United States Patent 7,745,391 (HUMAN THROMBOSPONDIN POLYPEPTIDE) - sequence listing, part 254

SEQ ID NO: 726790 - DNA, 880 bp, Homo sapiens
ctgctgacttctttgctgaaccggttagtccccaatgcaacagatctgcatagtgcctgttgcaggtattgtgctgactgctagatggggacagggatctactgtactaaaagcctcccgtacaaatgtggttgatcaggattactgccctccgatgcctttaacggcccaagtcagtacagggggcataattcgatcctcttcacttggcatatagaagttaccggcggtgcgtctgacacgcttagcaatcatcatggcctggttgcatgatgggtgtttgccccagttagctgcgagtagttgtgaattcagtgagatcgacagtgggaatgtggcctatcccgatcaactaacgaacagatgatgtccacgtggtaggaagctgttggaatgcaaattattatcacaaatagaggtgagagattgggacatccgtagtgtcggggaagttttcaggtacattgaacagagcagggtctgatatgacgccacagggttcactctccggttgatcaactaggaagaggctctccacaaggtaggtattgaatagactggtcctcgtttgccactagtaattgcaacacgatcatagaacgtcatattgtccaagaaatatagtattgccctcacgatcagaagagagaacacgtttggactccttattcccatggaaaggccttaacaaaaaagctggaatctggagttctccacagctaggcactataaagcgtgttaggaatgtatctgagccccgtgtatgacaggaactttctagtcctactatgtattcttcctaagtgggacatgtttaatgtaactgtcgcaaaggggtgatgcaggctggttgcatgcccaccttttttcagagtactgt

SEQ ID NO: 726791 - DNA, 370 bp, Homo sapiens
  misc_feature (135)..(135): n is a, c, g, or t
  misc_feature (152)..(152): n is a, c, g, or t
  misc_feature (158)..(158): n is a, c, g, or t
gtcccagggccgccgtcaccatgggccgcgagtttgggaacctggcgcggatacggcaacgtgatctcctacagattgtcgccctttgagcagcgcgccttcccaagctatttcagcaaaggcatccccaacgtntcgccgcactcgctgangcatcnctcgcgtgcgccgccgtttgtagtggtctacctgatctacacatggggcaaccaggagtttgagcagtcgaaaaggaagaatccagccatgtatgaaaatgacaagtagacggcctgcacctgggtgacagtcccctgcctctgaaagacccttctctgggagaggaatccacactgtagtcttgaagacaataaactacttatggacttcc

SEQ ID NO: 726792 - DNA, 291 bp, Homo sapiens
tcacaggaagcacatccataggaaaagggggagagtactacatcaaaggaataccccgtgagacaaaagaatctgaacagcagccttcagcctagaccttccctctgacagataaaaggttagttattaaattgaggcaccaggaaaaggcaaagcccaatgcaaggaactccaaaaaatgatacaagaagtgaagggagaaatattcaaggaaatagatagcttaaataaaaaacagtgaaaacttcaggaaacattggacactttgcatccagaggggtaccgagctcg

SEQ ID NO: 726793 - DNA, 1141 bp, Homo sapiens
gctggtgaacaggaccgttgccatgggccgtgtgatcccgtgcgacagtaggaagggcgccgggtcggtgttccgcacgcagagtgacatgcagccgtacaagggcgtctgcgtcgccgtgagagcaccgagggatttcggcgtggagaacgggacgcggggtacattcaccgggggcatcatcgaagtgtacatcatccagcgaagcccggagcccggcaaggagtcgcgcgccatcgccgaaggatgggatcttccgtggaagtccgatatcggatcgaagcaagcggtacagagacgcctggtgcaattgcctgccagaagggacaattcacagcgaggccaagtaaatgatgtacttgactgagcagatgaagggcccagactcaaccatgggacgacttgatgctccctgtgaggctaccatgccctgagggtaccaactcagtgttgctaagccatgcgagagaggaaacgacacttgaggacgcacctgtgggctgaggggtgtgaccccgaggacaatcaaggggagaacgtactgcacactcggtaaattcattcccaagagaacacttgtagagcgcagttgaaggaacctcggaaggttgaaagtcgtgcctctccctgggtatctgcaagcaaccgggtttacttcgatcgcattcaatggacccctatgatcaaagatggcaatggttgtggccacaggagaggtggtaacagataggaagccatagaggaaagcgttggtggcccggaacaagatttggaatcgaaaaaaccacgccatatttctttatgtaacatcgagctgtcgcgcaccagtagtgctagtttagcccaaaacgaaatacatcttactgtcatacgggggcaccgcacactcgcatcgcggcagcaccgttggcttaagggggctccaccacagagaaattttagcccgtgggagggtttgtttagggcacccaattaagaataattcccgatagggttagggaaacggcagaattccctgttttcatgggaagcagttggggcgaacacccaaaccccgagaagccagaccaacatcgcagagacacaggcccccatccacaaatccatgttcacagggcaaggaaggaatacgccccaccgg

SEQ ID NO: 726794 - DNA, 354 bp, Homo sapiens
  misc_feature (351)..(351): n is a, c, g, or t
tcagataagcagcagcgcagtgtagcacaaacgaagggcctgcctgctgtatcaaagaatggggtgggggcccggcgcggtggctcacgcctgcaatcccactactttgggaggccgaggcaggcggatcacttgaggtcaggagttggagaccagcctgaccaacatggtgaaaccttgtctctactaaaaatacaaaattagccgggcatggctgcatgcacctgtaatcccgactacgcgggaggctgaggcacgagaattgcttgaacctgggaggcggaggttgcagtgagccaagatgacaccactgcactccagcctgtgcgacagagcgagactccatctcanaaa

SEQ ID NO: 726795 - DNA, 385 bp, Homo sapiens
cttgatagcacttcgcactcaatgggctcgtccaggtagacatgacgctcttgaaacgggtgcaagttcggccgccaagtgaatatggccaagtctgacggcatcagagaatagtctgggggtgtctctcctaccagggacaaagacaagttcctccgaatccggagtgcccttcacaagcatatgcccatatcccacccaaaattttaaattacacacaaactgcacattgtataagcataaccagtgacacatcaactcttcacttgggtgggaacacaagacagcgcaagccccatcacctcctttaacacgctgcaacgctgtgatcacaaagagtccacatctgacagctcacagtccatctcgtgccgaattcctacag

SEQ ID NO: 726796 - DNA, 260 bp, Homo sapiens
  misc_feature (13)..(13): n is a, c, g, or t
ctatccagactgncatccctcgctgtcccctaacagcgacatagcccatccctgcctggtcacagggcatccccctggcactctgcggaccccagctgtgagccttggttgttggcagtgagtgagcctggctcttgtgcttggatggagcccaggctgcagctgtggccttgtccctcccacctctgtgacctcgggcactagcctttgctctggaggacaatgccccagagcagggtgtgggggatactgcaggcccc

SEQ ID NO: 726797 - DNA, 105 bp, Homo sapiens
ttgagctgcgagattatagtagggtcgtggtgctggacgtttaacgtttgacgccgtacggaactgcggtacatagttacggataactataaactagttacaatt

SEQ ID NO: 726798 - DNA, 948 bp, Homo sapiens
aacagttcggcggtcccgcggctctgtctcttgcatcaacagtgttgggacggacacagatccggggactctcttccagcctccgaccgcctccgattctcctctccgattggcaaactccggagtaccatcttctacggccatctcctgcttctgggacctgccagacaaccgtattgtggttagctccttcttgcaaaccaatcatgagctcccagattcgtcatgactttattccaccgatcgtgtaggcagccgtgcaacagtcctggtcaatttgtaacctgtaggtcatcataaatcatacctctctctgggcttctatttcgaccgcgatgactgtggctctggaagtgcgtccgcccaagtttctctccgcgaaattggtcgtggagagtaacgcgccgagggtgctagcgacggcggtgtcctgaaagattgcacacacacactagtcgttgccagtgtagcgcatcctctttccagtgacttcaagaagccagtttgacctatgagcgtgtggtaactatcccccattactccatgaaagcttgccagtggccctgggaacaaaaaggctgaaccacggccttttttgatctttcatgacctggttccttgccgtgagataacccgcatctctgtgacttcctgtagactcacttcctagatgaggaacgtgaagtctatcacgaagatgggtgccatcttgaacgatctctagggtgcgtggaccgagctggatgagcgagctctgtacgaagggtcattctaagccgaattaaactttggcccagaatttaggccctgaggataggcttgggaacttcctcctccaagggattttttcccaagcgggccacgcgaatttttaacagaaaaacacaatggcccgccaaaaaaatgtggcccgaccaaagctacactttttaaacacaggcatgtaga

SEQ ID NO: 726799 - DNA, 585 bp, Homo sapiens
cggtcctcatacggtccaggctactagggaggctgagtcaggacagttgcttgaacctgggaggtggaggttgcgatgagccgagatcacaccattgcactccagcctgggcaacaagagtgaaactccatctcaaaaaaaaaaaaaaatatgacacaaaattttatgtataaagtcccaggtaccctgccctgcgaacctatgtcataggttcgcaggggatctgaaaaattatgtaatagggagtgggaataaaactacttaatccctgtgggcgggttatattttaagctcaaatgcttggctttacccttgggttacttttatcctgtaaaacaaaattgaaaaaagattataataccaaagtgtagtaggttagggtgatggtaaaaactcttgtattaaaatgtcatggtggttgttaccttttttcagattccaagcttataaaaagcctgtatttttttaaaacacatcttaacctccacgctttacgattattataaaagttgaatggtccccctttggtaaggattttggtttacaattgctaggaaataactcactgatacctgccaaccttta

SEQ ID NO: 726800 - DNA, 860 bp, Homo sapiens
  misc_feature (23)..(23): n is a, c, g, or t
  misc_feature (158)..(158): n is a, c, g, or t
  misc_feature (174)..(174): n is a, c, g, or t
  misc_feature (201)..(202): n is a, c, g, or t
  misc_feature (228)..(228): n is a, c, g, or t
  misc_feature (268)..(268): n is a, c, g, or t
  misc_feature (286)..(286): n is a, c, g, or t
  misc_feature (292)..(292): n is a, c, g, or t
  misc_feature (333)..(333): n is a, c, g, or t
  misc_feature (430)..(430): n is a, c, g, or t
  misc_feature (432)..(432): n is a, c, g, or t
  misc_feature (460)..(460): n is a, c, g, or t
  misc_feature (467)..(467): n is a, c, g, or t
  misc_feature (474)..(474): n is a, c, g, or t
  misc_feature (479)..(479): n is a, c, g, or t
  misc_feature (491)..(491): n is a, c, g, or t
  misc_feature (507)..(507): n is a, c, g, or t
  misc_feature (514)..(514): n is a, c, g, or t
  misc_feature (517)..(517): n is a, c, g, or t
  misc_feature (520)..(520): n is a, c, g, or t
  misc_feature (527)..(530): n is a, c, g, or t
  misc_feature (544)..(544): n is a, c, g, or t
  misc_feature (546)..(546): n is a, c, g, or t
  misc_feature (550)..(550): n is a, c, g, or t
  misc_feature (560)..(560): n is a, c, g, or t
  misc_feature (575)..(575): n is a, c, g, or t
  misc_feature (593)..(593): n is a, c, g, or t
  misc_feature (619)..(620): n is a, c, g, or t
  misc_feature (639)..(640): n is a, c, g, or t
  misc_feature (660)..(660): n is a, c, g, or t
  misc_feature (670)..(670): n is a, c, g, or t
  misc_feature (672)..(672): n is a, c, g, or t
  misc_feature (684)..(684): n is a, c, g, or t
  misc_feature (704)..(704): n is a, c, g, or t
  misc_feature (707)..(708): n is a, c, g, or t
  misc_feature (726)..(726): n is a, c, g, or t
  misc_feature (731)..(731): n is a, c, g, or t
  misc_feature (761)..(763): n is a, c, g, or t
  misc_feature (771)..(771): n is a, c, g, or t
  misc_feature (773)..(774): n is a, c, g, or t
  misc_feature (779)..(779): n is a, c, g, or t
  misc_feature (787)..(788): n is a, c, g, or t
  misc_feature (797)..(799): n is a, c, g, or t
  misc_feature (827)..(827): n is a, c, g, or t
tacaaatattaaatctctccatnatgtctcaaacagtatcaaacaccatttcatatctctaacacagagcagagtcggcattcagtataagaaccaagtgaaaagtgttaaatttcaagcatctgatcacatcacataggtaacccggtaaaagattnagattgtacaatttancccaaaatccaactaatagcatctcanncaatatcctccactaagtaaaaaaanaaagtatctttttcaaaattgattaagagcaggaagttgngagagataaaaataaagnaaaaanacatcaatctaaaaaaaactccgattaaaaaccagaaaaanaaaaaaaaatttgtttatatccgggaaaagaagagaaagagaggtcaaatggggttaaaaaaaaaacatgaccaagggcaagacaaaccatataggnanacaaagatgatagccccagaaaagaaanaagtcanccatggntattntaacccatcacngtgggctattttgtgnggtattnccnccncttattnnnnatatagtgaaacantngttnctcgtttttnataattcaccacagnctttttcctttttaaacnccttgttatagacccaccaaaaaacnnaatttaaaagcgccctttnnagggacaaaccccacccccncaaaaggcanangcgtgcttttgnatctaaaaatatggtgggtnggnnagcccaaggctggggtcnccccntaaatggttacgtacagccttgatcatttnnngagctttntnntccantagctccnnccgaagttnnnactggggtttttggttggaatttagaanccgccacttgcctccctgatatcatccaatctt

SEQ ID NO: 726801 - DNA, 265 bp, Homo sapiens
gccacatctgccagagcctcgagtctgcgagggccgggacccggttccccggcccacagtggggggtgtgcaaacccgagagacctgggttgcaaattcgtgagagtcagcatcatgtttggcagctgcagtataggagccagaggcctcccatgaaggttttagaacagagtcctgttttaggagctggcagcagcatctaagccaaggggagggtattattccaggggatgtagtccaaggaccagctagctgccatcagttt

SEQ ID NO: 726802 - DNA, 204 bp, Homo sapiens
ggacggaatccacatgaaaaaaaccccacaagacaaagcaacatatctttgttgagaaggacaaaaaatgagagggataaacaaatgaggacaggccaggcatggtggctcaggcctgtaatcccaggattttgggacgcggaagcagtcaaatcacttgacgtcaggagctcaagaccagcctgtccaacatggcaaaacccc

SEQ ID NO: 726803 - DNA, 149 bp, Homo sapiens
ctgttgttgggacgggagcgagctggtccccaggtctcagtctggctgatcaggtcagcacaaagtcgcagccagcaagtactgccatgcgtccttgagtgcagtgacacagaccagccccgtgtggaggcgcctccatggcctctgct

SEQ ID NO: 726804 - DNA, 887 bp, Homo sapiens
  misc_feature (1)..(1): n is a, c, g, or t
ncatctatacagttatactagatatgccgccggatgcccttatatttcccgcaatgcgttcttcgcggggtttttcacagactcttcgttgtcgccacggtttttccccgcccgtcggattgcccttccccctcaatgttcgcgagtcctctacgcccccctgggagcccttatttaaatcatgttacggaggcaccttaaagacccgcttttggggaaaacaacgcgccaccttggggcccctccccggacagcctgtttgctaaccctgcacacgccgatccggggcgttttctactgcttccaaacccgccagcctgttcaagcgatatggcaccaccggggccgaccaacaatttactggtggggctccggacccttctctcggaacggggatctatcctggagttctccccttccccaagcactgcgtgggcggccccccccacaagttttctggcttccccggggcatgcaccaatacacgtgttccctctggttcggcccaaaaacgggtccccaccagcgcgagtttccacccacaccgagatgttgtacgaaggctcgccccccccttcggctgtctcaacgcgaggcgcgacgtcgttgccgctccccgtttgcccgcgtcaacaaccaggttcaacgcccttcatgcgccagatacaccacaccacccccctcatttgttctgggcccgactacacccccaagcccctttttggcgcctccaaacacccacatgtggctgtggggccccacgagctgtgtccgcacaacacccggctcggcccagaccacagatgcgctcccgggcaggtgggtgttggaaaatcctgtttttttgggggttttttttctcaaaaaaaatttcctcccccaacatc

SEQ ID NO: 726805 - DNA, 1074 bp, Homo sapiens
  misc_feature (110)..(110): n is a, c, g, or t
cggtgaaagcgaactcggtggtttattgcaatttttgtactctgtcccatgtaaatcggcaacggatggcttaccgatgcggggttagtggtgaaccaccttgcgtgacntcttagatcgatgcgtgcggtaattactactggcaaaatcctgcattgaatctgccaatctatcgttgtagaattactggtttagactcttatattgcattaaaggtgaatgcgtgatcacaagtattcccgacattgcgagggtgtaacaaggtgacctgcactgcaatagttgtgtcgttttcgtagcgttcttaataatgtcgtcaggagaaatagtcgaggagtgacatagcatcgggagtaagactagcttgaggcgatttttggaactactgtgtctctggatacccaattcagaagacgcagggggtgagacaggttcccagcacggaaggccaatggaagttattgcatctgctgaaagagcagctcgacgagatggggcttatcagatgtgaccttaagtgagaagggcactttgactggcgacgttaccggctaacgtccctggcgatatcccggcgagtggcttcatttctcatgtcggatacctcacgcggatggcagcgggaaaaatgtgaatccgcaaattgttgaaaactatcgcggtggccgatattgcgctgggtatcggcgatgacagttttatcagcgggttatgttcccggtgctgcatcaggtaatgggtcaaaacgctgattaacaccggatggtaaaaccttggtaaggttgccgatgacaaaacaggggatggagaaatcatgaacgggcctggcggcatgcgcaccagaagaacagattccccgggagggggggcatcacgcagggtcgcctttacccccggagtgaggcagctgtgcgcaaacgagggggaaaatattgtgcggtggagcctctcagttgcccatggaggtacaatagagcaaggccgctgcaaagcaacactcgacgtgtagaaatatcagaggcgagaatacagaaaacaaagcgagaagaacacaccggagaagagagcagaaaa

SEQ ID NO: 726806 - DNA, 106 bp, Homo sapiens
ttcatgataaggaaagagtgtgagaaaatggcataccagtgaaataaataagaggtctggtggcaagcggacaagagatgagtccgtcaaccccgaacacggaagt

SEQ ID NO: 726807 - DNA, 363 bp, Homo sapiens
  misc_feature (358)..(358): n is a, c, g, or t
gggacactgtatgttaaacagaactttgacacctgagtcttgagtctgaactgatccacacagctaagaaggcgcttgtatgccctcatctgtataacacacggaattgcacactgcacttgccgtgagaccgtagtaacaagactgcagatgtccgatttataccagcactggaatggactgccatactcccactgagatgtacactatggggctgaaatgcattctaagtatggtggctacaatcataaccagtctacacattgttacattcaaccatctttttagtagtgattcttaacttcagacttggactctagagcgtgcacttccaacttagtgggcactgtacttccgncagat

SEQ ID NO: 726808 - DNA, 422 bp, Homo sapiens
gctagtggtaagagcagcgtcgcagttgcaggcggcaggaagtacaaggcgggcgtaaagaaagtccgtccactacaaagaccgagtatgggtagaaaggagtgctgcagaaactgtaaccaaaggaggcataatgctaccagaaaaatctcaaggaaaagtatggcaagcaacagtagtcgctgttggctcgggtactaaaggaaagggtggagagatccaaccagttagcgtgaaagtaggagatgaagttcttctcccagtagtatggaggcaccaaagtcagtctagatgcacaaggattatttcatatcaagagatggtgacattcttggacagttcgtaaactgaaataagtcactattgaaatggaatcaacatgatgctgcccataccaatgaagttctgaaatctttcgtcat

SEQ ID NO: 726809 - DNA, 356 bp, Homo sapiens
ctaaaaatagtcaaaataaaataaaatagagatggggtctcgctatgttgcacagattggtctggaactcctgggatcaagcaacactcctgcctccgcctctcaaggtgttgggattgcaggcatgagccactgtgcctggtcaatggtgatttttaatctcttaagcatctaccaggtgtcaggcccttgctagaacgtccaatacttccaatgatcccaacagctctccaggggaggatgaacaagctcattttactgatgaggaaactgaggctgagagacttaacgtaatcccagtttgaccacattagaacacaggaattaaagaaaaatttgggaaagcctggagcatt

SEQ ID NO: 726810 - DNA, 132 bp, Homo sapiens
  misc_feature (7)..(7): n is a, c, g, or t
  misc_feature (130)..(130): n is a, c, g, or t
ccgtggntgcacctatcacagacttgaaattgtatgcctcagctttctctgaaagataccttgggatgccatctaaggaagaaagcacttaccaggcagccagtgtgctacataatgttcatggcttganag

SEQ ID NO: 726811 - DNA, 682 bp, Homo sapiens
cgccgccccttggtttctgggaagggccctctttcccgcctcttgtgggagatctcgctatttggcgccccccacgagaagaattatatgggaaccgcgcctttccagaaaatatatgagaagctccgcctatatgggagaaacacacggttcacacccccaactgggccacagactgctatagctggagccacatgcttacacagccccttagccacgagaggtgttctaccccccgtggaggccaggcctctcactgcctctcgctcacagtcacgtgcacgctaaccccccacgactgcccggcacagtggctgggttttcccaccacgaagtggtgttctagaatttatcacgagttacgaggaagacccaaactccggcacactgggtttgctcccctgagttataaagtggccttcacgccccaagagccactctttccctccctggtgaagatgtgacattcgaatatagatttgcacattccttattggaaggttagagccccctgctccattgtcattaagccccgaggccttggagtggccaacccagagcccaactgaagacccacctctctgcctgttcctcccacagaggcccgggtggccacggggtggtgagggccgttctgcacccagcccaacacattaccattaaaacccaacttctgtgtcca

SEQ ID NO: 726812 - DNA, 1009 bp, Homo sapiens
ccgcgtcgtgtccgctgggggcctcctcgccggctgcgcggtgaagtgatcatctgctggaccgaccgatccatccttttttctcgaacggtggcccgggggggtggagtgtgcctgcgtctgtgggccgaacactgggtgtgtgcatgggtgtcgagagccgcccggctggtcggacgctcgttgcgcggaacaagggtgctggggggggagagggttgctcagaccgccttgctccccacgcggttgtgggatcgaggccgcgcccgccccccagccttttttttttgtgggaggaagcgcaccgctgtgtcggcgcgagaccacaggggtggttgtgccccccttgttattttgccgtctgtaaacaattgcaccgcctcgtggggtggaggcaccgccgccacaccggcagggggagtggttgtttttttctgtgacgatggcgagaagtggtttgttcagcgacggctttttttttggggcgagcgtccacccacaggggggcccccctgctgtgtgtgtgtggttgctcgctcgcacccctccccacgacagcactggtgtgggggccgacgcccccccccctgcgtggtaggagggggtgtcctccccctcccccccgcgtggtggtgatctcttcggagggggtgtgttgggggcgcgccctcccctccctccccgcctgccccccctcttctagagtgggcgggccccccttctcctccgtgcgcggatccccccgcgctcctatagatgatgggcccgccgtgtgttgtggagggcggccctcgcaggctcccccccaccccggtggtcccccctccgtggggggcggccacccctttctgtgaacgatgcggtccccccctgtagcggcggtggctttttttggtcttttttcccccccgcgcgggggccagagggtccccccccccccccccttcttttttttttttttgtgtttttttttttttttttttttttttaatcctttgtggtggggaga

SEQ ID NO: 726813 - DNA, 874 bp, Homo sapiens
ggacgttccgggagcgccggtgttagcgtcggcggttttggcatggcgactttttctggcccggctgggcaattcctgtcgcttattccgcagaagatgtcgagtttcacacacggagggtggcactaggttcgcaaggcgcttaacccagcgaaaaataaccaatgaacaatttactccgtggagtagtctatgtgcgccaaccatacgcgtaaacctacttgacgaaaacgccagatctttgcatattgctcccagtttggcactgtgacacggtgcaggcttgtccacagaagtacagggacctggaaattatgcaacaggtgaatgcatcggtcgggagttggagtctgacggaatgttgccacgaataagttgcttggtatccaactgaagcaaactacctgttgtggtgaaagaactcttgggagtgtcagtttaagtgccacctgacataagtacataaagaactctttaaagactgaattatccatttaaggcagccatcatagtccatcaagtgagaggagtatgaatccgggaactcggggagacctaacaacgaaaaaggctaacgggcagtgggtgggagcgattttcaacacaggaaagtgagatgatttactcagggtacgcaaattcaggcttagaacaggcatttgaccttatgactcttcccttcttgtgcatttacaggaacaccgggccaggtatgtgcacaaactaatcgtgagacgttacgagagggcaaggtatcacgtccgcacgagaacacaagtgccgggaactctgcccaccctgagaagagttggatggccagcccacacagtggtcccaactttgggcagcgaactccacggttactgctctgtgc

SEQ ID NO: 726814 - DNA, 124 bp, Homo sapiens
tcggctcattatggatacacttaaaacgaatctcaagagggggaccattgtgtttcagataccatccctaaggagagtggttaacaggaagattgccagtgttactgaagaaaagagtgcttgg

SEQ ID NO: 726815 - DNA, 449 bp, Homo sapiens
tgggcatgtcccatgttcgcataaccactctactaggcgtggagcgatgtatagtgttccctggaagagacttaccttatgtcgggacgtacgggatcctagggagtccctggagacagagtaatgggccctcatccgataacttgcgagtggaggtataggggttgtggtatcaattttttttcctacaaacagtattattaactgccagcgcttaacccagaagtcatccactgcagagggattaaagtgcagatataaaatgctctcaaaaacttgtaacatgcatgggcgcgggtgggacgttcctctggactgcagaatgaataaagtgttgaatcctttggcatttgaaatcaagtaagtatgtttgggaagcagactactctttccctcatccaggtgtttaacatatccttatagtgctccgggatatatatctctggggc

SEQ ID NO: 726816 - DNA, 187 bp, Homo sapiens
ataaaaaaccccggggccgtttcccccttcggatttttgctttggccccgggggggtttccctttttcccccgggacccgtttttcccctttggccttttttggttccccttttgacccatttttttccaaaaacccggttggtcccggttcggattttccggggtttttttcccccccgggttcca

SEQ ID NO: 726817 - DNA, 152 bp, Homo sapiens
gccatgagcagatctgccactatgagctagcctcataggcgctcccagaacccacaacatagaaagaaatggtgctacccagctcaagcctgggcctatatgaatctaggacacaataaccctactagcttgcgacactgaatactgctagc

SEQ ID NO: 726818 - DNA, 731 bp, Homo sapiens
ctctatactaatctccctaaaaatctccttaatgataatatacacagccacgagaactagtcgatatttatgatctacttcgaagaaccacagttatccccaccttggtatcatcacccgatgaggcgaaccagccagaacgcctgatcgcaggcacatacttccttgattctacaccctagtaggctccgctacccctactcatcgcagtaatttacactcacaataccctaggctcactaagaacattctactactacactcacactgcccaagaactatcaaagtcctgagccaacaacttagatatgactagcttacacagatagtcgttataagtagtaaagatacctctttacggactccaacttatgatccctaaagccgcattgtcgaatgcccccatcgctgggtcaatagtacttgccagcagtattcttaagaactaggcggctatgatataaatacggcctcacagcgtcattcgtcaacccccctgagaaagacacatagcctaccccttccttgtactatccctatgaggcatacgttagtagcaaagctccatactgcctacgaaaaacagacgtaaaatcgctcattgcatactcttcaatcagccagatagccctcgtaaataacagccatatctcatgccaaaaccgctgaagcttcagcggagcaggcaattctcataagtcgccccaacgggcttacgatcctcattacta

SEQ ID NO: 726819 - DNA, 957 bp, Homo sapiens
gaacttgatgacgaaggaaaggtcatcaacagatataactagctgaaaatcctaaagagttagtctcacatcccagttcagacttggaaaggatagtctccagattcccttttcagaggttggttctcatcccttggaggatttaaaaccttagtacaaatagtcctagccatacttggcgaggtttgccttatactcccagggtctcttacccctcattgtcaaatacatatccaaacagcctatagaggctcttgtggacagacaggactaccacacgactaatggccctaactaagtattgaacccctgccacgaccaagagctacttcctcttgaagtacacatcgaagatacgtgatgctttctcttaaactttcacttcataatacacatgcatctaagaggcggggcaatgaagcacggaaatataagaacggaaaaacaagtaaagggaatacaagtcctttcctgaccagtctgactcactccaaagtcctgctggagctatgataattatctgctaaggccaggcaggggctccgaaggagtgggctccaggagcagggatgagaaaaacaagttctccttatcagtttccctgtttgaaattctctccccataacattattcttggttctgctctcacaacgtattttgtgtaactatttctgcaagtctgtaaaggatttggtaagtccttggttcgctttctgtagcaatggcaaggtcacaagacatgtctaagtaaggtaggctcatgttgcaaatcctgtgtcaaacctgtcaccggtatgattaactgccttttgtcctgcttctggtaagacttgcttttctcacctcgcaggttttgcgccaagaacccgacttgcccttgccttgatgcatgtttcaccagtcaagccctgtcttggtcccagggctcaggccttggcatgttatcccgctgggcca

SEQ ID NO: 726820 - DNA, 1817 bp, Homo sapiens
  misc_feature (1088)..(1088): n is a, c, g, or t
  misc_feature (1542)..(1542): n is a, c, g, or t
gccccttccgatctgcgtgttgttctgcaccgcggctcgcttgctcgggagggtggttgttgctcccctcctctgtggtatcctttgtggctccatcgtaggccgcgggttttgcttggcgggagggggtgcgaccacacgatgttctccctctctgggtttcttccctcggatgggctggtgctgtctggtgggaggtgagcccaccctggggctcgcctattgctcaccgaggggggggactcgtgcggggtcaaccacccttcttctccccggggtgcatgttgtgggtgcgcccgcgagcgcgttgtatttgtggttgttgcggtcgcgcacgccgtgttgctgtcggggacacagacgagggagcgtgctccatctcgatcgtagtgttatcccgtgctccccctgggtggcacccaacatgggtggggttcgcccggctccagcttgtggaagagggggggtgtttttggtgtgtgtccccccacaatggtgcgccgcccgctttttcaacccgccctccttcggtgagtggataattttgtggggggaggtcgcccccgcgtggttggtgttgtgccgccgccccatcggggtgctcctcctgctgcgtcgtatgtgtcggctccccaccattttctgtctatggggggcgcacttagtctacctttctggtctcctcggcgcaccgcttccgcggaatgttgtgcttctcctcttttggtgagaagcaccctcctgtgagagatttccagctcctgcggcggagaagcccatctgttgttgttttccgccgcttcgtgtgctctgctagaagaatagtctgcgtaggagaagaggaaaagtgatcatagaggagcgtccttctgcaatcaggaagtttattaggtagtattattaattaggaggaagcaggcgcgagaggcgctgtcatgtacttcgtcgtctgccagcaggcaggtcgttcggtctccatcagccagctcccaacatgctggtggacgcccaccagcttggtggacctcatcccccggcggcgttgcttcctctgctggagatgagctgggttgttctgtcttcttgcntcatcaccacagcggcttcgtgggttgatgacagaaggtggcgttgtgtagggtagcacacctgctgactctgcgccctcctgtttgtgtgttgtcgcgagactctggagagaggaggccacacagagagcgtgtgtgtgtctccttgccccctttctcccctttgttgagaccttgtaatagagaaccccctgagacctgtgtggtgttgtttgctgctgctcacacaaggcgcgacaccgcatgctcacactgtgtgtgttctgctgtgtgtgtgtctcgcctggtatagcgccacatatatatgtgtgagaggagagggtgtgcggagagagctcacaccgccacccgcgccacatggtctcacaccacatgagcccgctctcttctccacaccgcgtgagaccactgtgtgtcgctctccgctctcccacacattcactgtctctgttcnctcgttgtgtctcacgcagagaagagttgcgggcctcgagaggtggttctcccacttcttctcgttctcacaacttccatggggcacctcgagagctcgtgaaacttgttttcctctccctccattataaaattagaacacctcgaggtgatataaatttatctctttctcctaaatttcttgcccctcgaagaaggttgactgagttaaattaaaaggagaaaagagtttccttaaaatttgagagacccacaaattaatggaccccctgagga

SEQ ID NO: 726821 - DNA, 263 bp, Homo sapiens
agaggatccccgcttcaagtgatcctcacaagaaggcccactggaaaaaagactactggctgggcatggtggctcacacctgtaaccccagcactttgggaggctaaggcaggtggatcaggagatcaagagatggagaccatcctggtcaacatggtgaaaccccatctctactaaaaatacaaaaattagccaggtatggtggcacgcacctgttgtcccagctactcgggaggctgaagcaggaggatcacttgagccca

SEQ ID NO: 726822 - DNA, 290 bp, Homo sapiens
aatcttctattctagaattttgcatgcttgtgaagtttttagaaactgcatcatcattaagcaattaactgtggaaatgactttaaatagttatagttaaagacaattgataaggaaatttggttatctctgtggtctacaataacttaataaccataattagggtggatgtggtggctcattcctgtaatcccagctctttgagaggccgggttaggtggatcacctggggtcgggggtttgggaccagcctggccaacatggtggaactctgtctttgctgaaaataa

SEQ ID NO: 726823 - DNA, 219 bp, Homo sapiens
aagtaaggtactcagtcaacaaacgtcactctatgcactgaagaatctcagctcaccaagttcaaactctcttcttgacgtccaggaactggtattccatcactgcggcaagcgcagagctgaagttccataagtccacaagaaagtctgacaatgggtgtgtctgaccgacctgagaggcctgaacctgggtttcaactggaaaatgcctggcattat

SEQ ID NO: 726824 - DNA, 416 bp, Homo sapiens
acctcccggcttcacaccattctcctgccgcagcctcccaggtagctgggactacaggcccaccacgcgcagctaattttttttgtatttttggtagagatggggtttcgccgtgttggccaggatggtctcgatctcctgatctcatgatccgcccgcctcggcctcccaaagtgctgggattacaggcgtgagccaccgcgccgggccactcatttttaaataattaataattaacttagggaggaaaagatattgacaggatcttgataaatagctaatacattatacaggtgaggagtgtcacttctagctggggtggtcagagaagacttgggagaagaacatgaaacttctatgggctttacagagtgggaaactatgagtagcagtagacaagggaaacaccggggatc

SEQ ID NO: 726825 - DNA, 415 bp, Homo sapiens
atacataccgttcaggcttgagtgtctttgacgaccagcgtctgccagtctctatccaggttgttgcgcgccgccggcgtcacgcgcaaggccttgagccatagtgaaaaagggcgttgccggtcgctttgaatactgtcgagcacccgcgcacgggtacgctcgcctaagccctctatggtagcaagctcggccgcatcaagtgtcaaccaatcgagaaagcctgcgattagaccggcctggatcaatacgttccaggtttcgcgccccatgtggggcaaggccaggccgtgtttaccgctcagccaggtgaggcgtgcgagcagttgatcttcgcagccagcgtccagttgccagcagctcaaggcgtgtaaggcttgagcgatgggtacctgcacgtccacgcgtgtctcgt

SEQ ID NO: 726826 - DNA, 269 bp, Homo sapiens
aaaaatacaaaaaattagcctggtgtggtgatacacacctgtagtcccagctattcaggaggctgaggtgggaggatcacttgagctcaggaggttgaggctacattgagccaagattgtgccactgcactccatcctgggtgacagagtgagaccctgtctcaaaaaaagaagaaaaattctgtgatatttgttactgtcctaatctgagttgagatgaaaatatgcagtatatgatatagctacattatgagactatcatgtcagaa

SEQ ID NO: 726827 - DNA, 675 bp, Homo sapiens
  misc_feature (183)..(183): n is a, c, g, or t
ctatggaggtggggggggggccaaggaaatctatcagtttcccaagctttccccatcaccatttgattgatctccttaccctgttatttccccttcttgtcgcttacctgcagcatctttcccacccaggcctgccttattctttctaatggaaagcatgttttttttgggggggggccccgncccccctcttgctcttcctgaacgctccccccccgtcccttcgccgggcggcccggcctttatggttcgtttttttgtgttgtttgcccctctccccccttcctcgcctccaccctttcacggttcgcccctttctctcggcttctttctgcgagttttcttgtttttttattttgttttttttcttttcgtttctctctttctccctccctctctcatctccttccctcctcccctctccccccgtcccccctccccctcttcatcctcttttcttttccacatttctcgtccttcgttgtctttcttctttcttcctgccctgcctcccgtgccgtcgcttgttgtgtcctgaatttacctccttacttcttttctctcttctcacacctccttcctgtctctatcacccccttctccatcatctctctgccttctcccgaccgctttcattgtcagtgttcaaatcatccgatattatatataaataat

SEQ ID NO: 726828 - DNA, 567 bp, Homo sapiens
  misc_feature (465)..(465): n is a, c, g, or t
  misc_feature (563)..(566): n is a, c, g, or t
cctccccccaaatccccagccccccctaaggatggtccttgtcccaggcaaccagaaaatgtttttttgggccttccacaacccaagagggtttggtttgcttcaagacttccccccccccagaaaatagccatccattcttaacttattcccaacccaaatagggttcaactccaattgagggttataaccaatcccatttcttttctggttattataaccaaaaaatctttcctcttctcattaccagaaaaggctcttggtatctttctgttggaaagatttctaagaacctgtcttattttaaaggggggttttttttctggtaaaatttaaacctaaatcgcctcatgcccacttgtggctttgagactattcatcaagaatgaggatatagtagccctgacatagcttgagctaaagcctttaattccctactttggctatgggtggagggtgagtttnaaaaggtttttattttcttgtaacctgggaaaaccatgaccttgggccccattctttcaaattgctttgggtaataaatattggtggtggtttttttnnnna

SEQ ID NO: 726829 - DNA, 407 bp, Homo sapiens
cctgtgggtcaggctgttcttgaactcctgacctcaagtgatctgctcgccttggcctcccaaagtgctgagattacaggtgtgagctaccacaccgggccaggggtagtttttctttcttttttttttttttaaaagagggggggtctcattatatggcccatgtgggcttgggtctcgggggtccaggtgatctttgggcctcagttgcctaaccacaattttaaaggtgcacatttccttcataatcaagatcctttcatctcctttcttggggaaggtcatctatcattaaaggggcggctatccaggggcttttctcatagggggggatgggcggacgatgctggaagaaggggtaaaatatttgacggataaaaattattttttttggagacccggtctcc

SEQ ID NO: 726830 - DNA, 423 bp, Homo sapiens
  misc_feature (24)..(24): n is a, c, g, or t
  misc_feature (74)..(74): n is a, c, g, or t
  misc_feature (78)..(78): n is a, c, g, or t
  misc_feature (140)..(140): n is a, c, g, or t
  misc_feature (190)..(190): n is a, c, g, or t
  misc_feature (199)..(200): n is a, c, g, or t
  misc_feature (202)..(202): n is a, c, g, or t
  misc_feature (204)..(204): n is a, c, g, or t
  misc_feature (234)..(234): n is a, c, g, or t
  misc_feature (260)..(260): n is a, c, g, or t
  misc_feature (294)..(294): n is a, c, g, or t
  misc_feature (309)..(309): n is a, c, g, or t
  misc_feature (412)..(412): n is a, c, g, or t
tgtacaggaccgagcgggtggggngtgtgcacggggacgggggagagaagttgcccaatcacgccacgagcgtnggcnttcagggatgcggctcgcgcgtaagcatgagggtataggtgcgcaggcgcgggcagttcgcncggaaggcgttcagcaccgagtggcttaccacgcagaaacaatgcacctngcgcagggnngngnagcgccgccagctcctccagcgcggcgttnagctcggccgaagcggctgccgcacnttgagcgcgcacagggttgcggggtagtggtgtnctgcgaaggacaccnggggcctacggtgtcgcctgagaggttgaggcgcaggcagccaaggggacggctggctgcaggacgcgcgttacgctctcagcgggcagcgcgggctccagcnccagctccact

SEQ ID NO: 726831 - DNA, 856 bp, Homo sapiens
  misc_feature (30)..(30): n is a, c, g, or t
agaatagcctgaacccgggaggtggaggtngcaggttgcagtgagccgagatcatgccactgcactccagcctggcaacagagcgagactctgtctcaaaaaaaaaaaaaaaaaaaaaaaaaaggtacttgggggtttcccccggggtagggccctccagggggtttaagggggtttcccgggcgaaggcatttccagggggttgggcatccactcaaatttaggggggaaggaaaattatctctccaaatttaaaataaaaccctttatccaagaaaaatacccattccaagaaatccggcgagtcccttacccagggtgcctctaaaataaccttctcgagggaacattggggaaacaatcagtgtcgttgtcaattggcaacacctcaaattcttgtaattctctccaaacattaagcgcgcggaaggggtacacacgtgcgtgggggtcactaaaacagccacagccttataactttaggggggggtgtcctcctcctacgggagggggagggcattattaaaaacgtgggcgacacacctcggggttttaaatatcattagggtaattacccattaggtaccttattaaacccttttatcaaagttgggtctattgcggcacggggtggtaacccggcgggttatcaactcaaaggcctagtaggagtaccatatacacggacagcaacactacaacgtttcacaacatctggtcggggtcagggacacacagatacttttcgaattaaccgagggctccactacgaacacatagggacacaggggtcaggattccgcgaatcccattgtgggccaaatgtcgaccgcacaactgcgcgtcacgatcatag

SEQ ID NO: 726832 - DNA, 673 bp, Homo sapiens
gcaattttaaggataaaaactaacattggccaggcacggtggctcacgcctgtaatcccaacactttaggagaccaaggcgggcagatcacttgaggtcaggagtttgagaccagccaggccaacatggtgaaacttcatctctactaaaaatacaaaaactagccaggtgtggttctccagtgcctataatcccggctactcgggaggctgaggcaggagaatcacctgaacccgggaggcaaaggttgcagtgagctgagatcgtaccactgtactccagcctgggcgacagagcaagactctgtctcaaaaaaaaaaaaaaaatacaattaagaggggtatacggatgattcttcccactcattggttggtccagaagtaaataacatggtcggaagttgccaagtacctattggtttttgggggggtttctaagttagagtctggatctggtcacccaggctggagtacagtgggcaggatctcagcttactggagcttccatctcccaggtgtcaaggcgatcatgtggccaaagcctcctgagtagctgggatcacaggtgtgtaccaccacgcccagcggattttcggtcgttaccagtaaagacttcgccaggtgtccaggcatgtctcgaacgcctggcctaatgatctgccaaacatcggcta

SEQ ID NO: 726833 - DNA, 302 bp, Homo sapiens
gcaaccacattttttttttttaaacggcgttgggctcttgtagcccaggctgaagtgcaatggcacaatctcagctcactacaacctccacctcccgggttcaagcaattctcctgcctcggcctcccgagtagctgggattacaggtgcccgccaccatacccagctaattttggtattttaagtagagatgggatttcaccatattggccaggctcctctggagctcctgacctcaggcaatctggctgcctcaggctcccaaaattcaaggcgtacagatgttgaacaaccacgcccgt

SEQ ID NO: 726834 - DNA, 158 bp, Homo sapiens
ccgccgaggccagaagcggtgagatttgcacagtatttcaacacacccagctctgaacagacaaaacaatacctggggaggggagaccacaagagaatgttgcccaaagtgaaacaaatccacccaacaccttcatgtgactaacgtcacggtacacc

SEQ ID NO: 726835 - DNA, 2520 bp, Homo sapiens
  misc_feature (63)..(63): n is a, c, g, or t
  misc_feature (66)..(66): n is a, c, g, or t
  misc_feature (72)..(72): n is a, c, g, or t
  misc_feature (74)..(75): n is a, c, g, or t
agcgggtttcttaccgtaggtttctccctgttgaggcgaacgagctaaatgacctctccgggnggnggcggngnnctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttc

SEQ ID NO: 726836 - DNA, 579 bp, Homo sapiens
cggacgcgtgggtcgacccacgcgtcgcggacgcgtgggaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccaga

SEQ ID NO: 726837 - DNA, 1059 bp, Homo sapiens
  misc_feature (63)..(63): n is a, c, g, or t
  misc_feature (66)..(66): n is a, c, g, or t
  misc_feature (72)..(72): n is a, c, g, or t
  misc_feature (74)..(75): n is a, c, g, or t
  misc_feature (1039)..(1039): n is a, c, g, or t
  misc_feature (1041)..(1041): n is a, c, g, or t
  misc_feature (1045)..(1045): n is a, c, g, or t
agcgggtttcttaccgtaggtttctccctgttgaggcgaacgagctaaatgacctctccgggnggnggcggngnnctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtatgggaagtgaaggaactactcggcaactccaaaaatactgtatttgctttctccactttaccagtgtcatttttatctaaaacagtgtttcttgatgtttttttctgtgattgccccttaaggagccttttagacagttttttcctaatcgcccctgcccgccccaaagataatactataccaaatagagtttaataccgaacatatactgtgtgtctatttaggctattttaatatcgaagatatattgtatatctacttatgtgctgaatgcatgtctatgctttgtatgtaaaaaaatgttaanantttnttggctaccaaaaa

SEQ ID NO: 726838 - DNA, 295 bp, Homo sapiens
gtgcatttccaaaggagtagcagggcctgtggtggacccagcagaaccacaggagagtgccttgcctgtctcagtggaagtgtcttattgtcttaaggatagaaccagaggccctgaaggcagccacgacataactcccagcctgtgtaatctactggaaggcacattctcatttttgatgcagccaatttgtggaggcagcttttatcctttctctctgctgatatgatgaagtaatagggttttttttaacctctcgatgtctcgtctgtggatgaaaaaaaagtggcggccg

SEQ ID NO: 726839 - DNA, 505 bp, Homo sapiens
acaaaattttaaacagtggcaagacagaactgctaacaagaagggtctgatttacaattcattagtttctttgcttcaagaatgaagcctcctgtcctaaccatccttaaccccaaagcaggctaccttctccacagcttctcagctgggggataatgtaagttacctctatgcacaaacaagtgtatctctgtcaggatatcatgcagtgccaaccccttcagagttttcaactctgtaatatctagaggagcagttaaggcaaagggaacaagttccagaacaaacatactgcagagaattttgaatccaaacccgggcaagagactttttaaagtaaggcttttaatcccaacacaactgtttctctttcaacttgaagctgcacgtgttggactccaattctttatttttctttgtttcatcttcagtaagggctttctgaaagatagagttgtaactccttctagtagagaataaagccaactgcgttttcttttaaaaa

SEQ ID NO: 726840 - DNA, 5419 bp, Homo sapiens
  misc_feature (63)..(63): n is a, c, g, or t
  misc_feature (66)..(66): n is a, c, g, or t
  misc_feature (72)..(72): n is a, c, g, or t
  misc_feature (74)..(75): n is a, c, g, or t
  misc_feature (5083)..(5083): n is a, c, g, or t
agcgggtttcttaccgtaggtttctccctgttgaggcgaacgagctaaatgacctctccgggnggnggcggngnnctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagcttttggctctctgtttcatttttttccattaagaaaaaaaaaagtccccttttaaaacaagcagggctgggtgtgacggcacatgcctgtaatcccagcactttgggaggctgaggtgggaggactgcttgagcccaggagttcaagatcagcctgggcaacagagtgagataagacccaatctttatttaaaaaataaataaataaatagccaaaaaaacttagtgtggtgctggtgtgcatggtagccccagctactcagggggctgaggatgtggtggcatttacctgtggttctgtggttccggctactcaggaggctgaggtgggagaactgctcgagcctgggacatggaggctgtagcgagccacgatcgtgtcacggtattccagcctgggtgactgacagagcatgatcttgcctcaaaaaataaacacataaaacaagtagtacagcagaagagctgggaatggattggccaacgtttacatttcatggttatcttgaagttccaggtacagcagatgctgagcctctgggtggtttgaggcctggttggccatcagatatttagcttcatactttgccgctgtccttaagggggtgagtcctccatgaacaaagggaatagtgactttttccatttgacagtttaagaatttgacattttttaaagaacagcatctaaagaaagtttattctgtgatattagagacagaaggttttcatataaatgcaagtttgacaaagtcagcatctttctagctgtctaaggaagagtcacttgtaacacagccagccaggaggctgctttgttttttattataaagaacactaacacaaatgcagcatgattgctgtaaaataaatgtgaaatttgtacaaaagtcccagtccttccgcagttctaggtttacagtcaggctcaaccttacttgccccgctcctgcatgaaaacaagtgcgttttatacagcctctgccacccagtggcatagtttaaggctctatattatatttaaaattaaggtttttttcctatcatacacatcaatttggaacctgctggtgactcttctaccacagagggtaaataaaaagaccagtttttaaagtaagaggattcagctcatcttataaaagtataatagtttcggccagacgtccattaacatctgtttaaattagatacagacacaatgccaaatattagaatcataaatgtaattttggagataatgtttaccttgagtaggaagacacttggaccatattaaatttgaaagtcttctgttccagaccaaaatggggtaggctaattccctgtcatccaagcaactaaaaggtaaaaaccttataactttaaaataaaaaaggttatttttttcccctataaaagacaggcagtatgagttaatacattaaaattattttgtacatccctgctccaaacaaccacaaaaatggtactttttaaatgcctgcccatcctctcctggaagggggtttttccaagattcggggtgactgattcatcccacagccccaggcagcagtttatcctggaactgtcctctgttctcccatcactgctgagccctgagaattgtgaatggccctcagagcatctaggcctctgcaacaatcaggtctctggtgacttgaaatgcagcaatgagggagctcagctggatcttctcgttggtgccaacagaaagcctgtactcaatgtctgccattttggtcaataaatgtattcgaactgaagatggaaagtcaactctatgcacaaacaagtgtatctctgtcaggatatcatgcagtgccaaccccttcagagttttcaactctgtaatatttctgtaggctgtggtgaaatcttgattcaacatccagtccaggatgttggcaatgtctgacttgagcgggtgcccggtgcaggtgtagacagtctcctctgtcaccttcccaaaggccatattggtgctctgcaaaatgttcagagccctacgcatgtctccactggaaagagtgactagtgctttcattccatcttcacttatatcaactttctcttcttccacgacatgttccaggcggggaaccatgagttcaggagtcaggggaccgaaccgaaacctcgtgcagcgggactgcaaggcagggatgatctttgacagatagttacagatgaggcagaatctggtattttctgtgaatttctcaattactcttctcaaggcattctgggcgtcctgagtcatggcgtctgcttcatccaagatcactagcttaaagcctttcttaaatattgtccttgtgctagcaaagctcaggatcggtcctcgaatgatgtctattcctcggtcatctgaagcattcagctccaagaccatggagccaaattcnttgtctttatatagctgtttcgcacaggctaggataggtagagtgtcttgccgtgtgccctgggggaccgtagagaagcaagtgtggcagtcggtccttcagttgactaaagcttctgaatggtacctcagaagtgctcctagactgagcaaatagaagatcattgcagggtcatgtggccggtatcttttcaacccagggcaggtatcctgatctgtggtcggccgcgggcatgctcctgcatgcgttgagctgctgaggtctgccatggcggggagacgaaggtgaccagatccgctgagatcgtcgcgtcacaccaagcgcctgcacagtgac

SEQ ID NO: 726841 - DNA, 4793 bp, Homo sapiens
  misc_feature (63)..(63): n is a, c, g, or t
  misc_feature (66)..(66): n is a, c, g, or t
  misc_feature (72)..(72): n is a, c, g, or t
  misc_feature (74)..(75): n is a, c, g, or t
agcgggtttcttaccgtaggtttctccctgttgaggcgaacgagctaaatgacctctccgggnggnggcggngnnctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagcttttggctctctgtttcatttttttccattaagaaaaaaaaaagtccccttttaaaacaagcagggctgggtgtgacggcacatgcctgtaatcccagcactttgggaggctgaggtgggaggactgcttgagcccaggagttcaagatcagcctgggcaacagagtgagataagacccaatctttatttaaaaaataaataaataaatagccaaaaaaacttagtgtggtgctggtgtgcatggtagccccagctactcagggggctgaggatgtggtggcatttacctgtggttctgtggttccggctactcaggaggctgaggtgggagaactgctcgagcctgggacatggaggctgtagcgagccacgatcgtgtcacggtattccagcctgggtgactgacagagcatgatcttgcctcaaaaaataaacacataaaacaagtagtacagcagaagagctgggaatggattggccaacgtttacatttcatggttatcttgaagttccaggtacagcagatgctgagcctctgggtggtttgaggcctggttggccatcagatatttagcttcatactttgccgctgtccttaagggggtgagtcctccatgaacaaagggaatagtgactttttccatttgacagtttaagaatttgacattttttaaagaacagcatctaaagaaagtttattctgtgatattagagacagaaggttttcatataaatgcaagtttgacaaagtcagcatctttctagctgtctaaggaagagtcacttgtaacacagccagccaggaggctgctttgttttttattataaagaacactaacacaaatgcagcatgattgctgtaaaataaatgtgaaatttgtacaaaagtcccagtccttccgcagttctaggtttacagtcaggctcaaccttacttgccccgctcctgcatgaaaacaagtgcgttttatacagcctctgccacccagtggcatagtttaaggctctatattatatttaaaattaaggtttttttcctatcatacacatcaatttggaacctgctggtgactcttctaccacagagggtaaataaaaagaccagtttttaaagtaagaggattcagctcatcttataaaagtataatagtttcggccagacgtccattaacatctgtttaaattagatacagacacaatgccaaatattagaatcataaatgtaattttggagataatgtttaccttgagtaggaagacacttggaccatattaaatttgaaagtcttctgttccagaccaaaatggggtaggctaattccctgtcatccaagcaactaaaaggtaaaaaccttataactttaaaataaaaaaggttatttttttcccctataaaagacaggcagtatgagttaatacattaaaattattttgtacatccctgctccaaacaaccacaaaaatggtactttttaaatgcctgcccatcctctcctggaagggggtttttccaagattcggggtgactgattcatcccacagccccaggcagcagtttatcctggaactgtcctctgttctcccatcactgctgagccctgagaattgtgaatggccctcagagcatctaggcctctgcaacaatcaggtctctggtgacttgaaatgcagcaatgagggagctcagctggatcttctcgttggtgccaacagaaagcctgtactcaatgtctgccattttggtcaataaatgtattcgaactgaagatggaaagtcaactctatgcacaaacaagtgtatctctgtcaggatatcatgcagtgccaaccccttcagagttttcaactctgtaatatctagaggagcagttaaggcaaagggaacaagttccagaacaaacatactgcagagaattttgaatccaaacccgggcaagagactttttaaagtaaggcttttaatcccaacacaactgtttctctttcaacttgaagctgcacgtgttggactccaattctttatttttctttgtttcatcttcagtaagggctttctgaaagatagagttgtaactccttctagtagagaataaagccaactgcgttttcttttaaaaa

SEQ ID NO: 726842 - DNA, 227 bp, Homo sapiens
ccttgcttcgcttgttgctcgctctctcttctttgcagcattttctagcacgacctgctgtcggacggagatagcctgttctgctgcagcttcgcacgcctcctttgcctcttcccgggcagctgtttgctcagctgccttcttcttgacagcttctttacactctttttgtacttctacctgggccatcttccaacggttgctgattccatagatctcggttgatg

SEQ ID NO: 726843 - DNA, 693 bp, Homo sapiens
ctcactgcacattttgagaacaccatgaatctttacgaacaggccttgactgaagtcttgttgggcaagactgagcttttcaaattttatgacaccttgaagggtctatacattcttttatactggttcacttcggagtatagtacttttgggaactctatagcattcttagattcttctttggggtttgcgaaatttgactttaacttccaacgattaatcaggattgttctttacgtttttgattcctgcgaactagcatcactagaatatgccgaaatccaactcaaatatatttctctagttgtggactatgtttgcaatagaacaatttccacagccctggatgccccagcgttagtttgttgtgaacaattaaagtttgtattgactactatgcatcattttttggataacaagtatgggctcttggataatgaccccactatggccaaaggaattcttcgactatattctctttgcatttctaacgatttctcaaaatgctttgtagaccacttcccaattgaccagtgggcagatttttcacaaagtgaacattttccgttcacgcagttgactaataaagctctttcgattgtatattttgatttgaaaagaaggtccctacctgttaagctttaaagtacgataataagttcaacatctgggtataccgatcggagccggact

SEQ ID NO: 726844 - DNA, 4702 bp, Homo sapiens
  misc_feature (63)..(63): n is a, c, g, or t
  misc_feature (66)..(66): n is a, c, g, or t
  misc_feature (72)..(72): n is a, c, g, or t
  misc_feature (74)..(75): n is a, c, g, or t
  misc_feature (4624)..(4624): n is a, c, g, or t
  misc_feature (4633)..(4633): n is a, c, g, or t
agcgggtttcttaccgtaggtttctccctgttgaggcgaacgagctaaatgacctctccgggnggnggcggngnnctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagcttttggctctctgtttcatttttttccattaagaaaaaaaaaagtccccttttaaaacaagcagggctgggtgtgacggcacatgcctgtaatcccagcactttgggaggctgaggtgggaggactgcttgagcccaggagttcaagatcagcctgggcaacagagtgagataagacccaatctttatttaaaaaataaataaataaatagccaaaaaaacttagtgtggtgctggtgtgcatggtagccccagctactcagggggctgaggatgtggtggcatttacctgtggttctgtggttccggctactcaggaggctgaggtgggagaactgctcgagcctgggacatggaggctgtagcgagccacgatcgtgtcacggtattccagcctgggtgactgacagagcatgatcttgcctcaaaaaataaacacataaaacaagtagtacagcagaagagctgggaatggattggccaacgtttacatttcatggttatcttgaagttccaggtacagcagatgctgagcctctgggtggtttgaggcctggttggccatcagatatttagcttcatactttgccgctgtccttaagggggtgagtcctccatgaacaaagggaatagtgactttttccatttgacagtttaagaatttgacattttttaaagaacagcatctaaagaaagtttattctgtgatattagagacagaaggttttcatataaatgcaagtttgacaaagtcagcatctttctagctgtctaaggaagagtcacttgtaacacagccagccaggaggctgctttgttttttattataaagaacactaacacaaatgcagcatgattgctgtaaaataaatgtgaaatttgtacaaaagtcccagtccttccgcagttctaggtttacagtcaggctcaaccttacttgccccgctcctgcatgaaaacaagtgcgttttatacagcctctgccacccagtggcatagtttaaggctctatattatatttaaaattaaggtttttttcctatcatacacatcaatttggaacctgctggtgactcttctaccacagagggtaaataaaaagaccagtttttaaagtaagaggattcagctcatcttataaaagtataatagtttcggccagacgtccattaacatctgtttaaattagatacagacacaatgccaaatattagaatcataaatgtaattttggagataatgtttaccttgagtaggaagacacttggaccatattaaatttgaaagtcttctgttccagaccaaaatggggtaggctaattccctgtcatccaagcaactaaaaggtaaaaaccttataactttaaaataaaaaaggttatttttttcccctataaaagacaggcagtatgagttaatacattaaaattattttgtacatccctgctccaaacaaccacaaaaatggtactttttaaatgcctgcccatcctctcctggaagggggtttttccaagattcggggtgactgattcatcccacagccccaggcagcagtttatcctggaactgtcctctgttctcccatcactgctgagccctgagaattgtgaatggccctcagagcatctaggcctctgcaacaatcaggtctctggtgacttgaaatgcagcaatgagggagctcagctggatcttctcgttggtgccaacagaaagcctgtacctaacagaaaccaaacacagggtaagaaaaaagacaccaaacacagctgccttttcttaagggaccaagagatctagggctgaaaatctgttgaaggagtggggatgggaattgatagaacaaatgtgccctggatggcaatcttgtatgtgtccccctaacattttcttctctgccctacacattgatttataaatgtgatgtttcaaacttgtaaggaccgantcaattttnaaaattattaggtatcaggccgggcgtggtggttcacacctgtaatcccagcactttgggaggcgggcc

SEQ ID NO: 726845 - DNA, 134 bp, Homo sapiens
acccccccccccccccccccccccccccccccccgacgaacatattacaattgcagtccgttaccctttgtaattgtcttctctcaaaacatgattacaggacatctcaggctgactgtgctgtcctgacttgt

SEQ ID NO: 726846 - DNA, 4841 bp, Homo sapiens
  misc_feature (63)..(63): n is a, c, g, or t
  misc_feature (66)..(66): n is a, c, g, or t
  misc_feature (72)..(72): n is a, c, g, or t
  misc_feature (74)..(75): n is a, c, g, or t
  misc_feature (4505)..(4505): n is a, c, g, or t
agcgggtttcttaccgtaggtttctccctgttgaggcgaacgagctaaatgacctctccgggnggnggcggngnnctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagcttttggctctctgtttcatttttttccattaagaaaaaaaaaagtccccttttaaaacaagcagggctgggtgtgacggcacatgcctgtaatcccagcactttgggaggctgaggtgggaggactgcttgagcccaggagttcaagatcagcctgggcaacagagtgagataagacccaatctttatttaaaaaataaataaataaatagccaaaaaaacttagtgtggtgctggtgtgcatggtagccccagctactcagggggctgaggatgtggtggcatttacctgtggttctgtggttccggctactcaggaggctgaggtgggagaactgctcgagcctgggacatggaggctgtagcgagccacgatcgtgtcacggtattccagcctgggtgactgacagagcatgatcttgcctcaaaaaataaacacataaaacaagtagtacagcagaagagctgggaatggattggccaacgtttacatttcatggttatcttgaagttccaggtacagcagatgctgagcctctgggtggtttgaggcctggttggccatcagatatttagcttcatactttgccgctgtccttaagggggtgagtcctccatgaacaaagggaatagtgactttttccatttgacagtttaagaatttgacattttttaaagaacagcatctaaagaaagtttattctgtgatattagagacagaaggttttcatataaatgcaagtttgacaaagtcagcatctttctagctgtctaaggaagagtcacttgtaacacagccagccaggaggctgctttgttttttattataaagaacactaacacaaatgcagcatgattgctgtaaaataaatgtgaaatttgtacaaaagtcccagtccttccgcagttctaggtttacagtcaggctcaaccttacttgccccgctcctgcatgaaaacaagtgcgttttatacagcctctgccacccagtggcatagtttaaggctctatattatatttaaaattaaggtttttttcctatcatacacatcaatttggaacctgctggtgactcttctaccacagagggtaaataaaaagaccagtttttaaagtaagaggattcagctcatcttataaaagtataatagtttcggccagacgtccattaacatctgtttaaattagatacagacacaatgccaaatattagaatcataaatgtaattttggagataatgtttaccttgagtaggaagacacttggaccatattaaattttctgtaggctgtggtgaaatcttgattcaacatccagtccaggatgttggcaatgtctgacttgagcgggtgcccggtgcaggtgtagacagtctcctctgtcaccttcccaaaggccatattggtgctctgcaaaatgttcagagccctacgcatgtctccactggaaagagtgactagtgctttcattccatcttcacttatatcaactttctcttcttccacgacatgttccaggcggggaaccatgagttcaggagtcaggggaccgaaccgaaacctcgtgcagcgggactgcaaggcagggatgatctttgacagatagttacagatgaggcagaatctggtattttctgtgaatttctcaattactcttctcaaggcattctgggcgtcctgagtcatggcgtctgcttcatccaagatcactagcttaaagcctttcttaaatattgtccttgtgctagcaaagctcaggatcggtcctcgaatgatgtctattcctcggtcatctgaagcattcagctccaagaccatggagccaaattcnttgtctttatatagctgtttcgcacaggctaggataggtagagtgtcttgccgtgtgccctgggggaccgtagagaagcaagtgtggcagtcggtccttcagttgactaaagcttctgaatggtacctcagaagtgctcctagactgagcaaatagaagatcattgcagggtcatgtggccggtatcttttcaacccagggcaggtatcctgatctgtggtcggccgcgggcatgctcctgcatgcgttgagctgctgaggtctgccatggcggggagacgaaggtgaccagatccgctgagatcgtcgcgtcacaccaagcgcctgcacagtgac

SEQ ID NO: 726847 - DNA, 185 bp, Homo sapiens
  misc_feature (141)..(141): n is a, c, g, or t
cttgtgtaatatcaacaagcttaagatttgtctttgctagatagtgaactatactagtgttcgtcaattgacagacgtatatcgtgctcaggttattacgcatacgtagtgattggcaaacttctttatcttctattcgtnccttgattccaaagagaggtagaagaatctataagggtgagaat

SEQ ID NO: 726848 - DNA, 723 bp, Homo sapiens
gggcttttttcggtgttagattcaacactgcgctaaagcggggatgttccattgaataaaagagcagtgtggttttctgaaaaaaaaaaaaaaaaaaaaaaaaaaaaaaaaaaaaaacaaataaacaaataaaaaaaacaaaaaaaaaaaaaaaaatacacacacacaataaaaaaaaaataatacaacaaaaaacaaaaacatatcatcacacattatattcttagtccaaaaattcacaaaaaatcaagatactacatacaccatcttcctttcatcccgtccacacacactatcatttactctaaacaatacactaaaatctgacttgaatactactatatgcatcctagcaccatcgaagcaatgtgcagaacctactaataagatttgcactggctacatatcacaactacaccactacactacaaaacaaacacgcagacctgctttcttccagctaactcactccactaagcttattaatattaaataaacaccaacatctcaaccctctgctcctatgagatgaatcctatttctaataaaaagaagaaaaaaaaagaaacaataaaacaccttagtccatatcttctctcatgtgtcattaccccttcaagcccttccccttattatatcctcttctcccctcactcacttgagctctactttcttactcttaactctcaaactaaacacatccccacccacccatgtctgtgg

SEQ ID NO: 726849 - DNA, 5361 bp, Homo sapiens
  misc_feature (5025)..(5025): n is a, c, g, or t
agcgggtctccgcccgcgcccaccgccatgtgacgggaagcagctgattgcctctccgggcggcggcggcggctggccggggcgggcggcgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagcttttggctctctgtttcatttttttccattaagaaaaaaaaaagtccccttttaaaacaagcagggctgggtgtgacggcacatgcctgtaatcccagcactttgggaggctgaggtgggaggactgcttgagcccaggagttcaagatcagcctgggcaacagagtgagataagacccaatctttatttaaaaaataaataaataaatagccaaaaaaacttagtgtggtgctggtgtgcatggtagccccagctactcagggggctgaggatgtggtggcatttacctgtggttctgtggttccggctactcaggaggctgaggtgggagaactgctcgagcctgggacatggaggctgtagcgagccacgatcgtgtcacggtattccagcctgggtgactgacagagcatgatcttgcctcaaaaaataaacacataaaacaagtagtacagcagaagagctgggaatggattggccaacgtttacatttcatggttatcttgaagttccaggtacagcagatgctgagcctctgggtggtttgaggcctggttggccatcagatatttagcttcatactttgccgctgtccttaagggggtgagtcctccatgaacaaagggaatagtgactttttccatttgacagtttaagaatttgacattttttaaagaacagcatctaaagaaagtttattctgtgatattagagacagaaggttttcatataaatgcaagtttgacaaagtcagcatctttctagctgtctaaggaagagtcacttgtaacacagccagccaggaggctgctttgttttttattataaagaacactaacacaaatgcagcatgattgctgtaaaataaatgtgaaatttgtacaaaagtcccagtccttccgcagttctaggtttacagtcaggctcaaccttacttgccccgctcctgcatgaaaacaagtgcgttttatacagcctctgccacccagtggcatagtttaaggctctatattatatttaaaattaaggtttttttcctatcatacacatcaatttggaacctgctggtgactcttctaccacagagggtaaataaaaagaccagtttttaaagtaagaggattcagctcatcttataaaagtataatagtttcggccagacgtccattaacatctgtttaaattagatacagacacaatgccaaatattagaatcataaatgtaattttggagataatgtttaccttgagtaggaagacacttggaccatattaaatttgaaagtcttctgttccagaccaaaatggggtaggctaattccctgtcatccaagcaactaaaaggtaaaaaccttataactttaaaataaaaaaggttatttttttcccctataaaagacaggcagtatgagttaatacattaaaattattttgtacatccctgctccaaacaaccacaaaaatggtactttttaaatgcctgcccatcctctcctggaagggggtttttccaagattcggggtgactgattcatcccacagccccaggcagcagtttatcctggaactgtcctctgttctcccatcactgctgagccctgagaattgtgaatggccctcagagcatctaggcctctgcaacaatcaggtctctggtgacttgaaatgcagcaatgagggagctcagctggatcttctcgttggtgccaacagaaagcctgtactcaatgtctgccattttggtcaataaatgtattcgaactgaagatggaaagtcaactctatgcacaaacaagtgtatctctgtcaggatatcatgcagtgccaaccccttcagagttttcaactctgtaatatttctgtaggctgtggtgaaatcttgattcaacatccagtccaggatgttggcaatgtctgacttgagcgggtgcccggtgcaggtgtagacagtctcctctgtcaccttcccaaaggccatattggtgctctgcaaaatgttcagagccctacgcatgtctccactggaaagagtgactagtgctttcattccatcttcacttatatcaactttctcttcttccacgacatgttccaggcggggaaccatgagttcaggagtcaggggaccgaaccgaaacctcgtgcagcgggactgcaaggcagggatgatctttgacagatagttacagatgaggcagaatctggtattttctgtgaatttctcaattactcttctcaaggcattctgggcgtcctgagtcatggcgtctgcttcatccaagatcactagcttaaagcctttcttaaatattgtccttgtgctagcaaagctcaggatcggtcctcgaatgatgtctattcctcggtcatctgaagcattcagctccaagaccatggagccaaattcnttgtctttatatagctgtttcgcacaggctaggataggtagagtgtcttgccgtgtgccctgggggaccgtagagaagcaagtgtggcagtcggtccttcagttgactaaagcttctgaatggtacctcagaagtgctcctagactgagcaaatagaagatcattgcagggtcatgtggccggtatcttttcaacccagggcaggtatcctgatctgtggtcggccgcgggcatgctcctgcatgcgttgagctgctgaggtctgccatggcggggagacgaaggtgaccagatccgctgagatcgtcgcgtcacaccaagcgcctgcacagtgac

SEQ ID NO: 726850 - DNA, 2960 bp, Homo sapiens
  misc_feature (63)..(63): n is a, c, g, or t
  misc_feature (66)..(66): n is a, c, g, or t
  misc_feature (72)..(72): n is a, c, g, or t
  misc_feature (74)..(75): n is a, c, g, or t
agcgggtttcttaccgtaggtttctccctgttgaggcgaacgagctaaatgacctctccgggnggnggcggngnnctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagctaaaaaaaaaaaaaaaaagcattaatcgacctaacttcacaccatttcgctcaacccatccaatgcaatcgctatcgttcactcactcaacaggttcacaaatctactcattaagctcctgtcaaccctcgctacaactgatcatctctgcgcttatccatccatctactacaagcactccgccatcccccatcctcttcacagcctcctctgtgcacacttctcgtaccccctttcaccatcacttccaccaccccatccttcgcccctttgtcttcactctcct

SEQ ID NO: 726851 - DNA, 388 bp, Homo sapiens
gcggccgcctactactactaaattcgcggccgcgtcgaccgttcctttccactcttgctttccattccatctgactccattccacttcactccactccattcccttactttccattccgtttccattccatttcactccattgcattccattcctttctttcgactagctatcactgtgtcacccaggctggagtgcagtggcacaatctcagctcacattacatgtcaactttccattgcatcgcattctcttccgttgccttccactacattgcattccattccagtcaattccattctattccactccattccactccactgcactacactgcagtacattccattccattcattccattctactccattccactccactgcact

SEQ ID NO: 726852 - DNA, 654 bp, Homo sapiens
gttctagatcgcgagcggccgccctgcttcttttctgaccgggaaataaatgcccctgaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaacaaaataaatagaagaaagaaaagaaagaagataacaaatggtttgtaaagatattattagattgcttctttataggaatcagtctgactattatgaatcactacatcatacataacacacgcgcagacagatgattcatcgccagaggcagatggtaatgtgtcggctggtagtttctctggctagctgtgtgtgactactaggtaagagtagcgtcgattgttggagatgctaattaatatgataagacgagcgtagcgagcagataataaatagaatagaataaatattatgagcaagcacggatacgagttagatattacgggcgtgatcgtatgcgatgaggagtgtcatgtgagtctgtaattgtctcgtggttgggggtagtagttgggcggtgggagcgagaggagggaggtgcaccaggggggagaggtgggtgcgcgtgcgagaggcggctgtgagggccgagtggagaggcgggggggggggt

SEQ ID NO: 726853 - DNA, 376 bp, Homo sapiens
ccttttttgaaccaaccatggtcatgtttttacctcagggcccttgcacatgctattccctctgcctggaatgccctgtgccccctttgccctttgccgtggtaaaaaatccctcatcctttaacttcaaaatccagggcccttttttccctgttaccctcaggcaaaattaggtactctttcctctgggccattgttttaaatcttcgccccagctcttttcccgttgtattgtaatgatttggttatgtttaccctccctactagactgtgagctccaaagccggccgtttttattattcccttttggacccctagtgttttttatggttttccgccccctataaccggggccccataaatatttttccaatta

SEQ ID NO: 726854 - DNA, 1011 bp, Homo sapiens
tcgggggccgcagaaaatagaaactgaagccgatggtcacgatgacaggacatgtagtatatagcaggctagccagcgactccatgctcattgcttctggatctgcagggcaagtcccagcaggacccatggcagtgtccttcgatgccagcatgtcatccaaggcaggaaacccccaagatatctgcagccagtgcgggagagaggctgccatcctgcagacccccatagcagattcgtgagaacaataactccacaagggcgtcaggcctcggcagggtgcacaataggcagtagtagggccaggcagctagaaggaggaagaggggcccagaagcataagtaacccgggactcaagcaccagtaaggccaagcaacaaccccgaaggcagcccatagtatccgaacagcctcctagtgcacctgtcccaagcaacagcaaaaagcacagcaacaaggcacagaagcaaacaagcacaggggcaacaaagtccggcattccatacagagcttgagattccatatgacccacatatatctacctgccagaccacctgataacactgcacattgtggcttttcaaaagcccattggcgcgtcaagcgacacaccagaacactgaccaccaacaggacaaagacccaagccagacagtgggacacacactagggcccagagccgaagcccgaagaacccacgaggaacaacaagcacaacccaacgacgcaactggaagcggtggaccgggcgctcatccaggagcaacaacccgaaggggtatgggaggaacaggcccccgccttggacaccacgggccccaaggggccgtcaagcgggcaagcacacggccagcggaagctgcggacaacacagaggcacacagcgcgagaggacactcagaaagccaagcacacgagacaacagtaccaaaggaaccacacaaaagagacaagcggggagaatgaaacccagcgaacaggcatgcacagatccccacatctcgcgaaag

SEQ ID NO: 726855 - DNA, 289 bp, Homo sapiens
atatcaaggaacgagtacgggcagatatacggatccccacataaaaatgcttcaggttaaaaagtgaaggggaaggcaaaaaaatcaaccaataaaatgagaagtgtcgatttgcagcatgaagcactactctaggtataaattagtcagcccagatcccagacagagatgatactccaaacatgaaaagtcaccgtccaagtctcaattcactactgagaacccaagttcaaaatatcccctaaaattccataaaaatcaggaaagaccctagctgggtagtcagaga

SEQ ID NO: 726856 - DNA, 1566 bp, Homo sapiens
  misc_feature (1566)..(1566): n is a, c, g, or t
ggcgtgcaccaccatgcctggctaattaaaaaaaaaaaaaaaaaaaagacaacttttttgggagagggagggtctcattaggtgggctcagggctgggtattggaactcaaggtggatcctccgtacgttggacctcccataagtggctggggattacacgctggtgagctggctggtgcctgggcctcattggtgggtattacaatttggagcactttctcatcttcctttattaggacctttctgttggtacaaattggtgctatggagggtgtctttggcgataatttataacaatcgggggtaattggagtttttttcttggtcattgggctggcatttgggcataggttttattttttttaaacttctccttaaaggtgggtcactggacggtggtgggccggggggtgagacaaaccttcttggggcgctaagtgtttggcgacacagggtcaagaggtggtggtgcaccgtgaaaatggatggacgctaaggatgtggtccccaaagacaggggggtgtaaggggagaatcccaccgcggtgttgtgcccccggggaggggggatccgggcttaggtggagcagaatgtgatagtattagaacctccttgggcaccttgggttgggagccttttggcaaaaaacccttctttgggcaaaaaccaaagggtggggggtcaaaggagactagtggcgtaacactcccagggggtcgccgcgcccctcaggggggcccaggagggacggagaaacacagagacaaagcccagaaacgggcgggccacggggagaccatggggttcgcttgggagaaacacacacaaccacggtacggagtcactatcaaaacgagacagggtgggcgagcgggcaaagaaaaaaggaccccctgtggacacccatcatacaacaaccgtgaggaaggacatccagtctgtgggccggcacaatggtggaggaccccaccccgggagagaactagggggggacgccacacaggtgggaaaaggagcacgctccccgctcaaaagagttggtgggggggaacaccaatgatgttactcagaaggccaagcggttgcgcaaaaaaaaaattctgggaagcgtcgcacaaaatagcgcggggtagagacgacagcggggatcaccgacagaaaaaaagggaaaagctgggcattatagggggcgcacccaaatacgaagtacacacacagggggggcgtttgtagcaacgattcagaaaaggcacccaggcgccgcgaattaggtggtgaccagctcgtataaacacgtgctattgggaggataaccagatggcggaaataatattagaatgatgaaaaaagagaggagtgtgagaaaagtgataaacgtcgcataatatgacaacaaaataacgacgagtgggggaggcgaattaatccatgaataggaatgcagcaattatattcagctgtgttgtagttatacaagtgatcagatgggaagacatgaccaagttaatgaactgagaaagtcatctttatttttttctttgcgtagtgctagtgttcgacgaan

SEQ ID NO: 726857 - DNA, 657 bp, Homo sapiens
agcgggctctcggtcccccagccctggcgcggacggggtggttccagctcactctcctcccccgagcggcagcggcagcggcggcggcggtggctgctgcgggcgctgaatgagagacggtgactgttcgggtcgacgatgtgctactctaggcggcggcgagcgtggcgtgtgcatgcgtgacggccggcatcgtcctttccgtcctctgagggcgacggcgcgcggctgcacaggaataatgtatttgtggcctaggacgatgcaggcagtcagctcctctgatcgctgtcaacatagggtcagggactgaatgaggaaatgcatggaacctaagtgaatcgggcaggcaacgcagtgtcaatatggcaagctactgctttctgagcaaaacgtagcagcatctgcaagtccttaaagtgacaaaggctctgaaattgcacgacaagctatcgagtgctgtggtatccgagtgtacttacaggttacaccagacagaatatgcgggcgtcggataacgatcaatgggatgttcccagatcatataaaagctgattcaaaccagcatgaagcttgccaagtggtaggcatggcaatcaacagcaggacacacatataactcctgcacccaaatgcaggtcgcctatcacaagaaga

SEQ ID NO: 726858 - DNA, 355 bp, Homo sapiens
ccatgtgggcatacgggcacttccgtacagcgtcatttactatgtgcattgtatggttatgggaggcaatttttattttacaataattttttattcatcccttctttcattctccaactcagttattccagtttaaggtggtgggcgaccagagcctatcccaacagctcagtgtgcaaggcagggaccaccctggacaggatgccctcccatcacagggcacactcaccccccacacacactcagactgcgaccagacaccaacaaacctcacctgcacatctttggggcgtgggaggaaaccagagtgcccagaaagctctccgaccgggaggacgtctagacggtgcacagg

SEQ ID NO: 726859 - DNA, 340 bp, Homo sapiens
acttgtagctcccataatcctatgcattgtgggagggacccagtgggaggtaaccgaatcacaggagggtttttcccatcctcttcgcatgacactaagtctcacaagatctgatggttttataaacgggcagttcccctgcacacgctctctcgcctgccgacatgtgagacgtgacttggctcttctttggccttccgccatgactgtgaggcctccccaaccatgtggaactatgagtccattaaatcttttgctttataaatacccaggctcgagtatgtcttcatagcagtatgaaaatggactcatacaatcccttcccaattccccaggggcg

SEQ ID NO: 726860 - DNA, 733 bp, Homo sapiens
accagcgaagctgctcacagaggctcaccctttgaccactttcctggtgcacagccagactccctctctgggtgaagctttttccacactgtgccgcacagtatagggtgtctggctgtgcaccagtcgcaagctgctcacagaaggctcagccctttgtaccactcttcctgcatacgcagaagtcctctttatgaattaagagtacaaaatcctctgatgatgaagctaacctatccagttctatggaatgaatggagcatatcttgtcagaatagaccatcattgggtagggcacactgatctttgtcctattcccccaatagagtatgagacataaactgtcttgtgtgatttatcattaaatagaaaaaaatacaacaataacccttaacacaagggggggctttacccgaaatgtcccctggggaggcgccgaaacctaaactggacaccccacagttgtttgttcagagaaggggtccccgcaaaatcgtgaggccacatatttttatgacccagggactgtgtgcccagacacagtctatgaaagtcatcaaggtgactggggaaatcaccgagttgacgactggggaacatcctctgcacaagacaagacgcttgaccattagtggcggtgcaactgatgaattgtggcacgaaagaatgcaagcgaagttgttttaatgcgctctaggggacatttcacatgtctcaacccggataaaacagg

SEQ ID NO: 726861 - DNA, 928 bp, Homo sapiens
gatgtcgaagcgaaggacgttggtgggtcctctggtgcgaaattccggatttccttgggtcttccggtaggagctgtacatcaatatgtgctgactacacaggagccagaaacctgtatatcatctccgtgaaggggatcaagggacggctgacatcagaaattcccggatgcatggtgtgggtgacatggtgatggccacagtcgagaaaggcaaaccagagctgcagaatagaagaaggtgggcatccagtcagtggtcattcagacaatagaaagtcataccgtagaaaagatggccgtgtatcttctattttgaagataatggaggagtcatagtgaacaagtaagaggcgagatgaataggttctgcacattaccaggaccgagtagcagaggagtgtgcggacttgtggcccgggattgcatccgaagtgctggccagcatggcatgattctccagtatattgtaaaaaatataagagaagtgttgataccaatataaggtccattaacaattcaggtttcataacgagaaccatcctaaaattctgtttctagattttaatgtcaagttcccaagttccccctggtggttctaatatgaagggagtgcagcttctgctaggcaataagatttactgatggcagtagtatgcaagctcaggagatttgagcatacagataggaggcgggatgaaagacacgttggatccctatagattttgtagctttgaaaggccatggtgggggaattacaataccccggtaatgtaggttgtctataaattgcgtgtggacggcctttgtcggaaaagtgcagattaaaatgaagggggagaacggggggggcagttaagagcccaggaataagaggatgtggaaggaagaagggaaaaaatgagtcgagtggaaggtatgcggtgggc

SEQ ID NO: 726862 - DNA, 155 bp, Homo sapiens
cctgttttaattttttttccccaaaagtctttaaacatcatgccagcgggtgagccgagcccagtgtatattaattcttgtcgtacggcccgcctttctctgtccccatgagtatggcatggcgggcagcataaatattaattctaatagctctg

SEQ ID NO: 726863 - DNA, 964 bp, Homo sapiens
gcaaagcggtgtgtctgcaggcggtgttcccaggttccctcggctgtacctcgcgcactcgctcttgctccaggtccttcagtctccgctcgtctcagcgtaggctgtgacgacgtgagcaagaaagaaggatcaggagggttcaggaaaaggaagcatgacaattgcccaccataaccaaagaagagaagggaaggatgttgaagttcatacttcacaccgtgatgttggcctttaagatcatttcaggcgaggaacttgatgcaaggcgatgacaatggtatgagagacttgtgaaacattagtgcgggatatagactgttgaaagtagaaaggacaagtttattctcctccataggattgacaagtgctccctgatatggaagatatattgagtgaatcagaaattaagatgtggatggtgttcgcgacgaaaacagatattccgggtagcgccaagggagctatcaggggaagatatgcgtcagattgccatcgaagaccattactacaggagcgtacaggaattatgtggaagctggtctctgttcaagattttcatcagaagacgatcaggaattagtatggatgaaattaatgaacaaagtgatatatatgactgaagacttgggactgatcatacaatcgcttctctgatgggcaggattatgcagtcggtacggtgcgagactgcgagtcgcgacctgtcggctacttgctgggagtggctggtccacctggagggacgtgcggatgggtaataagccgtgccgagaagggggacattgaaccccctatgaagagagggagcaaagcgtccgtctgccggtggatgcattgggcaccggcctgagaaggtcagcacctggtccccaacagactggggcgtggcacaagtgttcgcctcaatttccggtgattccccatttgggatcctgcactacgggagaacaaaagggcaaac

SEQ ID NO: 726864 - DNA, 107 bp, Homo sapiens
gttctttgagatatcatctgaaactgaggcgataacttctgaatgtttcaagtttgaaaatcaactattcttgctggacgcggtggttcaatgctgtaatcccagca

SEQ ID NO: 726865 - DNA, 1391 bp, Homo sapiens
  misc_feature (342)..(342): n is a, c, g, or t
tgattctgtccatggcacgggctggtcccaggtactggagcgaagtatcagtggactcccgccacgatcaggcgcgagacagctccaggcatctcagtgtcccaagcagggttcatggatcaccacttcgttgagacatcgctcgggcgatcaacggacgagcgtagcgtacacgtactaacggggatcgcatacacacggagacatatcggctagactaggcttcctggatcctttcagggtcccattacaacaaggccacaacacagcctcccaagggatagtggtctgaatgcactccacatggcgcagagtcatgcgatccagagataggtgctagangcatgacagatatagcatcgctaactgacgggaagcacgtcacggatgaccgaggttccaggtgctcctcatggaggtaccatcggtgcgaccctactgaagatgactttaccctagggtccaagagtcctcgaactaaagctccttcagcaacacgttcgcacaaggcttcccgaggcgctacgggggtttgattatacgaccgtcgcgagtgttcgccaacgcgcaagcaaaagcctaagcgcagcccctacgcggaaattcactaggactcgttgtcacgggccccatgggaacaacggtgaacccaccggataggagcggccattagagccccaatggcagcggcagctgccttgcaaagaaagttgccgagactttcttcgccagttctgggcctttgtcccacgcacgagatcccaattctattggcggacttcctcctcgcgtcgggcgagataggccatgcgtccataccgagaggaattgagtctctccccttaacggaaccaatcctccccgctggggacattacccttcattgcgaagcgcggcccggtatttgcgcagacaccgaagatccaagttgggttaaccacgtggcgttttccaaccccctttggtgtaccaagcgttcccagtaacttacctaagattaagcctgaggttagagagggaacacagttgaggttccacctttaatacgctgtacgctcccatttttaagccaacatggaagtttccttgacggtttattttaacccttccaaggggggaacattatcgcacgctccggtcggattggggccagcggacccttcaagcaacgtatggcttaacgcgttatcctataatgtctgtttacctcccaaatgccttggaaaggggtccccctagtaataaagcgcgcaaagatgagtggggtggcaggcacgcagggctcctacgctgtgttgggacgaacctttggcgacacgtcatcatttggggcaacgtctcgcagaagtctactgtacgaatcacacaggaggacgaacaacccgcgcggg

SEQ ID NO: 726866 - DNA, 107 bp, Homo sapiens
ggtgtctagaggatcccgtatgttctgacccactcttatgttctgaccacgcgcttatggtcagaacataagagtgggtagaacataagggggggtcagaacataag

SEQ ID NO: 726867 - DNA, 393 bp, Homo sapiens
  misc_feature (386)..(386): n is a, c, g, or t
gacttcatttgaacttttcagtactatttgttgatttcataatttttcgagcactgctgttgaaactgcctttgcaaaattacaactgggggaatttattgatagggggaggaatcaggccttaaccgcttccattttggcttctaaccttaaaggcgtcctaattaaatcccgggggtttggggggacctaccttggggggggaattaaagtttagggttaaaaaaaaatttaataatagcccctccccgaagagccccccttttcgcctgggcaccagttttttttaaaaggactaacaatattagcaacagatacaattacagttggggaacatgcagcttctgctcaagagtttcacctccaaattgctgggggaatacatnactatga

SEQ ID NO: 726868 - DNA, 427 bp, Homo sapiens
tgactctaggacgcgcaagagggatatgaaaagtgcgtctcatcatgtaggcatggtcaataaggacaaagtgtcacttaactatcctcctccaagtttctttactatccctacacacaagacacatgcacacacacaatacaaatgagtatctgcatcgtcttgaagaagatctggatgacgagaatgttctaatcccagctaacagatgcgtggtgaggcaccacttttgatctcaggcttctgcagagtgagtgagtcggccaattgttatattagaaagcttgaccagttctgcgtcaggatccaatagggataggtagaaaatgacaatcacaatttgaggaatgacttgaggtgtgtgatgggatgtcctgaggtaaatgcgcaggatatagacccctttagtccttcaccttgaggaaac

SEQ ID NO: 726869 - DNA, 1327 bp, Homo sapiens
  misc_feature (685)..(685): n is a, c, g, or t
tcttttctgtttttgtttttgtatgcaacacgcacactcacgtagagatagttttggtgatgtgttgtggcttcgccaccctctgctcctgtcgtggttgcttggggggagggcggacgccccaccccctactctctgtgttctattgctcctccgccgcatcaagcaggagggcgggacgcatcatctattgtttgtttgggtcctcctcattctcgccccgcctcagattgctactctcttcatccctctggtttgctgcttcttgcttgtgggagaggggcgggactaccgggccttgcaacggtctagttgttgggtggataaacacactatatcgtgatggcaggacacgatcttgatttctttttgtcttatctcgcgctcctcttgtatcgcctacacctggctagggaaaacccctgctcgccgcctcgctggtggtgtgtatatatagagtcaacacagccgcgcgcggtggctgacacagcagcgcagcgagacacccatctctcgacttcttgttttgtgtcgttgtgttcttccgtctctcccccgcgctcctccctctctctcgcggggaggggagtgggggcgcgcgcgctccctctctctctccgcctcgcgctcctctctcttctcgcgcgcgcgcgcgcgcgcgcgtctctctgctctttctctctcncttttctctccacacacagacgagagagagagaggcgcgcgcgcgcgctcgcgctgtgtgggtgtctctctctctctctctcgcgcgcgcgcagcatcgctcgcacgcgcacatatatataatacacacacaccacatccccgctgtgcgggtgtgttatatgtgctgagcgcgcacgcgcacgacactctctcttctttgttttctgttgtgcgctctcctctctctcccctccccagcgcgcgcgtgtgttctcttcgcgcgcgcgcgcgcgcgacacaactcccgcgcgcgcgcgctgtctggcgcacactctctctctctctctctagtgtgtgagggcgtggtgggtcgcacgtattgtgtgtggtgtgttgtgtgtgtgtgtgtccgccagaatattcttctcttctctctctctctctcctcgttgtgtgtgtctgtgtctggagaggagagagcgcgtacttctctctctctctctctctttgtgcgtcccgggggcgcgcgcgccccctccccccccccccgccgcgcctctctctctcttgtgttgtttctctctctgtgtgtggaggagggagagggggtggggcccctctctcttgtgtgttgtgtgtgtgtggtgtgtgtggtgtgaga

SEQ ID NO: 726870 - DNA, 820 bp, Homo sapiens
gggcacatgtcgctcctggatccctggtggcgaaagtcgtccggccttgccctgtgttgctgatcctggcgttcctatgtggcctggttgcagaccgcccttctctcggtagccctccctgctgcttggtgcagcggttcgcagcgcgtgagattccggcctgactcagaaggcagacgtaacgccagctgcgaaggcccctggctcacctgcagctccccggatctcgcctgggcaccagcggacaggcacagagcccggagatgtaccacgtaccagcacgcaacggcagacagatggctgtgcactggacgcgcgcataaacgagccacgcgcaagcgagcgtggacagcggcactcctcgtgatgacggacgaactgaggagcggagactgtcaccggtgtacagagtcgcccggggcctggcacccgatccgggcgaaatgcgacggtgcgtcaaccgctctggtatcagaccaccagccgcacgtgtgccagcgaccccatgcacggccccacagctcagcacgccgtgcgacatgcaacatgacactggaggcagacagacggcccacctgctaccccagacctgcgaggcacccacggggaggggcagggcctggagcttcccactaaagacatgttctgatgctgtgtgcttttggctgggcctcgggctgccaggtcatgggatccaccttgacacagggagacaccccgaacctttgtgccaggacagcatcctggtccctgcacgtctcctgttcggtattagacccccaaactggagggggcatgtaaccgtaggcgcagaatctgg

SEQ ID NO: 726871 - DNA, 505 bp, Homo sapiens
cttcggccttctgaagtgctgggattacaggcatgagccactgcacccacccagtgatctcatttctgaacagggaaggggcagagggcccacacagggagtagggttggggtagagtgagaagggaaaggagaaggggaaggtgactgggaattctcacccattctcacttctgctttgtgggttagaaacactgagctgcctcatcctcctgtctctgaacttccttcacacgccattgggccatttgcatatgtctcgttgaaattccggatcacggcgtcactgcctcctccccatggcccccagagggtgaccggagcatcactaggagccaaagaatggggatgagcagtgcggggtagtgttgaccgccccaactttcccatggtgactcactcttattcaatagacagaccattttcctagaatgttgcaacaggggtattagggtttttccagagctttccactctcgattacccaaccctgagcccctcgcgtgg

SEQ ID NO: 726872 - DNA, 88 bp, Homo sapiens
gcggccgcctactactactactgctcgaattcaagcttctaagatgtacggggacatgtaccatcaataaagtagatagtgctcaacc

SEQ ID NO: 726873 - DNA, 314 bp, Homo sapiens
tgtcgccccggctggagtgcagtgacacgatctcagctcactgcaacctctgcctcccaggtccaagtgactctcccgcctcagactcccaagtacctgggaccacaggtgcccgccaccatgcccggctaatttttgtatttttagtagagacggggtttcaccatgctggccaggctgatctcgaactcctgaactcaggtgatccactgcctcggcctccccaaagtgctgggattacaggtgtaagccaccacacccggccaagtgaattgatttttgagaaaagtggccaggcaattcagtgggtcgac

SEQ ID NO: 726874 - DNA, 372 bp, Homo sapiens
tgatctccgtgccgcagtgtgctattgtcaggatgcatggcagaacaacacaaaaacaacaaaaaaagacttgaatggccttggccctaatggggcttggacctagtagggagatatatacataataccggaacaaatatacacattgcaaatggcgggagatatgttaagaaacgcaaccagatgatgtggtaaaacgcagtttgggtctgtaagaattggcgtaaaattcaaagacaaaccatagctggagagggtgccctctttgggaggtggccaaagatgtacttccaaagggggcgatacataaaactcagagccaaggtgaaagatgaggtcccccatattccataaaagacagggccggaagat

SEQ ID NO: 726875 - DNA, 208 bp, Homo sapiens
  misc_feature (51)..(51): n is a, c, g, or t
  misc_feature (71)..(71): n is a, c, g, or t
  misc_feature (79)..(79): n is a, c, g, or t
  misc_feature (87)..(87): n is a, c, g, or t
  misc_feature (92)..(93): n is a, c, g, or t
  misc_feature (98)..(98): n is a, c, g, or t
  misc_feature (111)..(111): n is a, c, g, or t
  misc_feature (113)..(113): n is a, c, g, or t
  misc_feature (134)..(134): n is a, c, g, or t
  misc_feature (137)..(137): n is a, c, g, or t
  misc_feature (142)..(142): n is a, c, g, or t
  misc_feature (183)..(183): n is a, c, g, or t
aaccccccccacaccaacctcctcataatccttctcaagggcagccatgtnctcacgggcctctgaaaaanaaccttcntccatccnctccnnaacgnaccagtaaacaangnaacgtatggaataaatcaggncanacccntggtgggggggggggggggggtgggggatgggtgtggtgtngctcagggtgggcagggctctgtgt

SEQ ID NO: 726876 - DNA, 418 bp, Homo sapiens
ccctttaaaagttaaggggccttttttttagatgtttcccctccccccaagcttgattgctcaaaaaaatatgcaaaaggcagggtcaaaaacccccaggggtcctttttttttaaaagccccgggcccttgtctttccccccctttttggtttttttttttaccccctctttcaattgcggaggcccaaaaaaatgcccccaagccctacctttcccttaaggggtgcccccccaaacccttttaaagggtgtttttaaattttttggggggggtggtccaacctttcccttctttttttttttggggtttgggcccccattttaaaaagactttttttatggggatgggttgcccaaacgggctttttgtccaaaaaaaagaaaacgaacttaaaaaaaaaaaacggggtttttta

SEQ ID NO: 726877 - DNA, 244 bp, Homo sapiens
gcacaggacctgatgtgtggtgtatgtatggtgactaggaagcgaatcaagtgagagtgtgcctatcggaaacagttacatcactgttcgtgcagttgtcgatgttcatcttaccttaagtagttgacatgtttggaatttaaaaaagaccttttatgttccgtgaatttttctagaaaacttaatttctacttctagaccttgcaccatttgtggatattccccttttatcctttcagaattg

SEQ ID NO: 726878 - DNA, 198 bp, Homo sapiens
cagaggcacaaggagggcagaaggaggatctggtgttatcttctgggcccccagcttctctgccagtgtgcagctggtccttgacctcctcgtagcagtttgcttgcaattcatgcttgatccctgtcagcttcttcttgatggcctccttggtgcctctggcctccttggtgcctctggcctccttggtgcctctgg

SEQ ID NO: 726879 - DNA, 481 bp, Homo sapiens
  misc_feature (10)..(10): n is a, c, g, or t
atggaatcanttgtgtgttgatactctacacacatctgatggaaccaggatgttatatggggaactcctcctgatgtactagtgaggaggacattagggagacaaagaggagcgaagcattatccttctgatgaagtcacatcctgtctatgagcccactaatgctgtaacataggactgaaagagagtgttctttaaaagcctatctcggactgttagtataaaaacatgatggtatcagctcttagcatgtatgcttgacccttatggaaggtataaatccacagaacttccttcccagagaactgggaaatagtcctagaaataaaccttgtacagttgagtggacatggataagcaacaatttgttactttgcaggatttgttccttggtaattgtttggttgttgtcatcctgtaaatattcatgatagtctgtatatatccttttgtatatcgtagatactggattcatttgggg

SEQ ID NO: 726880 - DNA, 542 bp, Homo sapiens
  misc_feature (57)..(57): n is a, c, g, or t
  misc_feature (76)..(76): n is a, c, g, or t
  misc_feature (80)..(80): n is a, c, g, or t
  misc_feature (82)..(82): n is a, c, g, or t
  misc_feature (87)..(87): n is a, c, g, or t
  misc_feature (93)..(93): n is a, c, g, or t
  misc_feature (95)..(95): n is a, c, g, or t
  misc_feature (99)..(99): n is a, c, g, or t
  misc_feature (101)..(101): n is a, c, g, or t
  misc_feature (120)..(120): n is a, c, g, or t
  misc_feature (126)..(126): n is a, c, g, or t
  misc_feature (146)..(146): n is a, c, g, or t
  misc_feature (158)..(159): n is a, c, g, or t
  misc_feature (161)..(161): n is a, c, g, or t
  misc_feature (166)..(166): n is a, c, g, or t
  misc_feature (173)..(173): n is a, c, g, or t
  misc_feature (177)..(177): n is a, c, g, or t
  misc_feature (183)..(184): n is a, c, g, or t
  misc_feature (187)..(187): n is a, c, g, or t
  misc_feature (198)..(198): n is a, c, g, or t
  misc_feature (207)..(207): n is a, c, g, or t
  misc_feature (211)..(211): n is a, c, g, or t
  misc_feature (231)..(232): n is a, c, g, or t
  misc_feature (234)..(234): n is a, c, g, or t
  misc_feature (237)..(237): n is a, c, g, or t
  misc_feature (245)..(245): n is a, c, g, or t
  misc_feature (248)..(248): n is a, c, g, or t
  misc_feature (259)..(259): n is a, c, g, or t
  misc_feature (277)..(277): n is a, c, g, or t
  misc_feature (286)..(286): n is a, c, g, or t
  misc_feature (297)..(297): n is a, c, g, or t
  misc_feature (299)..(299): n is a, c, g, or t
  misc_feature (317)..(317): n is a, c, g, or t
  misc_feature (330)..(330): n is a, c, g, or t
  misc_feature (338)..(338): n is a, c, g, or t
  misc_feature (344)..(344): n is a, c, g, or t
ggggccaagtgaagatcaaacgactggggctgcgccatctgttttctcttcccgccnttgatgacagttgaaatcnggancngcctntgttgngngccngntgaaaaacttctatcccanagaggncaaagttcagtggaaggtgnttacgccctccnntngggtnactcccngganagtgtnncanagcaggcagcnagggcagcncctncagcctcagcagccccctgnngntgngcaaagcnggnttcgagaaacncaaagttttcgcctgggnagtcccccntcagggcctgngnttgcccgtcccaaaaagnttcaccagggganagtgttanaggganaagggcccccccctgctcctcagttccagcctgaccccctcccatcctttggcctttggccctttttccccagggggcctacccctattgggggcctccaggttatttttcccctcccccccctcctcctccttgggtttaattatggtaatgttgggggggaatgaataaataaagtgaattccttgcccctgtgga

SEQ ID NO: 726881 - DNA, 107 bp, Homo sapiens
tgcgagctttctacacaggaaacaggtattaagttgtgaatgggaaaaacccggggggctttttaaaaaagaaaaagggaataccctataaaggggaaaaaaccgtg

SEQ ID NO: 726882 - DNA, 127 bp, Homo sapiens
  misc_feature (57)..(57): n is a, c, g, or t
  misc_feature (109)..(110): n is a, c, g, or t
aggtcccatgcgcgaggctccatcaaagaactactgacaacgaaggccgcgcctgcncttcccatctgtctatctatctggctggcagggaaggaaagaactgcatgtnngtgatggaagcgtcgcg

SEQ ID NO: 726883 - DNA, 144 bp, Homo sapiens
cagatgaacagttccctccttcatcaggtatgaaatggactgtgagcctcatgatagtgcccatttcttcacccgtaatatcttgtgtcagctcagaaatgtgttaggttggattggttggttggtttgtacacagatatgcag

SEQ ID NO: 726884 - DNA, 189 bp, Homo sapiens
cattacctaaaaaggctttttaagagagactactttctaaaagggtgaggtcttctttactgcctttacatgcaagagaggtgggaggaatgatacgaacgtacttaacagttgggcttgtgtcgattcatactacatatgaccgaaactgaactgctgccttattaagagctatacagcacatggagg

SEQ ID NO: 726885 - DNA, 345 bp, Homo sapiens
gtgatggattttgtagcttgctgcttgtttcacactgggtcaaatttaaccattaaattgccattcattttagaatcttgtattaagtaagtttgattttaaatgtccgttcatcttgttgcgacgaatctgtacttttttaaaagtgtgtgtcctctgaggtcctgagacaggtacaatgcagaactgcacatcttcctactgtatcactatttatattcatgcctgtgtagttcatcttacctatgaattccacataacagctaccttctggattaaatcaatatcatcgagcacttttagaatcgcaaagctctaaactcaatgagaatttaataaatttat

SEQ ID NO: 726886 - DNA, 389 bp, Homo sapiens
atttatgtgctcgtgttgtggcctgcagatgatccgtgttcatgtccatctctttcccgacgtgtcaacagagtcgctggtgaatcgctgcttctgtcctgagggcccatgaactacgctcctggctttgatgtctgcgtgaagacctgcggctgtgtgggacctgacaatgtgcccagagagtttggggagcacttcgagttcgactgcaagaactgtgtctgcctggagggtggaagtggcatcatctgccaacccaagaggtgcagccagaagcccgttacccactgcgtgaaagacggcacctacctcgccacgagaggtcaaccctgccgacacctgctgaaacattaccgtctgcaagtgctcgtgctagaactccagatagg

SEQ ID NO: 726887 - DNA, 1640 bp, Homo sapiens
gcccgcgccggcgtgtcgcctcccgtccccctagcagcacgctgcgtggctgctcgctggctatttaggacggaagctcggttggtgtttctccagaagtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatagtgcagatgctaatttcagtgtctggattaaaaggtgtcaagaagctcagaatggctcagaatctgaggtgtggactcatcagtcaaaaatcaagtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcatcgtattgtgtatattcacctaatgcccattgtgtattgatattgcattcttgaattttgaacactgaatatctttttgaaagattatacttctttacctctttgtgctttagaaattattttccttcaagtgttcaagtctaatgaagaatgaagataacattttatcacttctgtccttaaagatttcagacatggtgaaactgaataaagcatgtcatttgctcctagatagattcattctatctagttgtggggatggagaaatctttaatggtatattttcggttattgccttatttttgatacagtattctgtcagtaatttattagacctggcagctttgggtgagcttagatttttcaccttcagtgttacattgtgtttgcttttaaaaactgcttttgaatggagttgtaaatacaatttttctatgaagatgt

SEQ ID NO: 726888 - DNA, 946 bp, Homo sapiens
cccacgcgtacggacccacgcgtccgcggacgcgtgggtacgaccacacgcgatcgcgccacacgcgtaccgcccacgcgtccgagctgactatatatagctcttaaccgtctcagtgtcgcacgctgcgaagggagccgccgccatgtctagcgcatctgcaaatggatggtcgtgcggaactagctccagaattcctgatacaagaggaataccagcagacctacagacactgagcccaataccttgaaggcccgcaataaccttaccgctacaacggaactgattcacgcgcaaagactagtgggcgtggagcctggcagccgacggcacaggtgacaggggagggtcattacgcggagatccggccagcggaaagcctgagcacctacgtatgtagcggaacacacatcaacaagacactagctccagcggccaaagcagcagccaggcaatcagacacacatgatcacgcaacggaaccaagataccgaaccacgcacaggcgcatggccacccaaccgaccggggcccagcgcacatacctgcagcagccaacacgcctgaagactgcatcgaccacagcgcagcggcacccagcacacaaccaccgaagccccatgagcacaacaagaccaccacgaacccacacaaagacccaaaggagcaacacatcaccacacaaacaccacacacgcccaacacaccacaacaaacaaacccccccaacacaggagcagcacccaacagaccagccacgcaacacaccgacacacacacggaaacacaacgagtgagaccccacacacaccaaacacaacacaagacacccgccaagcgcacaaggccaacgccagaaaccaaacaagacagcacaaaaaacgcggaaccacaaagaaaaacacagccgccaaccccgccgaaccagacacaatacccaagcaac

SEQ ID NO: 726889 - DNA, 975 bp, Homo sapiens
gcccgcgccggcgtgtcgcctcccgtccccctagcagcacgctgcgtggctgctcgctggctatttaggacggaagctcggttggtgtttctccagaagtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatagtgcagatgctaatttcagtgtctggattaaaaggtgtcaagaagctcagaatggctcagaatctgaggtgtggactcatcagtcaaaaatcaagtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaa

SEQ ID NO: 726890 - DNA, 1071 bp, Homo sapiens
gcccgcgccggcgtgtcgcctcccgtccccctagcagcacgctgcgtggctgctcgctggctatttaggacggaagctcggttggtgtttctccagaagtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatatagagacggggtttcatcgtgttggccaggctggtctccaactcttgacctcaagtgatccacctgccttggactcccaaagtgctgggattacaggtgcagatgctaatttcagtgtctggattaaaaggtgtcaagaagctcagaatggctcagaatctgaggtgtggactcatcagtcaaaaatcaagtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaa

SEQ ID NO: 726891 - DNA, 1672 bp, Homo sapiens
gcccgcgccggcgtgtcgcctcccgtccccctagcagcacgctgcgtggctgctcgctggctatttaggacggaagctcggttggtgtttctccagaagtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatagtgcagatgctaatttcagtgtctggattaaaaggtgtcaagaagctcagaatggctcagaatctgaggtgtggactcatcagtcaaaaatcaagtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcatcgtattgtgtatattcacctaatgcccattgtgtattgatattgcattcttgaattttgaacactgaatatctttttgaaagattatacttctttacctctttgtgctttagaaattattttccttcaagtgttcaagtctaatgaagaatgaagataacattttatcacttctgtccttaaagatttcagacatggtgaaactgaataaagcatgtcatttgctcctagatagattcattctatctagttgtggggatggagaaatctttaatggtatagttgtggggatggagaaatctttaatggtatattttcggttattgccttatttttgatacagtattctgtcagtaatttattagacctggcagctttgggtgagcttagatttttcaccttcagtgttacattgtgtttgcttttaaaaactgcttttgaatggagttgtaaatacaatttttctatgaagatgt

SEQ ID NO: 726892 - DNA, 377 bp, Homo sapiens
aatgaactgtctaatcctgtaaggaaaaatgaagtctactttatgaggtgagagaaggacaggaaaaaaaaggaaaggaagcttggatgtcaacagtcctctctgacgcccacgtcctactactagtctactagcagctgtgtagcctccatggcagtgaccagcaaaagcgcaagggtgccgaagccacggcgaaaagaaagtccaagggtggagggataaacgtggagggacgtctgtgcacctagccccctgaagacccacgtgcgtctagggggcacattgcgggagaaggaacgtgatctaacacacagaaagggacagttttaaccgtattactgtatacatgtactcataaaactgtagaccggaaattg

SEQ ID NO: 726893 - DNA, 1085 bp, Homo sapiens
gcccgcgccggcgtgtcgcctcccgtccccctagcagcacgctgcgtggctgctcgctggctatttaggacggaagctcggttggtgtttctccagaagtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatagtgcagatgctaatttcagtgtctggattaaaaggtgtcaagaagctcagaatggctcagaatctgaggtgtggactcatcagtcaaaaatcaagtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaaaaaaaaccggggatataagggggggcggaaaaagaggtatggaaagggccttggcccaagctgtttccggacccagtttttgtgtccagggggaaaatcggcgggctcca

SEQ ID NO: 726894 - DNA, 1768 bp, Homo sapiens
gcccgcgccggcgtgtcgcctcccgtccccctagcagcacgctgcgtggctgctcgctggctatttaggacggaagctcggttggtgtttctccagaagtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatatagagacggggtttcatcgtgttggccaggctggtctccaactcttgacctcaagtgatccacctgccttggactcccaaagtgctgggattacaggtgcagatgctaatttcagtgtctggattaaaaggtgtcaagaagctcagaatggctcagaatctgaggtgtggactcatcagtcaaaaatcaagtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcatcgtattgtgtatattcacctaatgcccattgtgtattgatattgcattcttgaattttgaacactgaatatctttttgaaagattatacttctttacctctttgtgctttagaaattattttccttcaagtgttcaagtctaatgaagaatgaagataacattttatcacttctgtccttaaagatttcagacatggtgaaactgaataaagcatgtcatttgctcctagatagattcattctatctagttgtggggatggagaaatctttaatggtatagttgtggggatggagaaatctttaatggtatattttcggttattgccttatttttgatacagtattctgtcagtaatttattagacctggcagctttgggtgagcttagatttttcaccttcagtgttacattgtgtttgcttttaaaaactgcttttgaatggagttgtaaatacaatttttctatgaagatgt

SEQ ID NO: 726895 - DNA, 428 bp, Homo sapiens
  misc_feature (28)..(28): n is a, c, g, or t
  misc_feature (338)..(338): n is a, c, g, or t
  misc_feature (403)..(403): n is a, c, g, or t
ggaaatgcaataaaaaaaccacaatganattatataacactagatggctgtcataaaaaagacaaataataaaaattgttggtgagggtgtggagaaatcagaattctcatacgctgctggtggaaatgtaaaatagtggagagactttggaaaacagtctggcaattcctcaaaaggttaaacatagagttaccacataagcccattctattccatttctaggtatataaccaagagaaatgaaaacatacacccatgcaaaaatttgtgccaaaagttcatagtaacattattcataatagccaaaaagcgcaaacaacccaaatgtccccaaatngtctatgcaagtggatggaatgggatttaaaaattgtggttattacccaaacaccaggactattnacttcagccattacggaagggaggt

SEQ ID NO: 726896 - DNA, 772 bp, Homo sapiens
tgacccgccttctccccgcaccgccggacagggacccaggctcttgttgatgctgcgtctcagctccggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatagtgcagatgctaatttcagtgtctggattaaaaggtgtcaagaagctcagaatggctcagaatctgaggtgtggactcatcagtcaaaaatcaagtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaa

SEQ ID NO: 726897 - DNA, 875 bp, Homo sapiens
gcccgcgccggcgtgtcgcctcccgtccccctagcagcacgctgcgtggctgctcgctggctatttaggacggaagctcggttggtgtttctccagaagtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatagtgcagatgctaatttcagtgtctggattaaaagatcctaattttcagttcaaggcatttgggttgcctctaaagtaccttccgtccttatcattgcccaactcaaaatgccaatgttgggaattgcagctgatgctggtgttcagattgtggtgtatacggccattatgagagaactggactttgtgtgtttgtgtgtgactgagtctgtctgggtcacccacactagagtgcagtagcacaatctcaactcactgcaacctccactgtctgggttcaggagaatcgcttgaacccaggagtcagaggttgcagtgagccaagatcgcaccactgcactccagtctaggctacagagcaagactctgtctc

SEQ ID NO: 726898 - DNA, 1203 bp, Homo sapiens
  misc_feature (473)..(473): n is a, c, g, or t
agcggagtcccgtgcaagagggaagaggaggagtgagaagactacacagctcagtcaaagccccaacagcttcttgtattctctccagcccggcgcatagcccgcgcagctcctgcaggcactccctccatcttctggacacacagcgccacgtatactctgtattggtatagacaggtaagtctatgagtggacctcctggtgagttagccttagtacatcttctcgtttcttttctgggaggatgccgcatcgccagaactggaatctgcgcggagctggatcgcctgtggtctgtcagatacattcaccctacataggctctcgaggatcatcgcgggcggtcggctcatagagtgattccgggcaagcaagctagctaatgctacgagcgcaagggagatagcaaccacgtggtagtcggtgatggctctctcgttcgagtagcaagcaccgttcatagctatctgaangaagcatccgcattatggctagtcatcccatgctcctttcgaaaactggtaccttggctactagaggggcccagagtactattttcgtgctgcacacattcatccgttgctctccgtgcgattgatactgtgcgccttccttcacagaccactcgtgtcgcattatgcacaggctcccgttgtgccccaatgtttagttctgtgttttggttcttccctagcatgcttgatttgggctagagatggctgaatttggaatcctgacgcagagatttgaaatatttcgttcattggtatatcctacttcaagtcctagtcattggatgctcacttcccagtttttctttcatggaacacaggccccttccaaagtttctccataaatggtataaaatgtgcttccaaagagcccagtgaggagttaacctggggtttccaccattggtgcatttacctgtcccttttttccacccccccgcaaataatgagttttaacacttccctaggaaaacagcgttaacgggctcttgaacagtggggcgcacaccacgcttgtaaagagcgttagctatatacggtaacattggcgaaaacactgggaaagaacctgtactttttaggaacctgcatatttactaaattcagggttcacaaggaaaattcacctttaaaagcacttttcgctcaagattttaccttgtcctcccagtgtgaacaggtgaaacacaga

SEQ ID NO: 726899 - DNA, 396 bp, Homo sapiens
  misc_feature (4)..(4): n is a, c, g, or t
  misc_feature (17)..(17): n is a, c, g, or t
  misc_feature (50)..(50): n is a, c, g, or t
  misc_feature (55)..(55): n is a, c, g, or t
cctntttccccaacccnagagggactggggccctgggatggttggtaaangaccntggggaccctttgctatttgtagagccagacctcacccaaatgccccctaaatgtttgtcttggactcttccttcctagacctttatttttaacttagtttctccaccaataaaatccatgcttaggggagatgtcacaagtattttataacctgctgacctctacattatcttggtcagagaccataccagatcctaggcccttaagctataggacccatctttgtggtcggtgtactttgagctgagtttcaatgtaattatgcctcttatacccgggattgtattacatcaggaaacttttccagaattgtactattttaatatatgtttacagtaaa

SEQ ID NO: 726900 - DNA, 317 bp, Homo sapiens
atcccacagttttcttgtggtcgtactggttcgctccatattctgcatgctggctcctgggagccttgtgtcaaggagctctcgccgcctcttccctctctgtgttggattccccctgagcctcgggaatcgtacctggccgcgtcctctcctctagatgtaacgctcgctcctcaatgcctctccattccaaaccacgcagcaggtgattcctcttgagtcaccactttgacttgccagctgttccctttgtggaagcctcaataagcttcttgtattatattttttaaacttggaggatgtggcatcgataaaca

SEQ ID NO: 726901 - DNA, 166 bp, Homo sapiens
tagaggatccggctactacccgctacggaaactggtggtccccgctcctggaggtcaccatattgatgccgaacttagtgcggaccccgatcgcatagcgcactacagcccagaactcctgggctcaagcgatcctcccacctcagcccaccgtagctgggtgttg

SEQ ID NO: 726902 - DNA, 212 bp, Homo sapiens
cgaagctcttgccaatcctcgaagggttgacggcgaccatagcgtacgacgaacggttttggttgtcgcgctcgacggcgcgctgcatggtgatacacggtagaagacgacgtcgacgagtgccgaaacggggaggatgtcggcgatcgaagcgagggccgagtactctccgagcgagtgaccggcgaagatgcagttgttttggtcgacgc

SEQ ID NO: 726903 - DNA, 1511 bp, Homo sapiens
gcgaagatatccccatagcagaacagtccagcaaggacatccctgtgacagcacagcccagtaaggcatgtacatgttggtacacaaggaagcaacaatcccacccaccctcgcattaagtggacatccggacacagaaacgcaccacgctccacccccagcacccccccacaccccccgcccccccccgcacgcccccccacctcccccgcaccacaccccacactcccaggagacatgaccagatgagaacagagaaagagtacactagcgaagagagagacacacaaaagaacacaaaaacaacgcgaacaacagaaaagacggagacgccaggcaaaagaacaagcaagcacagcagagctcgagaatagagtacgacaagagaaggcgccaggaagcataggacgaagctaaaagaaatcacaccaccggcgacacaccgatcaaacaacacctcagcgtaccagcatgaccatatcatggaaagcgggccgagagaaggatagaccacaagaaaggacgggagcaacacgccgaaaaaagaacaataggcgaacaaaagaactagagtagacaaaaacaaacgaacaacgcacgcacgagtcagtgccaaaccggagagagaagcaatggaacaagaaaacaaacaagcacaaagaagcaacaagtaaaagccgccaccaggacacaagcaccgaacaccaggaaagatcagaaacacgcaaaagatggcaaaacagaaacagacagtgacaacgacctccaaccaacagagccacacgagactgagaaaaagccaggccataggaagacacaacgagtgggacacaaaccacaaacggcagaaaagagaacacagcaagagcaaccatcacgcactacaaaacgaacagaagagaaaagataagcacacacaagcaactccgacacaagcaaaacaagaggaagatacacgaaagatgaatgccaaatgagaagagaatagaccacaagcgtatagagaaacagcaataaaaacaaagaaacaaacaagacaaaccgtgcaagcataccagctcgccgtcactactactaagagaaagaaaccagaaacacaaaacgaaaccaagacaaagatgcacccagaaccaggacacgcaacaaatagtcataacagcagctaaagcaatgagagtcgccacctaacaacagcgacgacaaagcaccaaacagcgagtagcactccacagagatagcagcggaccaaaccagtaagccgcttaacacagacagagcgcacacaacgaaagcaagagagagacatcacataagctcaccgacatgggcccataagcgcagcgcacaccgacagacacgaaatccgccagccaacagcagtagccggataaggcagcacacaaacacgccgagacaagtcgagccaagcaagacgatacacatatagcacgacgcccgcacgcgagcaacacagcagcaagaaccaaccataatgaaatcgcagaaagcag

SEQ ID NO: 726904 - DNA, 530 bp, Homo sapiens
  misc_feature (14)..(14): n is a, c, g, or t
  misc_feature (42)..(42): n is a, c, g, or t
  misc_feature (73)..(73): n is a, c, g, or t
  misc_feature (169)..(169): n is a, c, g, or t
  misc_feature (199)..(199): n is a, c, g, or t
  misc_feature (251)..(251): n is a, c, g, or t
cacctgaaatggcncactcctggtgtccctctctttagtccncctttgctcctaagtccgtttgatccaaccnagtaaacaaggagttctctagtgttatacttcttcagtatttatcatattctttatggtgaaattccgctatcttctacttattcttatacagacntatccgctaatgtgatttgaacttgctgantccaaatcttatacactttcagtcccatggcggtatatgtgctcgaaagagntctcataggctgtttctgaatagtatttgctgtatcccaaatgcgctgacttgaacttccacaggcctgagcagagaacacttgccactgtcggggaactcacatagactgagtccaacgagattcggtcttgttctaaaggattatagaccacaaggtacctgcaaaaacagctgcttcattattgggatctcaaaatatttttacttcttacatatacatatacatgtagatatacatatacatatatatttttgagatagcgtctcactctgtcac

SEQ ID NO: 726905 - DNA, 601 bp, Homo sapiens
agacattcctaaacaaaggggctgcttgggttgacgtattgtggggggtggggggtgaggacagctgcatttcatcctaggttcttttaaaaaatgttttaataacatgattatttgtaaaaactcccccgaaaaaacgattttaagagtgttttgggaagtgcagctggataaatgaaacacgttaatgtcactgttgtttgtgctttatttacattggcagtgagtgtcagaatctacctagagcacatcttgccacttttgtccacaggagtcactactaatcatcataactgatgtctagtgtgaaagtgaagcttggaatgtaaacagaggccgagtgtgtgttggcatgtgactggattcactcctgcatgttgctagaagggaatttggggctgtataggaaatagcaagaggtgatgaagacaccttttattatctatttattgccatgtcgctggtagtatttagttccacacacattgtatttcacaagatgagtctcatccgtcttcctttttcaactttctcctaccagtgaaaaaataagccagggcagttctgatgacttcacatttcattggtatttgtttttcat

SEQ ID NO: 726906 - DNA, 359 bp, Homo sapiens
ggttaaaggggttccgccccgcccggtgctccccatttgcctggggttgtgcgcaaaactggaaaacatggctgttataaatgaattttttttttggggagccaaagcccacttaaaaccccgggcccaatttttctgtttttaaaaaaagagggggcttggggattttcctggaaaattataggggcccagctaaaacctgaaagccctccccccccccaggggtttgcagtttttttgtggggaacccctgaaggatttgttgttgctttaaaaaaggccatgatccaattggggtttggaaaacaaaattttcttcccttaaaaaggaaaagttcattgctgtttaaacccccaca

SEQ ID NO: 726907 - DNA, 363 bp, Homo sapiens
  misc_feature (10)..(10): n is a, c, g, or t
  misc_feature (27)..(27): n is a, c, g, or t
  misc_feature (58)..(58): n is a, c, g, or t
  misc_feature (60)..(60): n is a, c, g, or t
  misc_feature (223)..(223): n is a, c, g, or t
  misc_feature (324)..(324): n is a, c, g, or t
tcaatggtgnatgcgatgcaaacttcngtacaggacacaataatattatacagctaangngtacagaagggcagggccggttatcccaggtgtggagttaacggcttattataaccaaccaatgacgtacaaaacgtatataaccttgtataggatagctgtaggggagaacaagcaatgcccatccagtgtggacatggtatggtttgacctggggtactanaattgaaaccctgcctagttagatgctccgcgtaaggagccctgctgtacattgctttattgtacctgctgtgagtgtgcgttggcagtggtgtccttaanatctcactgagatacaaagcgttgccatgaggataatgt

SEQ ID NO: 726908 - DNA, 119 bp, Homo sapiens
tattcctgaaaataaacactctagagttttagtgtctataggaggtcatttagtttgcctccgttgtaacgaacacctgattgaaaatctccatttctctagacctcctgagaaagtag

SEQ ID NO: 726909 - DNA, 204 bp, Homo sapiens
  misc_feature (24)..(24): n is a, c, g, or t
ccttaccccacagatgagttaatntactgaacagcaaggataaaaatggaatagtatctaagaatcaaaatgtattagccatcttttcctattgatatcgaaattgtagtcagaattgtctttattgactttatttcagtttttgtacataaagaaaaatcatggttcatatccatcatgaacgaaaaacttaaacaaggcaga

SEQ ID NO: 726910 - DNA, 354 bp, Homo sapiens
ccctagcataaaaagaaaaagaaaaaaattttaactgctttttcggaagaacaacaccaaaaaagaggtaaagccgaatttataaagtcccgagacttcctgggcaaagaatggacaatcagtttccttcctgggtcgatgtcgatgttgtctgggcaggaaaaccagtttttgtgtaaagaaggtaaatttttttgcacccttttgaaatttagttactaataagccctactgtaatttagcccagtttaactcccccctcatttaaacttcctttgattttttccgcccatgaaaaagggcatagtttgcctggagaatcccctcccgttcataaaaagaatgttgatggca

SEQ ID NO: 726911 - DNA, 166 bp, Homo sapiens
tccaaagaattcggcacgagcctgacctcaggtgatccacccgcctcggcctcccagagtgctgggattacaggcatgagccactgcggcttgcctaggtatatgtatggttttaagggatattggattcattctggccaaaattccttcttagaggacccattgt

SEQ ID NO: 726912 - DNA, 857 bp, Homo sapiens
aaattatcaaggaaatttttcatagacctagattaaactattctaaaattaatctgaaaccaaaaagtctgaatagtcaacgtagtcataagaacaaaaaagctggaggcaatttattactcaacttcaaagtatacaagtcttcagtaaacaaaatagcatagtactgatacaaatacagacacacagaccaataaaacagaattgagacccagaaataaagctgtacacctacagcaatgtgatgttcaacaaagttgacaaaaataagcaagggaaaagacttcgtattcaataaatggtgttaagacagctggctagccatatacagaagaatgaaactggactctttcctttcactgtatataaaaaataactcaagatgaattaaatacttaaatgtaagacctcaaaataggagaatcctagaagaaaacctgtgaaacagcattctggacatcagctgtgggaaagaatttatgacaaactcctcagaagaaaattgcaaaaaaaccaacaattcacaagtgggacctaattaaactaaggagctgttgcatagcaacagagtaaaccggaaatctacagaatgggagaaaaatattcacaaatggaatgcatggatccgacagaggtctaatatctcaaactattaaggaatttaaacaaatcagtaagcatataaaaatactccatttacaagtaggcaagactggagagaatctctcataagagactaagggtaaaaaaaatgtgcatctggtgggaaggtcaatcaggatacctaccaaagggttaaaaaaaaaaaattgggccgataatgggggcgaagggaagggggaaagggaaagttaagg

SEQ ID NO: 726913 - DNA, 894 bp, Homo sapiens
  misc_feature (26)..(26): n is a, c, g, or t
  misc_feature (81)..(81): n is a, c, g, or t
  misc_feature (112)..(112): n is a, c, g, or t
  misc_feature (200)..(200): n is a, c, g, or t
  misc_feature (217)..(217): n is a, c, g, or t
  misc_feature (223)..(224): n is a, c, g, or t
  misc_feature (227)..(227): n is a, c, g, or t
  misc_feature (239)..(239): n is a, c, g, or t
  misc_feature (247)..(247): n is a, c, g, or t
  misc_feature (250)..(250): n is a, c, g, or t
  misc_feature (257)..(257): n is a, c, g, or t
  misc_feature (260)..(260): n is a, c, g, or t
  misc_feature (280)..(280): n is a, c, g, or t
  misc_feature (294)..(294): n is a, c, g, or t
  misc_feature (297)..(298): n is a, c, g, or t
  misc_feature (301)..(302): n is a, c, g, or t
  misc_feature (304)..(304): n is a, c, g, or t
  misc_feature (331)..(331): n is a, c, g, or t
  misc_feature (335)..(335): n is a, c, g, or t
  misc_feature (339)..(339): n is a, c, g, or t
  misc_feature (345)..(345): n is a, c, g, or t
  misc_feature (352)..(352): n is a, c, g, or t
  misc_feature (356)..(357): n is a, c, g, or t
  misc_feature (370)..(370): n is a, c, g, or t
  misc_feature (381)..(381): n is a, c, g, or t
  misc_feature (385)..(385): n is a, c, g, or t
  misc_feature (389)..(389): n is a, c, g, or t
  misc_feature (404)..(404): n is a, c, g, or t
  misc_feature (447)..(447): n is a, c, g, or t
  misc_feature (610)..(610): n is a, c, g, or t
  misc_feature (612)..(612): n is a, c, g, or t
  misc_feature (626)..(626): n is a, c, g, or t
  misc_feature (635)..(635): n is a, c, g, or t
  misc_feature (639)..(639): n is a, c, g, or t
  misc_feature (647)..(647): n is a, c, g, or t
  misc_feature (651)..(651): n is a, c, g, or t
  misc_feature (659)..(659): n is a, c, g, or t
  misc_feature (664)..(664): n is a, c, g, or t
  misc_feature (671)..(671): n is a, c, g, or t
  misc_feature (688)..(689): n is a, c, g, or t
  misc_feature (709)..(709): n is a, c, g, or t
  misc_feature (711)..(712): n is a, c, g, or t
  misc_feature (721)..(721): n is a, c, g, or t
  misc_feature (725)..(725): n is a, c, g, or t
  misc_feature (789)..(789): n is a, c, g, or t
  misc_feature (821)..(821): n is a, c, g, or t
  misc_feature (826)..(826): n is a, c, g, or t
  misc_feature (846)..(846): n is a, c, g, or t
tttattcccaagtataattttaaaangctgtttaggacccaaacatatttaaacatctcttacacatacagaatttcagtntacaaatattccagaaggcattttcttaagnagtgaaccatgcagaatactgttgctaaacatcgtttctgccttcctcgtgttctcttggtagtttttactgtttggcttgatcctgntgggggatgtgcttacngggggnngcngggggggggggngggggggnggnggggggngtnggggggggcggggtgtgggnggtgggggggtgtnggnngtnngnggggggggggtgtgggtgtttttgggntggntttngggtgntttaggnagannagtctggagtgcngggggggatgnaganaggnggacttgggctcatntttcatcagttaagtagccaattatctaacttgtatttctggnaactgaaaaggaaagtttctagaaaccgtaagaacaatttaagttgggatttagaatagctgacacatttttagatgggactgaaatgagtaagaaaggttctccaagatgtatgattttaagtccttactccataaatcttcattaaacacatctcagtttngncctgactcactggngtgtcagcnctantcaccctncctnaatacgtnagctncaccttngcaggaaagggctcacnngttacagatagagcttgatnanntcatcgctnactnctgagggtgtcagcacgcccaggtctgtaaacagcagagtgattaaggaaggggcagtgtagtngacccacggatgctcctctttgaggtcttgtncagtntgcgcgaccttgagagtgtntgccttatacttaaacttatctgggacgtcttgctggtttagtggaag

SEQ ID NO: 726914 - DNA, 1753 bp, Homo sapiens
  misc_feature (308)..(308): n is a, c, g, or t
  misc_feature (329)..(329): n is a, c, g, or t
  misc_feature (379)..(379): n is a, c, g, or t
gcccggagcgccgtgccgggctgatccgagctcggctccgagtttcacggcttcgtgttaatgcctagccgccgatcggtcggtgcgtacccatgtgcagatactgcccattcatgcattatacttaactcgagggagctctgcatacatgaacaacgtatgagaaatgttgctctcgatcattctgagcaatgataccgaggaagatcggcgggacgggattgtgcctctcggagaggtggcacgtgaggagacgcataggtcgacgtgagcggacaaagaagcgagtaaacaattcgcatcgcacntctcgcttcacatctcgggtngcaacagactgcacgtactccgcctttgcaagagcaccgcgaagggggcngcactagggctcactcctgcacaacaagctggcggaggctcacattgctagccttgtgcgtggttcgcgcatgcactgtgagtccgattggaacacccaaattcaaaatcgtggcaagggggaaaaatcaaaacgtctttgggaccaaaataaaagggatacgtcacattaaccaaacagaaaaaagattcaccagtaccaaacaacagcaattcttcacccgagttggaagagatttcccataacttccgaacagagggggggagacgagcgttgtgggcaaaaaggaagaagccgaaggaatggtaagccaccaaaggaagacgacggaacggtttcggagcacaacccccctactctcctgaagtctgaaacaccacagcgcggggggggccacttcgggacaacgcgacacagccgaataaaaggtttcccacaaggaacaaacgcaaatgtgacccctatagggccccctattacaaacatctcgtggtcccaacaacaagtcaagaaccccttaaaactaccaaagaacgtatatccattattctcaacctaataggggacatggaaaaacacgcgacaccaaatttgcgacaaccattttcccccaagagaaaaagttggggcccaacatttagaggatttatgcagagcattagcattatcactattctggaggcgcgagcaacaacttattatacccctccgcgagtctaggaccacgcggcgagcgaaacacttatgggcacgcatctcgcgtcttaggaaacacccccccaccgcccaaagcgctttacaaccttctaactttctgcggacaccattccatcatcccttgcaccctttactacataaaacaagccggcggggaactctcacggcggaggattctatccgacacacggcagacaccaacactttcgggcgggaaccaccaccacaaaacgcctgggcttcctacaaaacgaccacacacaaccttcgggttcgggcggcgccccaaacaaccgctcatcagcttacctactcgactcagcgacgagcgaacaatactccccttataagatctccacaagcccactcactgtgagtctatcccacacattccccacaattcatacacaccccctttgtgcgggcccatcatctccatctggacccttcatgtgccgtaccacacttccccccaaaacccacactcaaaaaaccccaaacccccacaggcggcagaaccccctctttatcaaaagcgcaacaacccaaaaacgaacgtctgcggacagcgaaaaaccctctggaaacacttcgcgctttcccaaactttccacttctttggacaagcgacacccttatccactacctcccacagtc

SEQ ID NO: 726915 - DNA, 775 bp, Homo sapiens
  misc_feature (366)..(366): n is a, c, g, or t
tgcttagtacctgcgacttgtggtatgagactagctagataggaagatgtcctgagtgacatgctaatgtcggacaccctgcccccaacttacttccgccacagtagttcatgccagtactggtcattgaatagatatcgacctgtctgactacaaaggaaacatatgtggtgtacgtcatgcaccctcttgacttcgccttagtgtgccccacggcttcatcgattgctattcaactagatcacggctgtacaaattatatgtaaacttacaagtgtgcaaattgagttggtagtctctactcgttgagaagttgctcgacttcatgatctgtcgttattcagtaggcgtcacatgacgagcctnaatcaagacgaagaaaaggactggggacccatagatcatgcctaaggtatcagacccgagatcacacgccattcgtatcaacgatgattggggtcttgtagatatgcttgatgaaaggctatcttcgtccaggggccttctcaatcagtggcctgatatagggtgattcttcggcatgatcacttgttatattgagcctccctgttggcgcgctcgggtggttgctactgagcgactagtgcatggccttcctggtcgctgactaggcatggtagactctgtgctttcagtgcttgggtgatgcgatgtttagactctcctctgccgtgtgatgggtgcttctggtgtttctcccttctgttgtcttgcctgggtcttttacttcttaaaggagggggactgggatccc

SEQ ID NO: 726916 - DNA, 903 bp, Homo sapiens
  misc_feature (26)..(26): n is a, c, g, or t
  misc_feature (81)..(81): n is a, c, g, or t
  misc_feature (112)..(112): n is a, c, g, or t
  misc_feature (200)..(200): n is a, c, g, or t
  misc_feature (231)..(231): n is a, c, g, or t
  misc_feature (252)..(252): n is a, c, g, or t
  misc_feature (301)..(301): n is a, c, g, or t
  misc_feature (320)..(320): n is a, c, g, or t
  misc_feature (354)..(354): n is a, c, g, or t
  misc_feature (361)..(361): n is a, c, g, or t
  misc_feature (365)..(366): n is a, c, g, or t
  misc_feature (379)..(379): n is a, c, g, or t
  misc_feature (390)..(390): n is a, c, g, or t
  misc_feature (394)..(394): n is a, c, g, or t
  misc_feature (398)..(398): n is a, c, g, or t
  misc_feature (413)..(413): n is a, c, g, or t
  misc_feature (456)..(456): n is a, c, g, or t
  misc_feature (619)..(619): n is a, c, g, or t
  misc_feature (621)..(621): n is a, c, g, or t
  misc_feature (635)..(635): n is a, c, g, or t
  misc_feature (644)..(644): n is a, c, g, or t
  misc_feature (648)..(648): n is a, c, g, or t
  misc_feature (656)..(656): n is a, c, g, or t
  misc_feature (660)..(660): n is a, c, g, or t
  misc_feature (668)..(668): n is a, c, g, or t
  misc_feature (673)..(673): n is a, c, g, or t
  misc_feature (680)..(680): n is a, c, g, or t
  misc_feature (697)..(698): n is a, c, g, or t
  misc_feature (718)..(718): n is a, c, g, or t
  misc_feature (720)..(721): n is a, c, g, or t
  misc_feature (730)..(730): n is a, c, g, or t
  misc_feature (734)..(734): n is a, c, g, or t
  misc_feature (798)..(798): n is a, c, g, or t
  misc_feature (830)..(830): n is a, c, g, or t
  misc_feature (835)..(835): n is a, c, g, or t
  misc_feature (855)..(855): n is a, c, g, or t
tttattcccaagtataattttaaaangctgtttaggacccaaacatatttaaacatctcttacacatacagaatttcagtntacaaatattccagaaggcattttcttaagnagtgaaccatgcagaatactgttgctaaacatcgtttctgccttcctcgtgttctcttggtagtttttactgtttggcttgatcctgntgggggatgtgcttaccactggaagccagangcaagattcggcaagtgtttnaagcctctaaacaaggcaccgcgtgttacgtcctgaccaagctgtgggncgtttgtggcaggaggggngatggctgcatatttcgccatgcatcttgcgtgntttaggnagannagtctggagtgcngggggggatgnaganaggnggacttgggctcatntttcatcagttaagtagccaattatctaacttgtatttctggnaactgaaaaggaaagtttctagaaaccgtaagaacaatttaagttgggatttagaatagctgacacatttttagatgggactgaaatgagtaagaaaggttctccaagatgtatgattttaagtccttactccataaatcttcattaaacacatctcagtttngncctgactcactggngtgtcagcnctantcaccctncctnaatacgtnagctncaccttngcaggaaagggctcacnngttacagatagagcttgatnanntcatcgctnactnctgagggtgtcagcacgcccaggtctgtaaacagcagagtgattaaggaaggggcagtgtagtngacccacggatgctcctctttgaggtcttgtncagtntgcgcgaccttgagagtgtntgccttatacttaaacttatctgggacgtcttgctggtttagtggaag

SEQ ID NO: 726917 - DNA, 197 bp, Homo sapiens
cgatgttgaggtgatctaaggatccccaaatctgatctcgtgatctgctgcctcaaactcctgtactcgtgatctgcccacctaggactccaaaaatgctgggattacaagtgtgagccaccacgcctggcctactgtgatcttttttttttttttttttttttttttttttttttttttttttttttttttttttt

SEQ ID NO: 726918 - DNA, 379 bp, Homo sapiens
  misc_feature (26)..(26): n is a, c, g, or t
  misc_feature (31)..(31): n is a, c, g, or t
  misc_feature (191)..(191): n is a, c, g, or t
  misc_feature (195)..(195): n is a, c, g, or t
  misc_feature (343)..(343): n is a, c, g, or t
  misc_feature (362)..(362): n is a, c, g, or t
  misc_feature (372)..(372): n is a, c, g, or t
  misc_feature (377)..(377): n is a, c, g, or t
gtaattaagaagaccctacctatttncccancccagcaaaccttttttttttgcctttttaaaaagattgatgcatccccacatgttatgggggcaccatatgatacctttgataaattgatataatgtgtaaagttcgaatcatttgagaggccgaggtgggtggatcacttgatgtcaggagttggagnccanccctggtcagcatggcgagatcctggctctactaaaaatacaaaaaaattagctgagcttggtggcgggcctctaattccagctactcgggaggctgaggcatgacaatcacttgaactcaggaggcggaggttgcaatgggccaagntcatgccactgcactccancctgggtaantggangt

SEQ ID NO: 726919 - DNA, 1284 bp, Homo sapiens
ggtggcacgcacctgtagtcccagctacttgggagcctgaggcaggagaatcgcttgaacctgggaagtggaggttgagtgagccgggaccgtgccattgtactccagcctgggtgacagagcgagattcctgtctcaaaaaaaaaaaaaaaaagcgcccaccttgaaagccttgtcttctttctccactttggtgggcccttctccagggggatatatcgagagcattgtggtttttctcataggtgcctttttctcctttattccaagggggtggcttcgtgaggtgggtgttttttttttttgttaaaattgcggcttgtggtttctaacaaatctagtgtctaaaagggcaagtcccaagaagcctatttccaagccaaattgtggtttcctccttactctcgtgcgtgcatacattttttctctctccccctctcgcgggcagagggggaacccagggtttagaacgcaaagtggagaaacacacgcaggagatgtgtgagaaagcggagagaggcggggttccacacacggtgcatgtggttaccataaagcgccaaggggagggcgttttaaagacgctctcccaaggctattatagcgggggcgttgtgagagaacgccccccttgggggggcgttcccagcgggaaaaccttgtgttgtgctccaagtggggttgcaaagttgttgaggttgttagtgggggcgccaacccggcgggggcacaagaagggagaacagcgttgatgaacccgggcccaaaggtattcttcacgagaagatatcccccagtggtggggatctcctgggcggtctcacacaggggggggacgagcctaagaaacaccgctctgtgttcctctacaaccggagtatacactaggggggagggttttgttggtagggcacccccggggacccccgccttcccctattattttgtcgagccccccgttggagaaaacacccagaagatagggtccgccacaacaacaaacggagcaactaccgggtgacgaggaaggaacaacttattcatgggggaagaaccgggacacgcctaccagagtatttgagtaacacatggttctaccaatataattcgccataatcggcggggcggagtaagacacagcgggacaagtagatacctccacatcttttaacacagctgtggtagtgtcgccccataaaaaattggggggcccagtggtctttaccaaaccccgtggttgtcccccccgtgacacacgtgttccacaggtggtacaggttttag

SEQ ID NO: 726920 - DNA, 137 bp, Homo sapiens
ctacgcgactgcactctatcctggcctacagagcgagaccctgtgtcagaaaagaaagaaagaaaccaatcctgatatcctttagctatttactctctctcactgaagcatcttgcgcgtggccagcaagggggtac

SEQ ID NO: 726921 - DNA, 285 bp, Homo sapiens
  misc_feature (257)..(257): n is a, c, g, or t
attccgggtcatggcgccccgaaccctcattccttctgcttttggggggccctggccctaaacccagaccctgggcccgctcccactccatgaggccaccgccgcggaggtccaagaggggagcccgggggagcccctgggttggagcaggaggggccccgagatattgggacccggaagaaccaaaaagtacaagggcccaggcacaagtttacccggtaaacctttggaaacttgggggctatttaaaacaaaangacaggggggggttttaaaaacctccca

SEQ ID NO: 726922 - DNA, 779 bp, Homo sapiens
  misc_feature (553)..(553): n is a, c, g, or t
  misc_feature (779)..(779): n is a, c, g, or t
agcgtgtgggcaggcggatcacaagatcaggagatcgagaccatcccggctaacatggtgaaaccctgtctctactaaaaaatacaaaaaattagctgggcgtggcggcgggcacctgtagtcccagctactcaggaggcagagccaggagaatggcgtgaacccaggaggcggagcttatagtgagccaagatggcgccactgcactccagcctgggcgacagagcgagactccctctcaaaaaacaacagcaatgcctgaccctcagggtctagccagcgctgggctgtgactttgtgacttgcagctggtgaactggtctcctgctcagtgcccaactcagggcacacggttaatgtcgagcccacacagaggccggggcccagggactgggtcctcagcttcctggggtcactggggagcccacccacctggagctgccacctcggtgggccttgggggacggggcgctccctcctggtgacaggcagcctctaggtctgcagggacccagccccatcctaaggcagccaacttgtggccagtgccctngaatttcaacacccaaacagaccaacctggcttggggttggcttgggcccgggggggcaaccagcaagtgggccccaaacatacccccttttggggaattggttgggggggacctttccttggaccgggaaagggggaaaaccaaggggtttaaaccccgggggtcccccttttcccccaaaggggccaaaaacccctttgggtaaaacccgggggggccccccgn

SEQ ID NO: 726923 - DNA, 282 bp, Homo sapiens
gaagcacacttctaatacgaaacactgaaatacatgtgagctctacgtgcatttaagaaggtaagatcgccctgtctgggaagtgaggagcacctctgcccggcccctgcattgtctgggatgcgaggagcgcctctgcccagccgctgtgcaaccctccaagtgtgaagtgacagccttgtgtgtgatctttctgccctccccaagtttgcattttcgacattaaagtttactttttaattaagttctaaattggagaatatacatttcaagtacaaaaca

SEQ ID NO: 726924 - DNA, 126 bp, Homo sapiens
ctaaatcagctcggtaccggaaatccttggcttcgcgcagcgcgagtacgagcagatacgccgcaggccggttggtcggaacaaccgccttcactgtggtggcagagtgtctgccaatgtacgcag

SEQ ID NO: 726925 - DNA, 322 bp, Homo sapiens
gagaccggtggcagtcggccagcccccttctccacggtaaccaggtgcgaccggaaaggccgtgatcaaaaaggcggacaggtcggaagagatgcaacaggactcgggggagtgcgctactcaggcgcgggagaaatacaacatagagaaggacatggcggctcatatcaagaaggaattggacaagaagtacaatcccaccgggcatggcatcggggggaggaacttcggtagtgatgtgacacatgaaaccaaacacttcatctacttctaccggggccaagtggccattcttcggttcaaatcgggtaagggatgcggt

SEQ ID NO: 726926 - DNA, 218 bp, Homo sapiens
  misc_feature (45)..(45): n is a, c, g, or t
tcactctagagatcccctgtcgctgggattacaggtgtgagccancgcgcggcgctgttgtatttaagatgcaaggttaaacaacctgagagtgtttaaaaactgtatttgttgtttatacttcacttcatcctgaaagactattcaaggtagcttacagagatgtggagaagccaaaaaaaaagagagaaaactagaacaaaagtgaaataagattg

SEQ ID NO: 726927 - DNA, 502 bp, Homo sapiens
ggcacgaggagagcagagcgctgtctgagccgagcgctgtgctctgcgccgaaccctgtggcatgtagagaggtgagaacacttggcgcggggcacgctgtatatcggagccaggccgaggacctgagaggtggaaggcttcttttccgtgagcatgctttcgggagaacgtgtggggcctgagctgatgcacgccgtcaaggaagtgtgtcaagggtgtcgctgtgccagaggagtttcaggagcaccacctgagtgaagtgcacaaaggtgccattaatgggagtataccccgaaggagtataagggggagctaggctcctatgagatgccgctgaagcgtaagttggacttaatgccaacgtaatccatgtgaagtgacttcctggtatatgaattggacaacaattatacctgggagcatttagagccacacaagggagtacagattttgggacatggaagcaagggggtgaatggagtttaagtggacacgagccag

SEQ ID NO: 726928 - DNA, 251 bp, Homo sapiens
tgagatcaggccactgcactccagcctgggcgacagaaggagacaccatttccaaaaaaaaggactgcagaaaccgtggcgctcttttacaaagtggctgtatcattcagcattcccatcagtaacgtatgggggatccagttgctccacatctgtgccagcatttaacattatctgggtgattgggtttggtgttacttttagtcattctaatagatgtgcagtgggaaaatcacgatggggcttttttt

SEQ ID NO: 726929 - DNA, 393 bp, Homo sapiens
ttgctgttcttgtgtacactgtatcagcaatgggcacagtgcgtgtaatccactacttgggatgctgaggaggaggatcgcttgaacccaggatgcggaggttgcagtgagctgagatcgtgccactgacatccaacctgggcaacaatgagcaaaattccgtccaaaaaaaaaagctgggtggagtggctcatgcctgcaatcccagcattttgggaggccaagggcaaggtggatcaccctgagatcagggagttcgagaccagcctaaacaacatggagaaaacccttgtctctactaaaaatacaaaattagccgggcatgggggcacatgcttgtaatctagctacttgggaggtgaagacaggagaatcgcttgaacccgggagaac

SEQ ID NO: 726930 - DNA, 165 bp, Homo sapiens
aaaatgaccaaaataactgtcctgtgaaaccctgtttacctcaatatctttggatggttttttttctctaaatagtgctgccataaggagtcacctcctactcttgattcaactgcaccagcctaacccttgccgtcacgcttacctcaaatggacccttagtgc

SEQ ID NO: 726931 - DNA, 137 bp, Homo sapiens
  misc_feature (88)..(88): n is a, c, g, or t
  misc_feature (98)..(98): n is a, c, g, or t
ctggagcaactaatattaaagcaaaaggagccgaccagtctttctccattagttactggtaatcaatgccatggtgattatatttctnggattctctntgtcatccaataacacctgacatcgacgctacagcagat

SEQ ID NO: 726932 - DNA, 231 bp, Homo sapiens
taaaaaaaaaaagcttcatcacagaatacttcccagttcctcttttatacttttttgaaaaattactttttaggacctttgggtatgatatgcttaaaattatttatccatttagtggcaaaagtgatacaagtagcttcttgattgaacatcatttacctcagatttttcacccagacagttacgtttttttatgcagctctcaaccccgaagctgggtggtgggggatc

SEQ ID NO: 726933 - DNA, 954 bp, Homo sapiens
  misc_feature (48)..(48): n is a, c, g, or t
  misc_feature (619)..(619): n is a, c, g, or t
  misc_feature (621)..(621): n is a, c, g, or t
  misc_feature (623)..(623): n is a, c, g, or t
  misc_feature (626)..(626): n is a, c, g, or t
  misc_feature (648)..(648): n is a, c, g, or t
  misc_feature (660)..(660): n is a, c, g, or t
  misc_feature (662)..(662): n is a, c, g, or t
  misc_feature (665)..(666): n is a, c, g, or t
  misc_feature (670)..(670): n is a, c, g, or t
  misc_feature (672)..(673): n is a, c, g, or t
  misc_feature (691)..(691): n is a, c, g, or t
  misc_feature (693)..(693): n is a, c, g, or t
  misc_feature (702)..(702): n is a, c, g, or t
  misc_feature (709)..(709): n is a, c, g, or t
  misc_feature (711)..(711): n is a, c, g, or t
  misc_feature (721)..(721): n is a, c, g, or t
  misc_feature (725)..(725): n is a, c, g, or t
  misc_feature (727)..(728): n is a, c, g, or t
  misc_feature (732)..(732): n is a, c, g, or t
  misc_feature (755)..(755): n is a, c, g, or t
  misc_feature (764)..(764): n is a, c, g, or t
  misc_feature (772)..(772): n is a, c, g, or t
  misc_feature (782)..(782): n is a, c, g, or t
  misc_feature (788)..(789): n is a, c, g, or t
  misc_feature (797)..(797): n is a, c, g, or t
  misc_feature (802)..(802): n is a, c, g, or t
  misc_feature (817)..(818): n is a, c, g, or t
  misc_feature (822)..(824): n is a, c, g, or t
  misc_feature (835)..(835): n is a, c, g, or t
  misc_feature (844)..(844): n is a, c, g, or t
  misc_feature (846)..(846): n is a, c, g, or t
  misc_feature (848)..(849): n is a, c, g, or t
  misc_feature (869)..(869): n is a, c, g, or t
  misc_feature (877)..(877): n is a, c, g, or t
  misc_feature (953)..(953): n is a, c, g, or t
aactcagcaatatgcgatacagcggggtagaggggagatgtaaacagncgggaggggacagcaccctgaccccccaagagaacacagggagccaatgggaatcttatttggcagctaaatacaaactggggattggaggaagaaaggaggggtcacaggggccctgggctcccccacccaagacccctggaggaaggggtcaattccacggtgtaaacaaaagctaataaataaatagaggcttcctctgggtcagggcgggatcagctaagcagcatcccccctccctgggccaagctgctctggggagttaagggtggaaggcactagggagagagggatcccctggcccctctgtagtgtaggagggtccctgccccaatggctgagatggagggcaggaggagcccaaggcacatgacagggctgggggagggacttataacggagggcacagggtgaactctgcacccgagccaagaggtgcagaatggacctgcatctatctgtccctttcaccctctgttcctgccccagaaatgcagggcccagcctgcccccaccttgacctggcacaaggacggggcacagaggctagcacacaccctgcaggtgcatnananagnattaggcaccaagggtaggagnaagaaggtgggntnagnncttntnntttgtcccctttttggtntntagtgttantgtttgntntaagagagcnaagnanntggnagaggaaggggctgtggaatggnagggtcttnctcttgcnctgggaagtntagganncatggggnagtgntgagattttagagtnnaaannnaggataataantttgaactntntnntggtgggagcagggcaggcncccgggantggcgagggagcaggttagataaggaaggggatgaaaaaagaggaaaaaatagaaaatttggcaaaaaaaaggagnt

SEQ ID NO: 726934 - DNA, 429 bp, Homo sapiens
  misc_feature (4)..(4): n is a, c, g, or t
  misc_feature (14)..(14): n is a, c, g, or t
  misc_feature (429)..(429): n is a, c, g, or t
aaanaaccggtgcnaacatagtgaaccccaatctcaaaaaaaaaaaaaaaaagaatttatttcctgaggaaagttaacaatggattaggtcctactcgatactgacatgcctagcttggctgtctcataagacatatggcagccagcccaggcacggtggctcacacctgtaatcccagcattttgagagaccaaggtgggcggatcacaaggtcaggagatcgagaccatccctggctaatacggtgaaaacctgtctctactaaaaatacaaaaaattagccaggcgtggtgcgggcgcctgtagtcccagccactcgggaggctgaggcaggaaaatggcgtgaacccaggaggcggagcttgcagtgagcagagatggcaccactgcactccagcccaggcgacagaatgagactccgcctcaan

SEQ ID NO: 726935 - DNA, 293 bp, Homo sapiens
gggtttctccaccggattaatttctcccttcaaattctgggctcggttttttctctggtagccgggtcctcgggtgtgaacaggagcagataacaaatagcacctagctgggtgacaacccataggaggtatgcctataaaatgccagggaccacagaggtgtcacggtgaggattgacactatgggcagggatgtggatgattggtattgtgacctacggattgagaatggctccagagtggggtacggaccagccttctctaggtgtccagacaccggtctgagtttctgg

SEQ ID NO: 726936 - DNA, 412 bp, Homo sapiens
  misc_feature (10)..(10): n is a, c, g, or t
  misc_feature (81)..(81): n is a, c, g, or t
  misc_feature (174)..(174): n is a, c, g, or t
  misc_feature (311)..(311): n is a, c, g, or t
caaactcctnagcaaggtgtaggtctgaacccagctcacttttcccaactcatctctttacacttccctgcttcccctggnctccagcacatgtgatgtgcaggtctccagatctaccatgtttatttcacttcattgcatgtgctgttgctcctgctgcttaaaatacctttncttctctttttcactgcaaacaactcctactcagacttccaagcacaagtgaaatataacttcctctgtgaagtcttccctaacttcatctgctcactccatccactttgctgctaaaatgttttcatatttacagntatttctctgaacagtacttactgcatgggcctgtaatcaaatgttacatgcctgttgcagtctgctgcaagcctgggtgagggccggggccatatgggat

SEQ ID NO: 726937 - DNA, 189 bp, Homo sapiens
caggctacccggctgtggtcctggctcttgtgtaagaattctgagcgcaaataaccatgcctacggaaggcccggagtcgttctttcgtccgggattgcggtctcgggcgatcactcggaccatgactcacgcaggacagacgcacatgtcgtttctactgacgaccttatgccgagactacggtacac

SEQ ID NO: 726938 - DNA, 164 bp, Homo sapiens
ctggtggccgggggcgctgtgcgctcggtttccttcttctgttggcggcgggtgcgtggcgcttgggtattggggtttaggttttattttgactctgcctctgctttttttttttttttttttttttttttttttttttttttttttttttttttttttttttt

SEQ ID NO: 726939 - DNA, 961 bp, Homo sapiens
  misc_feature (10)..(10): n is a, c, g, or t
  misc_feature (67)..(67): n is a, c, g, or t
  misc_feature (302)..(302): n is a, c, g, or t
  misc_feature (310)..(310): n is a, c, g, or t
  misc_feature (319)..(319): n is a, c, g, or t
  misc_feature (366)..(366): n is a, c, g, or t
  misc_feature (373)..(373): n is a, c, g, or t
  misc_feature (388)..(388): n is a, c, g, or t
  misc_feature (393)..(394): n is a, c, g, or t
  misc_feature (399)..(399): n is a, c, g, or t
  misc_feature (408)..(408): n is a, c, g, or t
  misc_feature (411)..(411): n is a, c, g, or t
  misc_feature (426)..(426): n is a, c, g, or t
  misc_feature (440)..(440): n is a, c, g, or t
  misc_feature (446)..(446): n is a, c, g, or t
  misc_feature (449)..(450): n is a, c, g, or t
  misc_feature (454)..(454): n is a, c, g, or t
  misc_feature (457)..(457): n is a, c, g, or t
  misc_feature (461)..(461): n is a, c, g, or t
  misc_feature (464)..(464): n is a, c, g, or t
  misc_feature (473)..(473): n is a, c, g, or t
  misc_feature (499)..(499): n is a, c, g, or t
  misc_feature (507)..(507): n is a, c, g, or t
  misc_feature (512)..(512): n is a, c, g, or t
  misc_feature (519)..(519): n is a, c, g, or t
  misc_feature (523)..(523): n is a, c, g, or t
  misc_feature (526)..(527): n is a, c, g, or t
  misc_feature (533)..(533): n is a, c, g, or t
  misc_feature (537)..(538): n is a, c, g, or t
  misc_feature (540)..(543): n is a, c, g, or t
  misc_feature (548)..(549): n is a, c, g, or t
  misc_feature (552)..(552): n is a, c, g, or t
  misc_feature (564)..(564): n is a, c, g, or t
  misc_feature (566)..(566): n is a, c, g, or t
  misc_feature (568)..(568): n is a, c, g, or t
  misc_feature (571)..(571): n is a, c, g, or t
  misc_feature (573)..(573): n is a, c, g, or t
  misc_feature (578)..(579): n is a, c, g, or t
  misc_feature (584)..(584): n is a, c, g, or t
  misc_feature (589)..(589): n is a, c, g, or t
  misc_feature (593)..(593): n is a, c, g, or t
  misc_feature (595)..(595): n is a, c, g, or t
  misc_feature (604)..(604): n is a, c, g, or t
  misc_feature (606)..(606): n is a, c, g, or t
  misc_feature (623)..(623): n is a, c, g, or t
  misc_feature (626)..(626): n is a, c, g, or t
  misc_feature (630)..(630): n is a, c, g, or t
  misc_feature (637)..(639): n is a, c, g, or t
  misc_feature (642)..(642): n is a, c, g, or t
  misc_feature (649)..(649): n is a, c, g, or t
  misc_feature (651)..(651): n is a, c, g, or t
  misc_feature (658)..(658): n is a, c, g, or t
  misc_feature (662)..(662): n is a, c, g, or t
  misc_feature (678)..(678): n is a, c, g, or t
  misc_feature (695)..(695): n is a, c, g, or t
  misc_feature (697)..(697): n is a, c, g, or t
  misc_feature (703)..(703): n is a, c, g, or t
  misc_feature (714)..(714): n is a, c, g, or t
  misc_feature (717)..(717): n is a, c, g, or t
  misc_feature (719)..(720): n is a, c, g, or t
  misc_feature (723)..(723): n is a, c, g, or t
  misc_feature (770)..(771): n is a, c, g, or t
  misc_feature (825)..(825): n is a, c, g, or t
  misc_feature (853)..(853): n is a, c, g, or t
  misc_feature (896)..(896): n is a, c, g, or t
  misc_feature (899)..(899): n is a, c, g, or t
ggttagtagntagggctagtaggtaggttcgtaggtagggttagtaggtagggctagtaggtagggntcgtaggtagggttagtaggtagggctagtaggtagggttcgtaggtagggttcgtaggtagggttagtaggtagggttcgtaggtagggttagtaggtagggttcgtaggtagggctagtaggtagggctagtaggtagggttagtaggtagggctagtaggtagggctagtaggtagggctagtaggtaggtctagtaggtagggcccgtaggtagggcgcgtagggagggcncgtaggcngggccagcngcgcgtctgcgccgcccccacctggcgccccccgctcccaaaccacnagggccngaaggtggcccccgntctcnntctcncttctctgngcnccagatggcgatttngctgacagctgccnagaaangcnncacncancagnccncatggcccngagatgtttatagaactgtttgaatngcagcccnccccngcccccncccnggnngaaganctgnncnnnntaagnngantcgggagtggcncncnttnanacccnnagacngtagngcancntgaagagcncnaagcacacggccgcacnaangctnacagggnnnccncccgagnancccatcncacnccccttgtaagggaantctggggcagctatggntngagtangccgtttgcancgngnntcnacccttagtaccttgccacccttttaaaacgctgctgtcatttcccnnttcttagtactaatgattctttgattctccctctattatgtcttaattcacttnccttcctaaatttgttatttgcatatcnaattctgtaaatgttttgtaaacatattacctcacttggtaanacnatactgatagtctttaaagatttttttattgttatccataataaatgtgaactatttaaaga

SEQ ID NO: 726940 - DNA, 1193 bp, Homo sapiens
  misc_feature (177)..(177): n is a, c, g, or t
  misc_feature (194)..(194): n is a, c, g, or t
  misc_feature (196)..(196): n is a, c, g, or t
  misc_feature (209)..(209): n is a, c, g, or t
  misc_feature (213)..(213): n is a, c, g, or t
  misc_feature (218)..(219): n is a, c, g, or t
  misc_feature (221)..(221): n is a, c, g, or t
  misc_feature (224)..(224): n is a, c, g, or t
  misc_feature (229)..(229): n is a, c, g, or t
  misc_feature (231)..(231): n is a, c, g, or t
  misc_feature (256)..(256): n is a, c, g, or t
  misc_feature (300)..(300): n is a, c, g, or t
  misc_feature (306)..(306): n is a, c, g, or t
  misc_feature (311)..(311): n is a, c, g, or t
  misc_feature (344)..(344): n is a, c, g, or t
  misc_feature (363)..(363): n is a, c, g, or t
  misc_feature (396)..(396): n is a, c, g, or t
  misc_feature (459)..(459): n is a, c, g, or t
  misc_feature (471)..(471): n is a, c, g, or t
  misc_feature (568)..(568): n is a, c, g, or t
  misc_feature (769)..(769): n is a, c, g, or t
  misc_feature (784)..(784): n is a, c, g, or t
  misc_feature (826)..(826): n is a, c, g, or t
  misc_feature (997)..(997): n is a, c, g, or t
  misc_feature (1002)..(1002): n is a, c, g, or t
  misc_feature (1012)..(1012): n is a, c, g, or t
  misc_feature (1016)..(1016): n is a, c, g, or t
  misc_feature (1022)..(1022): n is a, c, g, or t
  misc_feature (1035)..(1035): n is a, c, g, or t
  misc_feature (1038)..(1038): n is a, c, g, or t
  misc_feature (1047)..(1047): n is a, c, g, or t
  misc_feature (1050)..(1050): n is a, c, g, or t
  misc_feature (1087)..(1087): n is a, c, g, or t
gggccaactgaaccataggcatatccgctacacccgctgcaaggatgagtgggtgctggtgtcagctcacgcataaagcggccctggcagggtcaagtggagccccaggttttgaagacagtgccccgccatgccctttcaaccctttgtgttctggggccatccgagccaacgganaggtgaatccccagtangntagcaccttcctntttnacaannanttnccagntntgcagcctgatgcccccagtccagnacccagtgatcatccccttttccaagcaaagtctgctcgagaantctgtnaggtnttgtgcttccacccctgttcgggtgtaacgctncaactcttgtcggtccctnagatccgcgctgttgttaatgcatgggcctaantaacagaggagctgggtgcccagtacccttgggtgcagatctttgaaaacaaaggtgccatgntgggctgttctnacccccaccccaactgccaggtatgggccagcagtttcctgccagatattgcccagcgtgaggagcgatctcagcaggcctataagagtcagcatgnagagcccctgctaatggagtacagccgccaggagctactcaggtaggtacctctggtcctaaccagtgaggactggttaggactggtccccttctgggccacatggcccttccagacactgctgctgccccgtcggcatgtgcggcggctacctgcgcttacccctgctgagcgtgatgttctagcctccctcatgtagangctcttgaccaagtnttacaacctctttgagacgtcctttccctactccatgtgctngcttggtgctcccacaggttcagaggctggggcctactggaaccatttgcagctgcacgctcattactaccctccgctcctgcgctctgccactgtccggaaattcatggttggctacgaaatgcttgctcaggctcagaggggcctcacccctgggcatgctgcagaganactangggcattccngagnttcatnaccaccggggcanaangacaggganacngcaaccatcgcctgaccacgccgaccacagggccttnaatccttttttgttttcaacagtcttgctgaattaagcagaaagggccttgaatcctggcctggaatttgggcagatatagcattaataaaactgtgcatctcaaa

SEQ ID NO: 726941 - DNA, 194 bp, Homo sapiens
caacgagggtcctcagcttgatccagggaacccttggttaactatactgggatcagcgcaaagtaggggtgtggggttttggttggtttttttggttttggtttggttttttggctttttggtttttttttttttttttttttttttttttttttttttttttttttttttttttttttttttttttttttttt

SEQ ID NO: 726942 - DNA, 487 bp, Homo sapiens
  misc_feature (177)..(177): n is a, c, g, or t
  misc_feature (194)..(194): n is a, c, g, or t
  misc_feature (196)..(196): n is a, c, g, or t
  misc_feature (209)..(209): n is a, c, g, or t
  misc_feature (213)..(213): n is a, c, g, or t
  misc_feature (218)..(219): n is a, c, g, or t
  misc_feature (221)..(221): n is a, c, g, or t
  misc_feature (224)..(224): n is a, c, g, or t
  misc_feature (229)..(229): n is a, c, g, or t
  misc_feature (231)..(231): n is a, c, g, or t
  misc_feature (256)..(256): n is a, c, g, or t
  misc_feature (291)..(291): n is a, c, g, or t
  misc_feature (296)..(296): n is a, c, g, or t
  misc_feature (306)..(306): n is a, c, g, or t
  misc_feature (310)..(310): n is a, c, g, or t
  misc_feature (316)..(316): n is a, c, g, or t
  misc_feature (329)..(329): n is a, c, g, or t
  misc_feature (332)..(332): n is a, c, g, or t
  misc_feature (341)..(341): n is a, c, g, or t
  misc_feature (344)..(344): n is a, c, g, or t
  misc_feature (381)..(381): n is a, c, g, or t
gggccaactgaaccataggcatatccgctacacccgctgcaaggatgagtgggtgctggtgtcagctcacgcataaagcggccctggcagggtcaagtggagccccaggttttgaagacagtgccccgccatgccctttcaaccctttgtgttctggggccatccgagccaacgganaggtgaatccccagtangntagcaccttcctntttnacaannanttnccagntntgcagcctgatgcccccagtccagnacccagtgatcatccccttttccagctgcagaganactangggcattccngagnttcatnaccaccggggcanaangacaggganacngcaaccatcgcctgaccacgccgaccacagggccttnaatccttttttgttttcaacagtcttgctgaattaagcagaaagggccttgaatcctggcctggaatttgggcagatatagcattaataaaactgtgcatctcaaa

SEQ ID NO: 726943 - DNA, 721 bp, Homo sapiens
gcagagggtggtattatatgaagtgtgtgtagtttggagtgaataatgttttattttatgaataaaggttaagaatataataaatggtgggaggatttaaaagatgagtggggctaaagtaaaaatattatttataataaaaaaattttgaaaaaaaattatataagtaataaatttggtaagtgataatgttgttgattttttttaagaaagataggtatatagatttattagaatgaagttaattaaatattgaaataatgtaataatgtattaaataataataataaatttattaattttattaattaaatgatgatatattaagtattagtaaatatatattttaatattgagaatgttaaagtatgtatgaggtagattagtgaatcaatataagataatatgaagaagaaatataaaaatatggtgaatattattttattaaatatttaattttattaaattatagtaatatttttatttataagattaaattataagtagttttgaaatactatagatattttaaaaatgttagtttatattaaattttagtttattaaaaaaaaatatgaggattatataaggtttattgttataaataatatatatataatgatagtatagtttaatggaatcttatagtatttctagaataattttatattagagatatatattaatagaattatatttttttagaatgatgatttaaata

SEQ ID NO: 726944 - DNA, 1335 bp, Homo sapiens
  misc_feature (179)..(179): n is a, c, g, or t
acttgcaccgaagcatcactcgagaccccaaacctccagggctgaggcccaggccagacgcgccgagatgtgatgacgaagagaagaatgaaacggagtcccaatgccctggcctggtctccaggccaggtccaaggcgcccagggcagcactacggagggtccctgtggcctaccagncgcacaggcggttacctatgggcctaggagcttacctacattctgcgcatcctcgcaagcagcgggtccaagttcaagacgacgtagagcaaaagacgaatgtgcctgcctcacgtcgctgagcttggagggatgcgaaagcggcatctgctggctcgcctcctgcagctacttccttccgtgaccggagggtgactgattgtcgtactgatgcatggaaggggaggacgtctctgagaccatgcgtcaacctgagtttccagcgtctgtgccgggctgacatgggccgtatcgggaagtggaatgcgtccgtgttgatgcagtctggagcacgtttcggggagatgcaggacgaagactaggcggggtgaacttcagtgctggagtgtgtgctggcggagcgacggagggacgaatgaatagtgaagaggatgggagtcactgaggggcatgacagaggagcgagaagaagacaattggctgaccgtaatctggagcagctgcttatcaatctggcaagagctcagtgattctatccagaagctggatctgtacgaagaacgccgagcctgaggagcatgtcctgatgcgtagcgtccaacgcaggcccaaactgcacctctgcattctcttcaaacctggtgactctttacatgactcgggcgcgtgttctgcgtgccccaggtgtatggggaggggggcgttaatggaatttatcctatagaagtactgaacactgtaagacccgggatttcggggggcggaacacgtgccagttgagggcacaaggtacaggttgttcccgacacactttcttgacaagctggaaaacggacggccactaaggaggtatacaaggtcgagaaccacggacgacttcgagttgcatgtcaagaagagaccgaccgagcttgacaacagagagatacagcgtccacaaaagacaataacacaccaccagctcgaatctacacacagcaaagagaccagctatctagtcagaggcgagcaacgaactacattagcactacagcaatattaacgtaccagagcacagacgcgaccagcgaacaaacgtcagatcacagatagtacggaacagcagacgaacgcgcgagcagaacacagcacagaagccgagagaggacaagagaac

SEQ ID NO: 726945 - DNA, 108 bp, Homo sapiens
cacgaggtgagaaacattctctcaaagatttaacgtaccatttaaagctgttcttctttatcttgtcatgaataaacctgctgtgtattggagattatatggatacga

SEQ ID NO: 726946 - DNA, 280 bp, Homo sapiens
  misc_feature (15)..(15): n is a, c, g, or t
  misc_feature (105)..(105): n is a, c, g, or t
  misc_feature (135)..(135): n is a, c, g, or t
  misc_feature (214)..(214): n is a, c, g, or t
  misc_feature (254)..(254): n is a, c, g, or t
ttgtaatggcatggnaagtctactgagaagcagaaaagaagcaccatttaacaattatctgggctagtcaactggtagtgggtataaatgtaactggtaaggtcnaaggacaacacctaacctacaaatatgagnccaattagtttcacagaaataaaattaccttcctagctacaaataatcctaacccttaataccagccattggcccttgncaaatggatgaccaatagtccatacaggtgggggaatagnctcagtttaaccacttagctacatta

SEQ ID NO: 726947 - DNA, 1077 bp, Homo sapiens
ggagccacccggtccgccgcgtcccgtcaccgccgccgcgtccccgccggggcctgacctgagccgagccgggccggagcggcgggcgcggccgtggccgccatggaccacaatgccgctgctgcaggagcggccgcccgcctacaacctggaggccggccagggcgactacgcgtgcggcccgcacggctacggtgccatccccgccgcgccccgcggcgctacctatccctacctcgtcacagggatacccacccagccatcgccatgggttctacaaacatccagcagacggaccgtcacccgtatatccatgccaactctatcgtggtcgtagagatggctgtcctgtctagcatgggttgggagtgcatggagcgactgcttcacctttcctggggcatcttcagtggccactcatcctcattcccccttggaggtatcattatgcctgtataacgccttgagggcaagcgacgaatgcacccaatctgtgcgagccacccttacgcttaaagggaacaccatgaccggaatatacctacaacccagctcatctatattccttactgttacaactgtagcggtacaagtaagatttactacgacttaacgcctttcacgggacttgattatcgtaaaagccgacgttgcgtgaccctgaatgggggcaccaacggccatgctgacggcgaatccccgggagccgctggacacaacgccaaactctgtcattgccctcaccagaccccgaagtcctcaaatcacacaaacctccaaattacacgccacctgactacttaattaatcttagcaacatcatacacattttcatacaacggtatcctcaacaatcattgctccttcaactcaccttgcaacaattccgatacccactttaacacaaccaacaacaacgagcacccacacatcacagccaatcacactacaacaaccaccaataaacacacacggactaacttccatatgctacgccccagactccacacaccctacaccataaaccacaaacatcacgtccccaaacctgtatatcaccccggccgactcccccac

SEQ ID NO: 726948 - DNA, 295 bp, Homo sapiens
ccacctttagcccccatccctgccctgacccaaaccttgccttactcctctgtccctgcgtccccagtccagaccacccccttaatcccacctgtggccacaccttgccgatcgtctgctgctgcatcatctgccctggacctcaatgggaggcagtgctgagaccaactggcatgcctataatttacaaactattggattttttctacgtgtgggtttatacaacgacttaagccttttgattggtcgaggtcgggcgctaacatatcaaatcacaaaacacttattcgtgatg

SEQ ID NO: 726949 - DNA, 474 bp, Homo sapiens
tgtaatacactgtatatacatggactcaaagatagaagagaggaaaagtatagccacctggcttagagccccagatgagaatgacatgatatctgcttatctttataaaaaatatctaaaattcagtgattaaaaatgaatttatttcactatgtttcttctattgcctgtaggaagtagctcacaaaataatagagttgctgaatgtcactgaacttacccagaatgccctgattaatgatgaactagtggagtggaagcggagacagcagagcgcctgtattggggggccgcccaatgcttgcttggatcagctgcagaactggtaagattctccaaagcagaaaactggcagctgactggctaaccacataaacacataaatgtacctttgagctgtgttagttgaatggaccctgtcaaaacattagtatagagtttgacatagtccagcttctgcttaccctggaaaca

SEQ ID NO: 726950 - DNA, 1191 bp, Homo sapiens
gggatcgtgacctatccgtgttgccgccatcgcctccttatatgagtatgcttccttggactcgtcctgtccccaatagttactgttacaccacatccgtacgtccatccatggtataagcttgctaagagtagcgccataaatcaaggtagtatgcccaaactaaaattggactgctctcttaccacaggagccatgaaacagaagataccgtgtaagatgtacgtgcatcagtgttgggatagattgacttaagaatagcacagctctatggagtacagatggtgcgttccatacactacgaaaaggtatacgggctggaagagctcgattgcatctctaccagacgacatgggaaaacgagcagagatacagttaacacccccaaacaaaaaaaaaggatatagcacgttctggagcacaacaacgcaagcccagaggacacaagccacgcctgtgcaacatcccgagggcgggcccacggcgaggcagtctaatcacccctggccacaatgaacgatcaagcttagcgagcccacgcccaagaagcccatgcgaaacccgacaaccccatggcgcaaagcacacgggcagcgcgaccccgaagagactagagagggccaatacgcggtgaagggtaagggtccttgcgcgtaaacgcacaggtggggctgctcggccagtccccggaagcacccttggggggcgcaaaaagaatatgcgcatgaggccaaattgcctaaaagcaaaggggaacgcaccaggttgggagtggaccacgaaggggacggcatcgcacttgaaccagtgggttggacgcgcaagcggacattgaagagcaaggggaagtgggactcgcacgggaaaccgaaagggcgagtagaacgggacgtcggaagccacctgcagccatataaggaaacaagcccggggggaacgtcggccccctgtataaacacggcgggggggaaggacagaatgggggccccccccatggccccgataatagagaacgcgcacctggcacggacaaccgggaggtggaagacgggaccttcaaccgggaacagcgagttcgcaagcatgaactccggcccctgggagacggagcgccaacggaaagtgtagcggcgaaaaggcaccccgaaccgccgtgtggaacggacaacgataggcgggtaaagaggccgc

SEQ ID NO: 726951 - DNA, 928 bp, Homo sapiens
gatgacgtccgcacggaatgtaccgattctactgactgctcttccacctcacaccgcactggtgcaggaggatagacgggactaattgcgctggcggctcggcacattcatccgtgacccacgtgcagatcatggccttgtggtatgaaatatactcagatattatcagtcataaataggactacggagacatgacagcttgttcgaaggagattgcttcttggggtcgtggtagctcagaaggatccgcgcttggtcatttagctcaacctcggtttccatctctcgcgtcagcgaaacaatagcgcatgatgcctgatctatcgatggaagcttcactgatcaatcctggaaatgcattgcggagccgtacagccatggttgatcattggatacagtgcttctcgacaggtttgtgggcatggtgctaaatccattgtcccccatctacttaacataatttggggccttcgagtttacttagttttaggtcgcttgaggggcggacccttcgccttgggttacctttctttccaaggtatttaagcgcttttaaccacaaaggaccacttgcgccaagtttgaggacacggaataagtacttagataccggctaacctcctatttttattaggttgatttgcggccaattataaataagagcatgggctcccgaaaagggtagttcctggcatcctttactagcattataactgcgtccaatttatccagcgaaactttgggaacgttgcaccgttgaacaataacctcgaaatgtggggaccagttgtctggtgacacacacggaaaaaggacggcagtttatttctacccacacttagaagatgccattttgtatacaacacgggccagaaataatccaacgctatatggagctaacattgatgttgaaagaaatgtgccgcat

SEQ ID NO: 726952 - DNA, 244 bp, Homo sapiens
gccagaacactacgagccccagcttaaaactcaaaggacctgggggtgcttcatatccctttagaggagcctgttctgtaatcgataaaccccgatcaccctcccccccttttgctcagcctatataccgccattttcagcaaaccctgatgaaggctacaaagtaagggcaagtacccacgtaaaaacgttaggtcaaggtgtagcccatgaggtggcaaaaaatgggctacattttttccca

SEQ ID NO: 726953 - DNA, 439 bp, Homo sapiens
gtccatatcgaggcggggaaggatgaaatcattaagaatggcccctgaagaagatgtccgctcggatcaggaagtatcagatcttgaacaatgaggtctttgccatcctgaacgaaaacatgaagtccgtggagacagctgctcatccccccccccgtaaccccaaccatcctaacctctggtaaccaccatgtcctgtctacttctgtgagatcaattttgactccatatatgagtgagataatatgtatttgtctttctgtgcctgtgttatttcagttaacataatgttctccaggttcatccatggtgttggaaatgaaagaatttcttcttttttatgactggaccaatgtcccgctgtatgcgtattccacatgttctttatccatttgggtgtgtggattagcatttatttttttttttgagactccgtctc

SEQ ID NO: 726954 - DNA, 347 bp, Homo sapiens
ggtgttccaggagctggctgactgtcaggaggcctcttgcaagtcctcagtcttgcttatccatgcactcattcttgttgggggacgcagagtggattcctcttggtcaagcacagtgacttgtattaaccaacttaagggtgacacttataaaccagatgccaacttacaaagaaaaacagaaccactagagagccaaacagaagccaaactctagtgagaaaattgcttgatgtggctgggcatagtggctcacgcctgtaatctcagaactttgagcggccaaggcaggcggatccctttaggccaggagttcaaggccaacatggtgaaaccccatctctact

SEQ ID NO: 726955 - DNA, 377 bp, Homo sapiens
taaacctctgtgcacagatatcacactcatgcggctatacgcctgtgtgaattctcatgtggccccagagatggtgctccattgtgaatttcttaccgcagaccccacagctgtaagcccgaagccccacactgacaaggatacagcttgtcggtgcctgagaatcctaagtggaacgcttcttctttaatccctgttaccatttcaatattctcacgtgtaacctgctgcagaggacagcttcctgtctgtgcccaattagattcccatctgacctctctccggaaatctcttcacatggaagagccatagaaatccacctgctcatcataagtgctttcatcagcgtgttcatcaaactcagcttccactttctt

SEQ ID NO: 726956 - DNA, 850 bp, Homo sapiens
  misc_feature (401)..(401): n is a, c, g, or t
cagagatgacagaagacgagacacccaagaaaacaactcccattctcagagcatcggctcgcgggcacagatcctaggaagtctgtgcctgtcctccctgtgcagggtatcctgtagggtgacctggaattcgaattctgtttccctctgtcaaatatttgtctgtgctctttttgttagaacacaaaaaaagaaagaggctcggtgagcactggtgagtcactgcctggtaagtcccaggcactttgcgactaccagaggcgtggtggactacccctgcaggtgagggccagcttcgaggacgcagctcgtgaccacagcatggatgaaacccctttctctactaaaaagataagaacaacttagccgggccgtataggcgatgcgccgtgtattcccangctactcaacaaggctgcaggccaggagaatcgcctgaacccagaggcggaggttgtagtgagccgaaaatcagcaccatggcactccagctgtgggcaaccaatagcgaaccttccatctcacaatttaagacaaaaaatgcctacacgctctttaaacatggcaagggccttctcgtgaaaattaagcctaaactgaaccgggcgatcgacgctggctttcaaccttttggacataatattgtttcggccccaactcctccctgggtgtttcctaacctgaattacactgttttgaagaatcactctttacacaaggtacaacaacacagggggggcgcactcgcggagcgttaacactctaggcggcccggagataaagcggacccaacctgtgatgcccagagggtgccccgagacacgcgccaccgtccggggaagccttcgcc

SEQ ID NO: 726957 - DNA, 499 bp, Homo sapiens
gcatgaactgcaaggctcccctcagcgccatcgtgtctccgtatggcagcccgctgaggagctttcttgggctgcccccatactgctccctaagcaaggtgtacatattctgcgtagagtgcatagaccaaccagcttcccagggttcgtcgctgtgaggcgtaagggacatgaattctagggtctccgtttctccattatttattgcttagtggcatacatcatgccgctggctgtggatagtgcttttgtgtagcaaatgcgtccctccttaaggttactagggtcttcctgagtattggagagtgtggaagtactacgttaactgtctgtcctgcttggctgtcgttatcgttttcatggtgatgttgtgcttacaataagaagtacccgaggtttatttctgtggcctgagaaggaagggacctccacgacaggtgggactgggtgcgatcgccggctgtttggcatgttgccaacatggcgtgccgggcaggag

SEQ ID NO: 726958 - DNA, 214 bp, Homo sapiens
caggaatcactttccccaggtatactccaagacaatcatcgcaacacaaacatattatacaccaacgcctgtagcctatatattaacactacatacgctacctacctgacaagcagctatagccctcgagtaatacttctcacctaacaggtcaacctcgcttacaccacccttactaaacattaatcgaacataaccccaccctactaacccg

SEQ ID NO: 726959 - DNA, 196 bp, Homo sapiens
  misc_feature (22)..(22): n is a, c, g, or t
catccattattctttaattttnatttttagaaacagtgtttcactctgtcacccaggctggagtgcagtggcctgatcatggctcactgcagcctggacctcctgggctcaagtgatcttcctgcctcacagcctcccaaagtactcagattataggtgtgagccaccacggctggccaccatctattactttttg

SEQ ID NO: 726960 - DNA, 1646 bp, Homo sapiens
gcctttggcgcggttcactgcgcagatgcacgcggtcgtcggccaggctgggtccgcgcgcgtgccgagaccgaggtagctgatccgcgagctgcgtgcgccaggtgcgtacgtctctacgtggctgggctcaggtagctgcgagctgctggacggctgtggacgtcgcggtaccggcggcgactacgaggtaggatggccatgtctgcgctgggcctgcctggatgctgtgctgtagcgcatccgctcgggcgagcgctgctggtgcacgatgcgatgatggtgctacgcgctctggaccagggatggtgctgcgcatcagtgtcatcggtttcctgctgccaggctgctctgccgcctgctgccgaggacggagtcccgagagcctgcaagcgtgccgtgcgccccggatggtgttcgacgagttcaaggtgcgcgctgcaggaggctcgagctcgttggcatcacccagggtgagagatgcggctgtagtccaatgaaagccagcccagaggctgctcgggaactcccagggaccctacttgactgttgagctggatgtctcgaatagcaaggacagggccagaatgagggaatgtgcagacaagatccagtgccccaggaaggtcgctccagatgggagtctgaggaggggaaggaggcaggatggctcggagctcccgggagcagccaaggccaggaactcgaagggcggctcacaaccgacttgatgactgctaaccttggagccgactaagaaggaagctacctgccacagagaccaggtggccgtgggcccgtgaaggtgcatcgtagtgaacgcttggggtgtcccaagttgagagtcattcgcacattgcttgtccagtaaccgggcagacataaggactagacactatgacactcgtcattaagagaagacggtgagacacagacaagtaggtagcaaatctatactgtctttcctcgtgattagttagcagtaaaaaaactaaaaaaaagacagaactaaacgacaaagaaaagcagaacacagcagacgacgcaggagaagggcgaggcagagcgaggaggagggagaggcgaaggcgaagaagggagcgaagagaggaaggcgagagaagagagcgcgcggagcagaggagggagaagggagagagagcgggaggcggagaagagaggagcaggagaaaagcagagaggagaagagacgaggaagagaggacacggaagagaggagcggcagaagaaggagaagcgaaggaagggcagagcaggagaagagcacgaagcagacacaagagagagcgtacgcgactaggagaagcacaacagagacaagggcaaaaagaaaacaaaaggaagaaaggaagaacagcagaacgaaagaaagaagaacagagaaaaaacaaaaacagacagcgaaacagagaccaaacaagagagagagaggagaaaagaggagaagaaaaggagagacaggcagatcaacaaagcgaagaagacagaaaagagagaaagaaagacaagagagagagcaaagagaaagaagcagaacgcgaacacaccacagagacagcgagacaacacacatagaagagaaagcacgcccacagcacaaacacacaaaacaagacagcaaaacg

SEQ ID NO: 726961 - DNA, 122 bp, Homo sapiens
ctctatacgttgactgtccccttacacagatgaagaaacaaacacattagggccaggcgcaatgtggctcatgcctataatcccagcccttggggaaggccgaggcaggcacgttacctgag

SEQ ID NO: 726962 - DNA, 316 bp, Homo sapiens
  misc_feature (88)..(88): n is a, c, g, or t
agtaggactcatgacatcatagctcgtggttagaattcaatttggaataaagtcttgatgttggaatgggatcactgcactgggagcncctggtggtcaggagctgtgctttagccatcgccgaaatccagcattcgagtgcagtcctgctgcctgataacacactcagaagttaaagggccctccaaggtcctatggttcattcttttttaaaaatttaatttttaaaatattgacacataattaactaacatatattcactggaggaaccattagtgttgttcctaccatatacatgtataggtgctccacgtc

SEQ ID NO: 726963 - DNA, 315 bp, Homo sapiens
tagttctagatcgcgatctagaactagggctgcctctcctattatctattatcactgaaacttagtagcagacttcaccaggccctgaggccacaccttgcgcaccgttggcaccccgggggggaaatccggcgtaacatgatgagtagggatcttcagccattacggtaggcaactaagtccaagaccaagactgccgtccggcgtgactgttgggctcaccggatggatatggccgatgggcggcgctgtgcctcggggatggatacatttgaataacccccctgtgtggtaggggtggaagtgggtaaaacc

SEQ ID NO: 726964 - DNA, 127 bp, Homo sapiens
acactgggttcgagttcctgtggtgcattcattgatcagacaagcacaccgcaaaggcacagtatcggtccttggcgaggaatcatcaagggggagaaggttactgcaacctccagaaggcaggaat

SEQ ID NO: 726965 - DNA, 694 bp, Homo sapiens
agcttcatcgctctatgcgcttagtaccctttctctgtgaggaatgtttttacatatagaggttaacgttgaggtgtaactggcgcatagtggacttaggatgttttggtttatacaacgatatttttcatgtctgttagtaacactgtttcaccaaagagtagagagagaccttcactctgtgaaattccaaacaaaacgatgtgctgaatggttactcacagaaagatttgacaacttgaggtataacgccacctgaggtgtatacaacttgcaagtagtatacacctcaggtggcagaaagagagcgacccagagagagcgacccaaaaagagaacaaaacagacagagcaaccgagagagagagctacccagaaagagcaaaaagattacagcaaccaaaatagagagcaaacaaaagagatgccaccttaggttatactacttggccacctgaggtgtatactacttggggatccgtgcacgttaacgattactaggactaagcagaaccagagagttagataccgcgtttgtctatcgtctcgtttcgcttcgctactcatactccctctggtctctcttatccacttctttgattccttattagcctctcaccccttttcaactctcctatcatttccttctttctctttgccctactcttcattaagaatacttctatcctctccc

SEQ ID NO: 726966 - DNA, 309 bp, Homo sapiens
ctcatctaatcactacctacacgtcatcatatttcagctcttgagagcatactgctctcctttagatggctgtgaatctatatggccatctgggcttcacagcttgagttaaccttgcttttccgggaacacaaatgatgtcatgtgcagcttcgccccttgagacatgacacgcggccccaaatttgctattcccatgcattttggttggttcttcacttatcctcggctctgaagaagttttgtgaccacggtttgtggtttcttaaaataaaatgccgagacatgtgtttaagctgaaaaaaaaaa

SEQ ID NO: 726967 - DNA, 124 bp, Homo sapiens
aaatctgcaagctccgctacaccaggaaggacaagctgaaggtgcacatgcggaagcacacgggcgagaagccgtacctgtgccagaagtgcggggcggccgtcggccacaactacgacctgaa

SEQ ID NO: 726968 - DNA, 231 bp, Homo sapiens
gcgagaaggcagagggcgcgagaggcacaaggaggtgtaggttctgtgcctcgcaaagtgctgggatcataggcatgagccagcacgacccggcctggatgccagttctttatcagatatgtgtttcgcacatatgtccacccagatttgtggctgcttgttttcttttcctagtacctggatgttcgcttttagacgagtttggaccagtgatcctccttggtgccttgg

SEQ ID NO: 726969 - DNA, 482 bp, Homo sapiens
gcgagcatttgtcctcgggtgtggtgacttggagtgtaacagcgtgatctgaccaatagtacacacagacgcaaggtttaactggtacttgaaacaccagattatgttaacaaaataaccaagatttaaagattattttggtacacctttctttttagtgtcttatcagtgggttgattcatcttctacataaatcagtgttttatgaccaagaatattgcttggattgttttgaaagtacaaaagaaccacatagtttctactgacaggtttcagagctcccaaagattaatttccaacttagaggtttgtttttattttcaacctatgacgacttgactggtcttaaagctgctatttgatagtaattaaatatgttgtcattgatagaagcctgttggttcagcaaactgaaatgagtgttgcagacagggttttcttttcctcgttggtgttgctgatttgtgagcatgctttctgaa

SEQ ID NO: 726970 - DNA, 193 bp, Homo sapiens
tgaagaggagttggcaagccttgggaagtggataagcgagcaaaaaagcgctctaagatggtgtctggctcccaagatatctgggagggcatccaagataaatgagaacagggcttgaaggaagtcacctgcagtgatcctccgtggtacacgaatgactggaggtgcaagtgctctctaccaagaatccgat

SEQ ID NO: 726971 - DNA, 206 bp, Homo sapiens
aaaatgtcaaatgaatttgacacattctgatcagtaagatcccagaatatctaatagtcaaattcatttgacattttcaaagtataaacaactgttaaagagttgcctatttttattcataaattatacttagtttgttaccatggcaacaaaaatagcaacaacaaacccaaactgtcctgtccaattgatcttcctaaaaaaca

SEQ ID NO: 726972 - DNA, 777 bp, Homo sapiens
tgcgcgcaaggccaactgactggagaagctcggagaacggagggaggcggcacggacagccctggcggaccccgcgcaaactgctgcaacgatccaccagcgttctggggtccccaacgccaacagcactcagagcagatgctgctggactgttgtcgagccaagactcgcggctaccgagcacgtcgacatccagaacttctcctccaagcctggagtaaatgggagtggctcttctgtgccgctggtggcataactttcttcccttgaggccttacgagctatgggcagcttagccctcatgaaccgagcgtccagaactttacgaggctggcccgttctcatacatgcggtgactccatggcggactgcccgcagctccgtggatacatgaggacagtggtcgcgagcttcgagagctttcggactggaagtgcgtgtacacgtacatgccaggaattgctaccgcctgtcatggtccagataggggctggtaacaaaaccagataaagtcgctaagcccctgctcaggggccccacggatgctggtggactgtgtgacaccgtggtaggaggtggacgacatgatgatcatgggcaagaagcgctgaccccaagtggtcggtcacctatgtgcagtcgctctacaaccacctggacgccacgaactgcgcctgcgcggcaagaatgtttagcctgcccgcccgcattggccagcgcagtggcaagctgccgcccccactctccgggcaccgtctcctgcctgtggtccgccca

SEQ ID NO: 726973 - DNA, 835 bp, Homo sapiens
ggggatcggggatgcaggagttgagtggcagtttcaataacaggtcatgccgagaaaaggatagcactataatatgcagaaatctacaaagttctgatacttccgtggaaagcactgaagttctacccgccaaggcacaggagctgcgcatagtgagaatcaaaactgccaacagcccaccatgacaggctcagccaaagtacatccatgatcctcaccgatgtcgggaaggtcactgaacctatatccagacacagaaggaatcattcagcagcatatcttgaaagatgtcgattcctccattgaacaactgatggtggccaacgacggttatctgcaaaaagctaaaattgcagatggaggaccgagagtaaggaacacactggtctacttcctggatgttctttctagtcgaagaattgaatttacaaagaatccaaagcaacaggctctgtccaatatgaaaactggcacaaaccagacagtgtggattgtgtggagcacacatgaatgggccaggcaccattcgagcagaaagaatgtcttccagatcacaacagtatcaggacccggcgttccttctaacagtcagatatggactttcctcatatcggctcggttccacgctatcaacaatgcattggacagacttggcgacggctcacgtgtcatcagaaaactggattttcaaaatccaaagatctctagcctgaattgctaagtcccacgcaggggttcaagcacgaaccgagccagagaacttatgtcacgcggctcacggtcgacagggaaacggtaagcgaagaggatacggacaccggatggaaggtaaacg

SEQ ID NO: 726974 - DNA, 247 bp, Homo sapiens
gcttagggagtcactaactctttatctagtcaactcattacaaaaatttatttttggccaggtgcggtggctcacgcctgtaatcccagcactttgggaggatgaggcaggtggatcacctgatgtcaggagttcgagaccagcctggccaacattgtgaaaccccgtctctactaaaaatacaaaaattaggcgggcgtggtggtgggcacctgtaattccagctattcaggaggctgaagcagga

SEQ ID NO: 726975 - DNA, 301 bp, Homo sapiens
ctggtgatctctagcaggatccccagcaagaatggcatatcagtagccagttttaacggaatcagaacactttgggtacatgctgctaacagcccgtcagctcgtcatccttgttttttgtcaacctggctatccagtaagtaccaatgtcctctatttttgtccgggaagacttttgaatactttcaagtgcttatttttattatcacctgctcgttccttaatgtactagtttgttccagctactacttgagttttatatctgcacagtcttcccaattttccgataagatctccattt

SEQ ID NO: 726976 - DNA, 458 bp, Homo sapiens
gttctttctggccctggacaaggtttttattgggaaacattgcatctagaaaaaaggaccaaatgtgacaagttagatgggccccagcccaggattttaatagggtatacatgggaacaggttaacagggttattgggaaatgcattttttgaccaatataatctaaaaaggactggaatatttacaggcttttaatacataaataacttgggtcaaaaggacccttactggtaaatgctaattaatagtggaaaacaggctaaaagcaccatacaccccaccatagttttttcttaccgggtcacatttaaagaatatcagtttattttgtcaaaacactacagagatccaggactgggactgaattactaatttatacaattgcgaaaaaatttaagttataaaataagggtatggaataaagaagggtatttaattaggactaaatactgtgaag

SEQ ID NO: 726977 - DNA, 167 bp, Homo sapiens
tatggcccaggctggagtgcagtggtgcgacctcagctcatcgcgaacctccgcctccgtgggttcaagagattctcctgcctcagccttccccagttagctgggatttataggcacattgccaccatgtgcccgggcttaatttttgtgtattttcaggtaagaag

SEQ ID NO: 726978 - DNA, 427 bp, Homo sapiens
ccatgtgaagtgtatacaaaacaattagccttatctaggtaatacacactgatacaccatattgtcaccatttcaatgaagatatgaacctatgataggtcctggatctgagggggtttttgtctgtatataggactgatatatttattccgctcaactcttgccttttcttcatactgtcctaggctgtttaaatagaaccaatgactacgaatagtttctcatattttcactacacgtttagccagaaagcataccctccctctctcttacctagtatttacttgatcgccatcacctcctctggtatatgtttatttgtttaactctttcttcattgtcagttctgtttgctgctgtcttctcagcacccagaaccaagcctggcatggtgagtgctcattaatatgaggtgagtaaaagaaca

SEQ ID NO: 726979 - DNA, 394 bp, Homo sapiens
  misc_feature (24)..(24): n is a, c, g, or t
acaccttttaaaaatttatttttnaaaataacccatgcaattttccacattgtaagggcccactttttccatgtatcatttatctcctcttcctcagcctaaagactggggcccgggcacagtggctcactccctgtaatgcccatgactttgggaggccgaggtaggcggtttgccctgaggtcaggagttcgagacccagccctggccaacatagtgaaaccccgtctctactaaaaatagaaaaaaattagccaggcatggtggcatgtgcctgtagtccagctactcgggaggttgaggcaggagaattgcttgaacccaggaggcggaggttgcagtgagccgagattgcgctactgcactccagcctgggcaacagagcaagactcca

SEQ ID NO: 726980 - DNA, 515 bp, Homo sapiens
cattggagaactggagtgtctggagttcccacggtgtagtggaccagaggccacctctcctgggcttctcaagtgtcatacgccgagcgggggttccgggccttgaagccttggatttggacatagcccttggccgggaatttaaaacaagctaaacattaagcagtacatgctgcctcaaaccttttgggattttcagaatgactgacactgccgaagctgttccaaagtttgaagagatgtttgctagtagattcacagaaaattgacaaggagtatcaggaatacctgaaaacgccctcctgagtctccttccaatttgttgaaggaattggaatagcagagctggtggggaaccaaaaggaaacaggagggcaaatcgcgttgcaagaacaacagacagttcagaggcagggacaacagatgggggtggccaagtgacaatcgatccaatcagtggcatggacgatcctggggtaacaactacccgcaacacagacaagaaccttactatc

SEQ ID NO: 726981 - DNA, 155 bp, Homo sapiens
ttccatgtaatctgcaattgaacatgggtcagtcagtccttagagcattggctgagcgccgttccgaagggactggtgctgatggactccgcttgccctcgtggcgatcgaagatgggagtcgcgcttgttgtccgagtaccgaggctcaatttc

SEQ ID NO: 726982 - DNA, 192 bp, Homo sapiens
ggtcatgtccatgccagagtaaaggaccctgggtgtccccatcaccctccagccccgtgtgccagacgcacctatatggtagttggtgccaagctcgtcaataggcacagaactaggatacagctatactacgtagatagctagaaaggaacagtagccaggcgctagacgacaggcacagagtaccacgta

SEQ ID NO: 726983 - DNA, 499 bp, Homo sapiens
  misc_feature (71)..(71): n is a, c, g, or t
  misc_feature (308)..(308): n is a, c, g, or t
  misc_feature (325)..(325): n is a, c, g, or t
  misc_feature (328)..(328): n is a, c, g, or t
ctcaccatttccattacaatttcattctgttgtcctgctctgacctggccagaaccctggtcttcgaacantggctgcaaacatagatgctcagaaagtgtaactgttgaatgactcacttgctgaaaatgaatttaatattttcaaagcaaacagctaagaaagccaacaaagttgctttaaacttgtttaaaagttgtaaaaatcaccctgtttgcacccaagtcactgctaaggggcccaatggcaggaaacatccattggtgggcacactgctttctgaccattcatcccgataactcaggaantcactgcaaacacgcantcnagtggagaagacggaactggctgaaaattaattaaaaaaaaaaaaagacaagtcgaatgtgttggctcacacctataatcccagcactttgggaggccaaggcaggtggattgctcaaccccaggagtttgagaccagcctaggcaacatagtgagaccccatctccaccc

SEQ ID NO: 726984 - DNA, 1180 bp, Homo sapiens
agcgggggggggaggtgagccgcaggggccgagtgactgacccctgggactcgcggtcccaggcgcaagggtgccgcggcgcgggacggagggactgggacacccgatggtgagtgacgggtgccgggggtctggcgccctggcggcggctgcagtagagcgtcggtctctggtgaccgtgccctggggtgtcgcgtggatactcctggcgtcggggtgaggggcggacttcggagcgttcggcgtatgatccacgcacgtcacgttctagtgtgacttgcgcgagacactttgttgcgtggcgtagccatggcgtaggttcttgcgtgtatcggtggcgcaagcattgggagagttgacccttgtgtggcccatcctaagcaaaagcaatgccgcctctggacacgccttggggacggccatgggatcgcaacttgggtgcgggccaaggcgccgtatgagccctggggagcgaagcggcgaagagccctttgagaacgggcaaaatggctggttaggccccaaaccttgcaatgtggtcctgtggtcggcgttggtgcctttgggtggtgtgcaacgccagtccacttgcggtttcgcgtgggagctcgaggggggtgcgatagcctttccattggggttcgtgttgttgcatttcgcgtgtggaggcaatcgggcgcaccgaattggggatggggatggggcctttgagtgcggagccaagagcgccgtttcgagattcggatctgcgattcgccgcattcgcgggggcggtcacagaccgaggcacggacggtcgcgccatacccgacgaagcgaagcagatcccaacaggttggttgaacaccgacaaaggtcacccagcatccgttaagacagctcattaaattatataccttcacagccaactttgcagatagtgacctaaccaacttggcggacactgggggcttggggcatgtgaccacaccacgccatgggcccatgtgtctgtggaccacagaattgtgtgtgttggtcgcgtgcggtacccccgtttggcgacaccgggcagacctacgcggagtgcgcttggcgcgcaaaacggttgctaccatattgtcacggacctaggctgcccccgaattcgagtcaccaacttgtatcggccggcacgcttggaagctaacttgcaactggc

SEQ ID NO: 726985 - DNA, 652 bp, Homo sapiens
  misc_feature (336)..(336): n is a, c, g, or t
tacgaactggtggcggcgcggaattctcagcggcttccacaccctgttgactccaaaaccacgtcggatgttttaaggtttgttttggagcagtacaacgctctgtcctggctcacgtgcaatccggccacccaggaccgtacttcctgccttcccgtttttttgtgggtgggcactcagttgtacaatgccatcatgaatatactccaattggaaaagcacttgttctctctggctcagttccttctccctgcagcctcagtccaaggaacctgctacactctgcaaataacccacatgcttttcttcagaccactctccacaggcctgtactgngattccttctcagtaggcacatgtcaattctgcagttgtcattaccagagtgacttcttgacacttttctcatggaccttgggaacttccataagtggagaccttcagccagtgcgtggggcgtgtgttgccccaaccactgggtccccagtaagccccgccgggttgtcgccttttctggtggtttcctgttccgtccagttttcttttcgctctcgttctttcctttccccccccctttttcttctcgttttgtgtctctccccttttccttatattctttttccctcttgtctatatgacatataaaaatata

SEQ ID NO: 726986 - DNA, 745 bp, Homo sapiens
gggcgaaggcgcacccgccgatacgcgcgcggagctgcggccccaggaccccgcgtcccagcgcagtgccccccgatccgccggggactctcgtgtcctcgtcgtctgaccccctcaagtgtgggtgaatgtggggactgaggctgcgtggtgtccgtccggaatagaggactgcagggaggcgtgccggcaggtatcagggacgccgcccggttacattgagcctggcggtgctcctcctggaacctgctctcttcatcgtatctttaaggaagcagagtgatgagaggtccagacccgtgcgccaggggaatgagaccgtatgactcctacagccacggttccgggtcggggaaggcgatgcccatcagccggccctgcgacgacccgtgcctgggcatcatcgatgaggaggaggcagaaggcaggagccgacgacgacgggcagggaccacacagcggccaggggacccacctgtggagcgggagccgcgaggtcaggaggttatggcatccagcagggcgtgcccccggtggtcgtgcgtcctctgctggggctctgtccgcgatgctggtgtcgtgcgtgaactcgcgtcgctgcggtcaaggtgcgaatgccttggagctcttccggagtcacgtgcggcccttttggctgaggtgaaatctccttcacgctgatgctcacgtgagcggggaaccatgcgcgggagctggtgcggtcggaggagctgggcggtgggag

SEQ ID NO: 726987 - DNA, 176 bp, Homo sapiens
ggtggacgggcagcttcttctcgagatgtctgctgcttgagagctattgcttgttacgatataaaaaggggttcttttgtctttctgtaggtggacttacagcttttgattgaaagtcctagggtgattctatatctgctgtgatttatctgctgaacagctcagctggggtcgtc

SEQ ID NO: 726988 - DNA, 256 bp, Homo sapiens
cgttccacataccttctctcaactcatatataatctgttccacagtccttccgctcaattcatagataatcctgtccacattccttccctcaactcatagataatccattccacaagccttccactcaattcatagataatccattccacaagcctttctctcaattcatagataatccgttccacagaccttcttctcaattcatatataatctgttccacaggtcttccctcaactcatagataatcctttcca

SEQ ID NO: 726989 - DNA, 1061 bp, Homo sapiens
  misc_feature (53)..(53): n is a, c, g, or t
  misc_feature (57)..(58): n is a, c, g, or t
gagactgtagacgagttgggttcgtgtgtatgtgtgttgtgtgtgtgttgtgnaggnnggcagacagctccgtcgcagactacggacctctccggggtctcagccgccaaagaccctgtccggtaggtgagtggcacgctttgagggcaaggcttctcggatcgaggcttcttcatggccgctcgggtcgcaagtggccggggcttcgctctttgcggaggacggcgactcagagagcgcagttgatttgaggaaacactagccgggcatcatgagtggctgtcgagtgttcattgggagactaaatccagcagcgagggagaaagatgtggaaagattcttcaagggttacggacggatccgagatattgacttgaaaagaggttttggttttgtggaatttgaggacccaagggatgcagatgatgctgtttatgaacttgatgggaaggaactttgcagtgaaagggtgacgattgaacatgcccgggctcggtctcgaggtggaagaggtagaggacgatactccgaccgttttagcagtcgcagacctcgaaatgatagacgaaatgctccacctgtaagaacagaaaatcgacttatagttgagaatttatcctcaagagtcagctggcaggtttgttgaaatacagtttgagatattttttaatgtggcatttaaaagtgttaatgggtagttaatgttttattaatatatatcttattaaatgctttatcttaaattaatttaatgaactataattttaaactttaggttacatgttactggggggatgcttccagactgtatattagggggatcccatgttcacatgtgtcgggggaatatgccagttttgaaaatctcatttaccccatatttaacccgtttttggccggctatctgtggtgcgggctattaccacagaggcctgggggtaccaaagcgggctggccacctggttggccggtgaattccgcagagcccagacaagcgccctaatattgtgggcgtcgaaacccggcacaaagcgaggcacaccacactgtattacacacag

SEQ ID NO: 726990 - DNA, 1202 bp, Homo sapiens
gcaagatcacggatgtgtggcatctacgattcaagcgacgtggtacccatacgaggtgcgtggatgcaatcagcactcttccatcgtcaatatgggccagtgcggtggtgcgtccggatgctcgaccgacgcctacctggtggtccctgagaggagcacgtcttcgaacatatgtgctgacattgcattgcatcccttgggatccttggtactgatcataccaatccatcaagctggatgcttgcgattcctaagcaagacaactccgtgtacttgcaaacgatgatgaaacggccactacatgcgcttgtctctacatgagtctattccgtgcgacagacgatgcaggatagctgcgaccgaggaccagatgattgcacgttcgtcatgaacggagggaggcacgtgatgcctcgcattgcgagtggcgtccagggtgcttggtgtcctcgcaagtcgcggatcgtgccttgtgatggatacctgatggtacatacgtacaaggcaggaatgagggcaaatcgggaagtcttggccatcgactcatactgatgctcatccacatgggtgcagggagcaatggtacgttatcccgtcggtggcttgagtgacgaagccccttcgcaccagggggtgccctgaaggtctagagggactgctttcatcctggtacctactggcgaaagattgggagaaatcgttctgatctggatacaggcaaggcagcgcaatgcgcggaggacgacgcgaacggcttgcgctcgaaaccatagccctcttgactttcatcaatccaagatggaactagcctcgaaacaggactcaggggtctcggtccttccgtgaggggcggttgagacgccaactggttcaatacatgctcttcagggacatggcgtggaccagaccaaatagattggcctgggccttggtctacccttttcagccatatttgcgaccgtgtagggggttgccttcgagggacgccaatcggggcacaacttcacttggccatgtgccggccaagcgggctttcgattgaagaatgcggaatgggtcaaaaacgctcttggggagaccaaaggccccacaggggggcccgtgggctcgaccattttggcgcccacttagggcgacagagcgattctctggagaagcccacttggggcgcagcggcagaactaatagggcgagaggcgctc

SEQ ID NO: 726991 - DNA, 296 bp, Homo sapiens
  misc_feature (278)..(278): n is a, c, g, or t
cgcgccgcgcgatacggctgcgagagacgacagagggtggacgaaaaaggaccagagaggagagaccaggcccacctgccccaggctcagccagggagctgctggaggtagtagagcctgaagtcttgcaggactcactggatagatgttattcaactccttccagttgtcttgaacagcctgactcctgccagccctatggaagttccatgcattggaggaaaaacatgttggctctcttgacgtgggagaaattgaaaagaaggggaaggggaagnaaagaagggggggagtct

SEQ ID NO: 726992 - DNA, 935 bp, Homo sapiens
  misc_feature (53)..(53): n is a, c, g, or t
  misc_feature (57)..(58): n is a, c, g, or t
gagactgtagacgagttgggttcgtgtgtatgtgtgttgtgtgtgtgttgtgnaggnnggcagacagctccgtcgcagactacggacctctccggggtctcagccgccaaagaccctgtccggtaggaaacactagccgggcatcatgagtggctgtcgagtgttcattgggagactaaatccagcagcgagggagaaagatgtggaaagattcttcaagggttacggacggatccgagatattgacttgaaaagaggttttggttttgtggaatttgaggacccaagggatgcagatgatgctgtttatgaacttgatgggaaggaactttgcagtgaaagggtgacgattgaacatgcccgggctcggtctcgaggtggaagaggtagaggacgatactccgaccgttttagcagtcgcagacctcgaaatgatagacgaaatgctccacctgtaagaacagaaaatcgacttatagttgagaatttatcctcaagagtcagctggcaggtttgttgaaatacagtttgagatattttttaatgtggcatttaaaagtgttaatgggtagttaatgttttattaatatatatcttattaaatgctttatcttaaattaatttaatgaactataattttaaactttaggttacatgttactggggggatgcttccagactgtatattagggggatcccatgttcacatgtgtcgggggaatatgccagttttgaaaatctcatttaccccatatttaacccgtttttggccggctatctgtggtgcgggctattaccacagaggcctgggggtaccaaagcgggctggccacctggttggccggtgaattccgcagagcccagacaagcgccctaatattgtgggcgtcgaaacccggcacaaagcgaggcacaccacactgtattacacacag

SEQ ID NO: 726993 - DNA, 789 bp, Homo sapiens
agcggagtctcttggaaaggaatctcactatgcgggcttgactgcgaatgggtctgtagcgctattcactgtaagaaatgcaagatgcattttacaaactttaactacagtatcagctccctgattgcctgtgtggcaaagcagatgaattactcttcagcgagaagtgaataccatgggtgcaacatttgagtcccgtctttagggacgtatgacagaggacatcatcgcgtttcagtattttataggagcttcaaatcgcagtcagaagtaacactttaggcaactccctgttcttccgtcagcaagaatgtccagagtcgtccagtctgtcgatgaagacatgcagtctttcgtgggaaaaggaaatgcacagtttatattttgctcagaccattacactataggaaagctcacacctggctccgccaaatccagacaatcacgtttctgatctcccctcccgactctctccgccagtgggatggaaacaagtggaacgatgcgatctccagtcataaatctatgatctcttatatgccatctccgaagctggggccaggggaaaagtatgaattgcacgcagacgactgacaccagctcccagcgtggtggtccatgtatgtgagagtgatcaagagaaggaggaacgaagaggaaatggcaaagaatgacggagacctaagccaaaaattatccagaccaggagggcggagtacacgccgatccacctcagctgaactggcacgcgacgaggacgcattccaaatcatactcacgggaggaatc

SEQ ID NO: 726994 - DNA, 407 bp, Homo sapiens
ttgcgccccacgcgtccggtccaaaaacgcaaacggcttgaaacagctgagagatttcaaaagcccctggaccgagtaattgaaatgattcagaattgcttggcttcttggcctgatgatttgcctcattcagaagcaggaatgagagtaaaaactgacccaatggaggctgatgatagcaccaattgttctggccagaatgaacctcaaagagaaaattcgggtcatgggagggatcagattatagagaaagatgctgccttgggtgtcctaattgatgagatgaatgaaagcccatgaaagatgtttttttttctttttttccttttgaaaaaggcatcataaattggttcttttttttttggccagtcttaaaagaagtttccctaaaaatgtaaacagcttta

SEQ ID NO: 726995 - DNA, 137 bp, Homo sapiens
gtctgtatctgttgtatctggaaaaagcaacatatttcatgctttgaatattttctctggagaatagttttaaagttatttccttgtgtaacattcaaaagtaaaacacacatatataattccatcaaggattctct

SEQ ID NO: 726996 - DNA, 1170 bp, Homo sapiens
atcatcatagcaggcgagatatgaggtggattaaagccaaacccagctacgcaaaatacttagcatactacctcaattacccacataggatgaataatagcagttctaccgtacaaccctaacataaccattcttaatttaactatttatattatcctaactactaccgccttcctactactcaacttcaactccagcaccacgaccctactactatactacgcacctgaaacaagctaacatgactaacacacacttaatataccatccaccctacctctccctaggaggcctgaccaccgctaaccgagctaatatatagcccacatgggccattatcgaagaattcccaacaacacaatagcctcatcatccccacacatcatagccaccatcaccctaccttaacctctacttactacctacgcctaatctactccacctcaatcacactactccccatatctcacaacgtacaaaagtcaaatgcagcgcactgcaacactacaaaagcgaacaccaaacactcccacacactcagtcggcgcttaacacgtcaacatctacctataatcacacttgacatagctactaactctgcacccacccgcgcacacccaccacaaccaaaccacacagaacaaacacgagcacaccggacacagccggagaaggagaggaagccagcagacgccagaggacagcggccgcaaccgcccaccagcgcgcacgcgcggccacgcgagcgaccgccaagcaaggccggcgacagcgcctaccagagacacggaaataacgaagcgaggaactccacgcggcgacgcgcgattgccagaaacgaagccacagaggcgtagcgtcgtcgcaccgtcgcaccacgccgtctcacgccgatgacgagagcaagagatcgagggccgacatgcggtgcccctccatcgtacccagaacgaggcgcagacacaccataagggcaggcatcaacaaaccacggcgcgaacgagccgggaggaggcgggtgcaaaccagccaacgcgagcggagagtactacatgatcgagacaacaacacaaacataatgaaacggagcgatcgaagtgtcgccgacggaactcgatcggaagcaatccggggcggtgatgcaagctagttgcacagcaacccgaaaca

SEQ ID NO: 726997 - DNA, 874 bp, Homo sapiens
tgaaacaggatcttgctttgtcacccagggcttgcttggtcacgcaggctaaagtgcagtggcgcaaacatggctcactgcagcctcaacctcccaggctcaagtgatcctcccacctcagccccctgaatggctgggactacaagcgtgcgccaccatgcctggctaattttggtatttttgggagagatggggtttcaccatgttgcctaggctggtcttgagctcctgagctcaaacaatccaccctcctcagcctcccaaagtgctgggattacaggcttgagccaccacacctgacctattctgtgtttcttataaaaataaaactttttgggataaagcttatttctggtttttccttttcctttttttttttttccgagaccccatctcagaaaaaaagaacaacaagacggggtacagatgtgatttgggaagaaaaagatcaggctgatgaggttaggatccccaggcccttgggacttaaagatcactagtgtctaaatcccatcgagggctttccagtctataggtaacctccctggacctggattggcagacggttcacccatcggatatatggcgctccggttaggtcctagaggagcgttccctgaacttgctttgctgccccccgtctgtaaacttcatcctgtaatgaagtttactcaactgtcctcgtgtcgcgtgcccacggcgttccccgacattctttcgggcccctaatagtcttgtcaagggtctaaaccctgtttccagggggccctctgccttggttgcctctgaaacctattaatcagagagattgccaggccccggccgaccacagcggcacccatgttttcccccgggggggccccacactagggcg

SEQ ID NO: 726998 - DNA, 916 bp, Homo sapiens
  misc_feature (475)..(475): n is a, c, g, or t
cctccagtccatctctgcaagtccatgagccgtgtgttccgccattagtatatcttggtgctccttcaagtcgcatattcatgcgtggcaaaagtgtcacttaagatctgatgaattacatcactcgtatccgatgagatatagtgaattatgttggcatccaaagcatggcggcatgtaaaccagtagaatagactgcatatggcgtcgtaccaatcgaatataaccatagatcgatactagtacgtaactatgctagattcgtcgaagcctacatggctggaactgtgccgatctcatataccgcatgatttacgtggtgggtatgggaatcaccaggtactggtcatcgcgttgctttgtggcccataccgtagtagtacagtaggcggcccgaattgtttgcaccgagcaataacctcgcgaacccgttaataatccgatagagtgtagaaacaagccgatacagacgttngctcacatgcatagtatctgcgcactggattgactcgatcacctgtacctatgtactgggtattatagtgcgtacacacggtaccctcccctgtatgcagagaagttccctagaaactatgcttgggcgtcacgtaagttgcatcaaactgtgtagttcgctcacacaagaatgagctagagattgtggtgagttgccttactccactgtaccgcctggtggtgcctgtcaagaccgtgtctatgcgctctcatcgaatgagagcttggcaagtggccaggatgagaagaccgtacagcagaatcgagtacagggggccagtggtgtcacactgtaatgaggcataaccggatattccaagggcttctggaaaattccccggaattattctgcccaattgcacgtaaccaccatatcaagctgcctttgggggtttgtacc

SEQ ID NO: 726999 - DNA, 137 bp, Homo sapiens
aaggaggattcacggactcagagcttggggtggagactgaaggaacagacaggagagaaagaaggtccaggtatgccggcatacctggaccttctcctctagtcctgagccatctttagtctctgtcagctctttcg

SEQ ID NO: 727000 - DNA, 358 bp, Homo sapiens
taaatttttccccttaaaatttagggggggttcggtttttcaaaaatttagaaggggttttgttttttgaggttccaattttgggggggggggcccaacaacccgttaaaaaaaatccttttgtccttccaaaatatgatagggaattatgggttaaattttttggttatttccaaaacccccaaagagagaaatttgtttttttccccccccaaaaaaaaaataaatgtttggggggagggattttcccgttcccctgttttgttccttccccctcaaaaacatgggtttaaatttcccctggcccccccaaaaaacaaacccctttggtttttccataaataaaaagggaaaccca

SEQ ID NO: 727001 - DNA, 154 bp, Homo sapiens
tgccctaaagacagggttttgccatgttgccaaggctggtcttgaactcctgggctcaagccatctgcttgccttggcctcccaaacggtagggattataggtgtgagccaccacgtctggcctccaacttgattattgaatacagtctttctc

SEQ ID NO: 727002 - DNA, 225 bp, Homo sapiens
aagcgaacatgcggccagagaggacgtgtcagctcctcgtgggactgaagagctgctgaccagtgcagagtggtgggcggggagcctagggtcctacacaccaagcaacagtgacgatcgtggctgaggaggtggtctgcacacctactggccgaaatgactttgtacatcggtggacccttgggactgggagaacggatggcagcagagtcttctgaaagcaga

SEQ ID NO: 727003 - DNA, 126 bp, Homo sapiens
gctgatataaggatcttgggagtagtcaatgattgtaaaagtgtagcttacttgttgtctccgattcaggttagaatgaggaggtctgtgtgctaggagtaaataaatgtgatatggttagtgggc

SEQ ID NO: 727004 - DNA, 513 bp, Homo sapiens
  misc_feature (5)..(5): n is a, c, g, or t
  misc_feature (32)..(32): n is a, c, g, or t
  misc_feature (62)..(62): n is a, c, g, or t
gatcnaatcctcgggcccctgaagttaatccnggagggcctccatcctggcaaaaaaggacnaaaaattaggtaataaaaaaagttagggccatggaaaagtaaaacatttatccctagaaaaagcctaaataacaaccccaattacctttggttaatgggcaaaaacccccacaaaaatccccataaaaacaaacacaaatatttttaattaattaaactaattgtctggcctgcttgaaagtgtcatcaatttagtgaagtatttaagactagctactcacacctataatctcagcacatttggaggccaaggtaggcggatcacctgaggtcaggagttcaagaccagcctagacaacatggtgaaaccccatctctactagaaacagaaaaattagctggttatggaggcacgtgcctgtaatcccagctacttgggaggctgaggcaagagcgaatctcttgaacccaagaggtggaagttgttgtgagccgagattacaccactgca

SEQ ID NO: 727005 - DNA, 299 bp, Homo sapiens
ggctcagctcaggtatggggatgatgtgctccgggctgctctgcacggggctcacggagccagctccagaacgctatagtgctagggttgccgtgtggctgtccaggagcaacagagaggcacaagcagaggccgtgggtgaggatgagccgccccagcgactcaagccgcagaggcagacgccacctggactgctcctccctgccagctgggcctctctggcctattcctaccttccaggcccactgcactcctgtctgggaggcccttatgagggcagcccagccccccgcacccac

SEQ ID NO: 727006 - DNA, 355 bp, Homo sapiens
gtgttagaatgcctctgggttggattagatgtcggagtactatgtgttccaatcactagacatatggaaacatggtgacaggtatctctctgtcgtggggaatatttcgggagctcacacagcactctgccactagcaatggagagacttacactggtttgatgaggacaacactaagaagcacctgtgtggagcagaataagaaattctgtaaatacctagacaattagctaaccagaccctatgaagaattgatgcctataatacctcatatagaaacccattactgctatgtggttaaagcaaaacgttccattactgctcattgtgtcgtagagaggagcttggtgtctct

SEQ ID NO: 727007 - DNA, 483 bp, Homo sapiens
  misc_feature (4)..(4): n is a, c, g, or t
  misc_feature (18)..(18): n is a, c, g, or t
  misc_feature (22)..(22): n is a, c, g, or t
  misc_feature (75)..(75): n is a, c, g, or t
  misc_feature (77)..(77): n is a, c, g, or t
  misc_feature (82)..(82): n is a, c, g, or t
  misc_feature (91)..(91): n is a, c, g, or t
  misc_feature (101)..(101): n is a, c, g, or t
  misc_feature (163)..(163): n is a, c, g, or t
  misc_feature (177)..(177): n is a, c, g, or t
  misc_feature (185)..(185): n is a, c, g, or t
  misc_feature (187)..(187): n is a, c, g, or t
  misc_feature (200)..(200): n is a, c, g, or t
  misc_feature (203)..(203): n is a, c, g, or t
  misc_feature (212)..(212): n is a, c, g, or t
  misc_feature (215)..(215): n is a, c, g, or t
  misc_feature (222)..(222): n is a, c, g, or t
  misc_feature (238)..(238): n is a, c, g, or t
  misc_feature (242)..(242): n is a, c, g, or t
  misc_feature (268)..(268): n is a, c, g, or t
  misc_feature (274)..(274): n is a, c, g, or t
  misc_feature (296)..(296): n is a, c, g, or t
  misc_feature (298)..(298): n is a, c, g, or t
  misc_feature (310)..(310): n is a, c, g, or t
  misc_feature (326)..(326): n is a, c, g, or t
  misc_feature (354)..(354): n is a, c, g, or t
  misc_feature (368)..(368): n is a, c, g, or t
  misc_feature (397)..(397): n is a, c, g, or t
  misc_feature (400)..(400): n is a, c, g, or t
  misc_feature (409)..(409): n is a, c, g, or t
  misc_feature (454)..(454): n is a, c, g, or t
tcanaaaaaactttattntganaggcggggctgatcccccccatgttgggagacaccatgtggcaagtgacaaancnctganccccccccncttggggccncagtggtaggggtggggggagggggtggcccccatggctggggtagtaccatgactgggggnggggggggcaaccngaggcctncngctttgggggggngcnttccccccnccntgtcccnccccctctggggtccnggcnaggcccttcccgtcctccttttcctncctctnccccagggtaggcccaatcctntnaaatttgggtcnctttgccgggtcttcnttcctgccgatcttcctgagcttccccncatggggggaaatncctggtggggtggttggccgcccctcccnatncccccttcnttcccatctcccttttggggaggtccgccaagggtccctcccgtntcacccgtccccccagaagccctgcaaaa

SEQ ID NO: 727008 - DNA, 296 bp, Homo sapiens
caggtgaatcattcacaatcacactgctgtttgttgccgtatccattggctactcgcttattttgtagggtaaacagcttgtttctattaaattccgatcgccatcgattgcgagtcagagaatgcaggtgtgtgttattgatgtgggaagatcatatccgagagcgagggagaaaacagtcacaagtttcatggggcattttcaatagactggacggaacaaactttcttgtatttgaaattcgtttaacatgtcataactccttctaaagagttgacgagcgatcaacgaaatg

SEQ ID NO: 727009 - DNA, 121 bp, Homo sapiens
gggtgcggcgtcaggcctgtgggtgtggtgtttgtgtggtgcggtgtgctgttgtctgctgccgggggactcctctacgacgtctgaccctgccggcctgcacagcttggacctggccgtc

SEQ ID NO: 727010 - DNA, 289 bp, Homo sapiens
tgctcttctgtgattctgtacttttcccgtaacttcaggtgcagctcttcaacatttcttcttttctttttatcttgctgtgtggcgaatctcagactacagagttctttcgccactctcgtgtgtttcatgctttaactcgcgattttatttctctctttttcacgatagtctctttagtagctacactacgccttatttttcagcttttcagactttttactctaagcttgctcacgagggattatcttttaagcttctgttaatccttttaccataaaccaaaatg

SEQ ID NO: 727011 - DNA, 152 bp, Homo sapiens
cacatctagcccaagagcatgagcacgtggtccaggagagccttcaggcccttgaggccccatggggcagtgctgtgtgggcagaggaggggtagatatgcagcagcgagccagtgaaggacctctgggcaacaagttcccaggccctaaat

SEQ ID NO: 727012 - DNA, 454 bp, Homo sapiens
gctgtctccggatgtgtaacaggaccgatcatgttatatccagatactaggctagtgattagcatcgccatttaaagtgaggaacctgctgtataaagatatgctggtcctgcattaattctcgtaggataagggcctccgactgcatacatgtcgcagccaaggacgtaatttaatgcttaaaaatggctgcctagtatcaaatagtgtatacataccatgttttctttatcagtccaccatggacaagcatctgagttgattccatgttttagctatggtgaatttggctgcaatgaacacatgagtatatgtgtctttcatagacagcacaatttatacacctgtgggtatttacccagtcatgggattgttggggtaaaatggtagttctgttttatgttattgcagaaatctccaaactgctttccagtagctgaactaactcacattc

SEQ ID NO: 727013 - DNA, 543 bp, Homo sapiens
aggaaggaattttatgagacagagactcgttctgtcgctcacactggagtgcagcggtgcgatctcgcagacctccacctcccaggttcgagagattcttgagcctcagactcccgggtagttgacattacaagcaccacgcatggctaattttatttttaagagagatgggctttccccatgctggccaggctggtcttgaactactaaacctaaagcgaactgcctggtttggtctaccacagtgcttggattacaggcgatagccaccatgcccgccctatcttctcttataaggaacaccagtcatattggattaagggcctgccctgctgcagtctgacctcatcttacctacttacaaccacaacctcagtatttccaataaaggacacatactgcggctccatgaagtgcatgaattttggggaggacaccactcaacccagtgcattacagttctatttaacataaaagactaatcccatactatacatggtgaaaaaacgacttattaaataggtgaaagactgccgtatatac

SEQ ID NO: 727014 - DNA, 118 bp, Homo sapiens
gaatggcagcgtctggatttggagactggtttagtacccaagggagcactttatgggcaataaactgctgtcagttccatgatggatccttccgtcgccagtgtaaggggctatgaat

SEQ ID NO: 727015 - DNA, 129 bp, Homo sapiens
tcgactcagaggatcctcttctcgaaaggcacagtattatgggtacgaatatcttaaaggcataatagggtccagttaaaccatactttctagccattattgcatattaatcaagacttctgtttattt

SEQ ID NO: 727016 - DNA, 962 bp, Homo sapiens
cgcagatatacagaggccgaaggagtggttgtccaaaagtccgtgtacatcttgtgatcacaagagtctggggaccccttacaacgagaacttatgcctcaggacttttcgctgtaggttaatgcaaagtgccttgccttcccacggtttaacgacagatcactttccttcggtggtctattaccgtcacataaacaaccctcgcgaattatcctttcttcccaaaggtaacagaacggggtccaacctaagtcagtcttaaagatattggaacgtataagtttcgaaaagtaggtgtgatcttatgtccgatttcaaaaattgaaagtttttgcgcttattgtgcgaggttaaggcgcgtaaatgggcctgagttgtaagtgtataaagcgagatttaaagcgtactgctaccgagtagagatctctaactacctttagtacaactggataagcgtatacatatttcatcgtgtactttgattgatatgaacgaatatcatcgaaatattgtttctttcaatagagaatccaaatgtatctgtggcatgctgtaagttgaattatagaacctacgcaaattataattatgtctctatatatttattgcaaggtaaggaatataaggaattagtaggagagacatatgaaactgtgcaacgagtgcaaaagcttctgagcatagtgctaaaactgttaacatacttagactctcaccgaaatggcaaaactcctatttagcgtgcagaatactttaattcaatgtagaattttcctattaatcagtcaagtatgaatcctaacaataatgctcatgtgacaacctagtttagattattccagaaattaaattcaatttattttctagagcttaagtaaccactacgttaacctgaaatgagatgttaggtttcccgtgttcctccgaatggttcttccacactcaaaataatggaatatacc

SEQ ID NO: 727017 - DNA, 1423 bp, Homo sapiens
  misc_feature (374)..(374): n is a, c, g, or t
gcacgctacctagctagtgctcatagctaggagaccgacagtggtacttccagtatccatgcgttacgcagagcttgtggagtgcggacatgtcccatgaaggaacgtatgcaccactaccgtgagaccaggtcgtgtgtctcctagttggcatcagagtcctggcatgtaacgcgcagtgagtgatactacgagctcaccacatggcgtgaatgagtggatgctcgcgagtgtagagcgagtagatgcaatcgtcgctcgcttcggtcagtaaggaagtagagcccccgagggcgaccttcaatttgcttgcgacaagattagactgtgtccctctcggatctattcggaggtgaccacccgaatcttcttantaagcgtacgtggactctctagctagctactagcgcgtcatggggcggtcgaattgagctttgcgcgcggtactgtaccgatttgtagacgccttccagaagttgtgtggagccttggagccgcatgagtagttagtacgtggggcccccttgtcccggatggcccagttctacccaaacgcccaacacgtactacgcacgtactgccccttgacttctatgcgagaaagttgacagatcatagaccttcgtagacacctgcttgtcgcgggactgagttgggctcttggagaaaattaccgcgggagcgtgctaacgctacattgggacacgacaagtggcttgccgtggccttgcgactaaccttgatccaattggcgacagcagaaggctctatataaagatttggcgcccccttttcttttaaacacgcggccaacttaaaaacaaaaagcgcaaaccaggggcattgaggccaacttggcaccaccgaccttaggggcttcttggactcgcctagtgtaccttatggaagacggccgcagttggaaaaccgcttggtttgccaccctatttggccgcacattatgccaaattatgatcaagttgtgcaacgacacccaaggcgatgaggacacacacgcaacatttcccccctgtgcggcaaaattacacgcggtaaattgtcgtaagcattaggccctagacgcgcggcaagggggtgaggcccgtttttccgacaacttgtgggctgaggtttcacggggctcaccgcgttgttgtctccccccgtgtaaacagggccctttccattggggggcgccagcaacgtttgtgcaacggccggctttctgttcaaccttggcttttgtttattaccccttgaggtatgtccggactttttataaccttgttaggggtcggtttggggctttggcgcggaggtgcaccgcgcggcttttgtgaccgcctaaggtttctctcgggcgtcctgatctccacccatttttgtgtcgtcgttgtgttgggcgccgttgtcgtgtttaaca

SEQ ID NO: 727018 - DNA, 205 bp, Homo sapiens
aaaaaaaaaaaaaaaaaggggaagggaactttcctttttcttgctcctaattcttgcaatgtaacatgcccactcccctttttccttccccaatgatttaacaattctgagggcttcctcggaaaggtgagcagatgccagcaccatgtttcctgtaaagcctgcagaactgtgagtcaattaaccttctttataaattaaaaaa

SEQ ID NO: 727019 - DNA, 116 bp, Homo sapiens
tacggatgatcagcacgcacaggtgacacagcaagactccatctcaaacaaactaacaaaaaacaaaactcaaactgcacattaaataacagtgcatggccaggtgcgttgctgat

SEQ ID NO: 727020 - DNA, 251 bp, Homo sapiens
tgactctagcggatccctcataggttcgcagggtcgtgtgggagggggtggctccctggaggagaagtccatctggtggtggagaagggtctagtgcaaggatgcagactgggccagtatgtgtgggtccatgcaggaagctgagggaggtggaaggcccgtggggctcgagcgcatctgcccgccctagtcggggaagagcaggaagccggagaagacgctgtcagagccctggacctgcgaacctatga

SEQ ID NO: 727021 - DNA, 539 bp, Homo sapiens
ttctcagtcaatgtagccacccaactgtgggggggcaatgggaaactgcacttgcaattgttcttgtcttggtaagtttaggcctggtgtgtgctgcaagggacactgggagccctgagaaaggcttcttaaagtggggactcctaagctgagtacttaaggacgagaaatttgctaggtaggcaaatggtttgtgtgtgttgtggaggtggaggggatgggaacagcaggtgggtatatcagatatcatttggttctttcattaatcatttctctcttgagaaatgatttctttctttaatcacctctctcttgagaaatcatatttttcaactcattgaaagcaatttttgttttacttcattgaggagagttctaatagctgtttaaaaatcattggctgctaattccagtatctggcacatcttggcatcggactcagttgattttgagaatatgtttcattttcttggttctttatatgataggtagtttttcttattgtatactggaccttatcaatattaagttgtagaaat

SEQ ID NO: 727022 - DNA, 495 bp, Homo sapiens
aggcggacaatttgctacaagatccgtattcgcacccaccaagctccaccttgccaacatcattgtctgcaatctttgtaaacgtccgatgaaaatgagtgatgaaaccgttcctgtacctggtggaggcctatgagcgagttgaggaaaacaagcaggtaagcatcctagtgaactgttagaaaaaactatgcgagtatttaacacagactaagactaggcacgggatatgttagaagcagttgatagtacttctgatattagggactatgcttaatcagataggatcatggccaatggagagcagacagaaaaagcctcagattcatcctttacttcgtgtatggcacattccctttaagcttcaacctcagaacccacaaatgatcctcaggctagtttatctccaaggtctgaaagcagcctcaggtatttggcaatggggagttctgtgatcaatgcttggcctatctccataatagggctcttcaatag

SEQ ID NO: 727023 - DNA, 212 bp, Homo sapiens
ggtttaaaaaacccccctgccctccggcctgggtgaaagggcaaggccccctctccaaaaaaaaaaaaaaaaaaaaaaaaaaaaaaatgtagccatgcccatgttttaagaaagggccaaaaatattataaatagcaaaaacccccttttttttttttttgagacaaagtccctgccctccggcctgggtgaaagggcaagactccctctca

SEQ ID NO: 727024 - DNA, 202 bp, Homo sapiens
ccgggcgccgggtgcctctgctgctcctccttacggctgtgggtggttgtgtcgcttcccacttactgtgtttttgggacgacgtcctgtccgtggtacgtcctactccttgtgggaccgacttacgttttacggccttggacgtacggtttacggttactgtaccgtacgctctacggaccctacgtgtgtgtggacgact

SEQ ID NO: 727025 - DNA, 147 bp, Homo sapiens
atattcagcaggtcatatatcatttccattctgcctctttattatctctggaatcctttccttctctccatcttaactgccacgaccattaacacttcttacttagatgcctactgaatcctcacgactggttgccctgactccagg

SEQ ID NO: 727026 - DNA, 430 bp, Homo sapiens
acatttccaattttgatgctgaataaaagtgtcatgtgcccgtcatcccagacagtagttcacaaacagacacacctgtgcgtacatctgtctatctgtttcctgagctgggtaaaacaacagcacagaaccttcagtcctggtgagtgggtggctgtgcccctgtacccatggcaagcacgaaacccagtcgtgagaaggaaacaagtgatgaagcttaggcacgtggcactgtgctactctcaggacgcctcaacagctctctcccatgttagcccttcaacagggaagacccaaacctgtgaggaggcgactgtcccagacctggggtcccaggcgaatgtccacaagttactcaaagatgcaggacgcagtctccttgaacctgccatttccacaggggccagaggaggtggggtttaacaaaagc

SEQ ID NO: 727027 - DNA, 1492 bp, Homo sapiens
  misc_feature (1347)..(1347): n is a, c, g, or t
gtgtttctgtgcgcctttctcgtcttcttgcgtctgtcgctattggtacagtgtcgtccttattggcgggggtcgtgtagtgtctcttcctctgctgttcggtctgcttgtctcgtttggtgcttgggtcctgggacgggctgcggtcgccgctgcttgtgtgctgcaatgcggctgctctgtttatgtaagtcttgtcgatgtgccttgcttccgttgtgtttcatgttgctttctctgtctcggcacctgttcttgtggggggtggtgtgtcttatcccgtaggggcgcgtcgcctgtgctcttcgctgtgctcgtcgctgcctacttttgtgggggtgtgtttgtgtggcgcggttctttgtgtggctttgttccactttggttttggcaatctcttggccgtcccctcctctgggttgtggtgctgggggcaatgtgtgcttgtttcaccccgggggctcattcgtgtgcgctttgtgttgcccgggggtggcctcggtgtccttttcgggggtcgcgcgccgtgcgcgcgtctggtgtgtgtgtgtagccctgctgctcgcttagtggccgtttttgggggccccgcttcagccggcttttgcacagcgtgggatttgtgtgttgctctgtggtcctacattgtgcgccccgtagtttgagggtgtcttttgttggggcgcgtgcctgggtgtagtatcacggtggcgtgttttggagcacttttcccccgagtggtgtgtcccttgtattgtgtggtttgtgttctccccggccccgcttgccgctgtgcgcccccgagtgtgtttagggggtatgtatggccaccggtgtgtgtctccttcctggtaggctagctccctgtgcggggggggggggtgtgtgtgtgtacgtgcggttttctttgtgtgacgtgtgtcgttttgtggttttatatcgttgaccggggttctgtaaggggcgcgcccctgatgggtggtttttggtgtgttttggttttgctgatgcctgtgtgttcttctggaaccgcgtggaccatacctctcgttctgggacctcgtttgttgtaggccgcggctctctgtttgccccggagcgcgcctgtaatgtaacgagtatggaaagggcgtgtggtgtgccgggatccccttgtggattctttgagacacttgtcaaaattaacaccctcggtcacagccgacgtttatagcctctgcccccatctcgctgtttctccacgagtttaggctgtccggggacggggctcgagacgggtgggggactggaaacccctctccccgcggagaggacgtcgccacttctgggttttccactttatgtacntgtttaccactgaaagataacgatacctcctctgctttactggatacccctgatgttccagtatttagacctatgccatatttctttacttttcctttataaacatgtttgtttacaaccctaaaaaataaaaaaacaataaaaa

SEQ ID NO: 727028 - DNA, 160 bp, Homo sapiens
tttgagtcgtgcataacactccatgcatttcgattccatttctgccagttttcttccattttattccattccgttcgattccattccattcgatggcattccattcgaatcctttccattccatttcattccattcctttctattccattccatttcatt

SEQ ID NO: 727029 - DNA, 335 bp, Homo sapiens
acatgagtgtgtatactgaaggaactgccggactggttcggtgcagaaatataaagatccttgatcctcacgagccacaccatcgagatggcctctttcttgtccagtgtcacccagggactggacacgccatccaccaacagctggtattctgcagcggaatactctatgtagtacacaatcacagtacattgatatttccctgagtcataaatccggacttcaggaatgcatcactctctgtgctcttcatggaggagatgttgtatatcagcacgtcatccttatagaacagcatctggtgcttaggctcgacgtgagaggtggtgctgaca

SEQ ID NO: 727030 - DNA, 715 bp, Homo sapiens
  misc_feature (548)..(548): n is a, c, g, or t
aacagcgactcatcacttgcatcttatatcttaggacccatgccgtgacgcgcgtaaaacaactgggatcgctctggagctcctcctaaatagaccctgccggaactagccaagtaggtagatctcgctctcttacaaatacacataaccgctccttcagtacgtgagtgccgtttagaatcacaacacagctattccctagttcctactgagttggctcagatggtgagcatgaggactgaatgcagcgctgtcgggagaggccgagacgagtttcgatcgatgcatagtcacagatatgcaaggcactacctgaataccgtgagattacttcccgtgagtaactatatgacacatgcaactagataagtttgaaaattcaatacaagcgagctggtgatctgattgcccttttttagccaggtccaaaaggcactaaggtagtatatacgccgcatcatatttagggagggtgaccactatggtacgcaccggaagaaggttatcgtcaaacgaacgtatgaagagttccgccgtatcgaaggtcnccatactggatgagtaacagtcatcaacggttaattctatgcccgagattcaggatgttatcgagatctaagtgtgtagacatatggctgaggtgagtggtaaaattcgagaacctaaacacgggaaaacgcctttagtaggttgaaatgacaaatgggttctgtta

SEQ ID NO: 727031 - DNA, 188 bp, Homo sapiens
gatatggtgctcccctggcaggcaggcccagtgggccagtgtgcactcgacacagtgggcagatgtggcagcaggtgcaggagtagatggggtggcagtgcatggcaatgggggagctggggccatcaatgcagggcacatcggtggggtcagtgccagtgacctctgctgtgtgatgtgtagcagtg

SEQ ID NO: 727032 - DNA, 816 bp, Homo sapiens
tacggctaggtacgaggctgggtttgcgttgccactctcgcactctgttctttcgccgctccgccgtcgcgtttcctctggccggctctgcatgtggcctgaagatatcgccgcgctggtcattgccaatggctccggcatgtgcaatgctggttttgctgcggacgacgctccccgagcccgtgtttccttccatcgatcgtggcgccccgagacgaccagggcttcatggtgggtatgcggccagcaaggtacgtcctacgttgggcgacgaggactccagaatcaagctggctgcgtcgatcctgaccctagtaatgctacctccacttgacgcatggcatcgtcaccaatctgttgactgatcattggcatgagaggagtcttgcggtcatccaacagccttactagcaacgaaggctgcagtcgtgaggccccggaaggagcacccatttgctgctgaccgaggaccctcctgaaacctcaggggcatatacgagagaatgatgatgtcacgacttactgttcttgggatcgcttacaatcgactcccgagggcatgtggcgtaggcgcatactcacggtcgcgtgctgtcctctctgagcgcctcttgtgcgctccactgggcattgtcatggctctctgggagacggggtctcccacagggtgcccatgctccttgggctagctgcctcgcccatgccattctgcgttctgtacctgtcttgcctggacctgagcgattgctcttgaatatctcatttggctaagatactgcttctgcagcactgtctcgcgggaattttgcgctaatc

SEQ ID NO: 727033 - DNA, 886 bp, Homo sapiens
gaaagtttccttctcaggcacaggggatcctgaaaggggaacttcatcttttagttcttggagagtacatacaaatattcataataacacatatttgtttataaaaatctataatctcttctaggtgatatgatgacattattttataacttttattgtgggaaactattttttctaattatgctaaaacttaaaggatgggtaatatgcagcattactatttgcacataattccaaaacatcgtattttcttattcatgtatctctagtcttcttttagacagtggacccttttttctttttctttttttttttttaagtttggtgaacaatcctggggaagtcactaggggtctgggggggcggctttaaaataatggagtaatttggagctggccagtaggatctatggccgggactaaaatttatttcctaatcttcggatgaccaagaagggaaaacttcaggttggcagatgtgagatgaaatatagccggtgaatatgcatacggatcggaatgaaggaataacctttcaagtcaagaggaacggtcgtggttggcgggaaagtgagatttccctgcggagtggggagtagttgtggttaaatctcctcttgggaacagctgggccttttctccaggtaaagaacccctagttggtgcgggtaattctttctttaaaagagaacgtcggtttaaataagtaaagcccaaaactccctctatttttatcccaaagaaaacctggtaaggggagggaattaccgcgtcattcttctaaacaccttttcaatgtgttttacacagcaatggcgttattaatttagggcacaagggagaaattcacttacacgcaaaaagggggggatcacacacaggataga

SEQ ID NO: 727034 - DNA, 138 bp, Homo sapiens
atcatgctggaaaggcattgtttatcaccaaattgttcctggatggttgggagaagttgttcttggaggatgtgttggtaccattctttatttatgactgtgttttgaggtaaaattgtgagtgagcccactcccttg

SEQ ID NO: 727035 - DNA, 1736 bp, Homo sapiens
  misc_feature (388)..(388): n is a, c, g, or t
  misc_feature (498)..(498): n is a, c, g, or t
  misc_feature (810)..(810): n is a, c, g, or t
  misc_feature (1559)..(1559): n is a, c, g, or t
gcagatcgatggcggcgcttcgtgcccgagcgaggtgcccgcgtcatccgtgcgcgatgcggacgattgtaccgctgactgctagcgcacctaatcgtgcgaggacgtgtaccctcgcaccagggctcgacgcaagtgtacggactccaggcgttatcgcacacgtaggaactgccacattttcctattgtgcttttgttgcgagtacacagaaggactagctcgatactacagggtagtggaaccatgggcttctttggtatggagcatgctagccgatacaatgccgagtgaggaccggtgtctctggtgcagacactatctgcctcccagaaaggccttgtccaatactggtcaatagtgcaaagagagaatgttcctggtgtgntgtaatcactccccaccgatgattcagtctgcgtgtcaactgtgtctgtagctgagtactgttcttgagatgtgtgaattcacttgtgagacaatgtgtcagtgcaacgnaccaaagagggtctcacagccaatctcacaccggaccgttagtcttccaataggccacctcgacacgtgtgtcacccctctgcgggagctccactctcacaggagtggtcctggaatcctgtggttcgtagcgtaccaagctatacataaacagtggggacgagtctcacgtttgagaaccgcgacaccttacgtatgtgttttgggagtcttcccgtacgttctacacatatacgtgctatcgcaaagacatcctatatatgagaacatcccgtgaattggttcgcgcgaaatttttggccctcgtgggcnttcgtagttgttctgcttgtgcacaactctggggggtcatacctggtgggcatcgaccttgcgtgaggaactagatgggcttgcttggggggcctcgaccgggggaggtcggtcactcccaattttcccccaagtccccacgttggcccttcttgttccatcgggccccctaagatgcgtacccgagtgggcatgcgtccgttacctccgcgtgaataagccattggtttggccgcccagagtgggtcccttaagtccaactcttttggtggcgattggcccttcgccattgtgttctcgcccgtatgagtggggcgcgcgtcctttccttcataagtttccttcgcggggacgcgcaactggaccttctctctcgagtctccggatggcaaaccgggcacgccgttggagtgtaacacctcgcgccatttctacacctgggtgtgtaggcgcttaggcctcaatagtgctcgagcagacccatgagggtgtgcccatgataccccgttaggtgcataatataccctcaacgaatgtgcggccccagggcggtgccctgggggcttgtcgataacctccttggtgttgcacagatccatgtcccaacgctcccggggaacgcgccacatgatactagatgcccccaagatttgtgaggaacccgccaccacagaacaacccgcgaacagacacagcagggccatacacatacacggggcggggcagacagcagacacaccaccaggagncgcgagccaccaatcagcgcttggcagcaccgccacacgtacagacacggcagcaacccccagcgcgccgctccccacgacggtgccacacacaccaacacgacacgcgcacgagctacgcacacagaccagctccacccactacacaccccaccgcacccagcgtcacaacagaca

SEQ ID NO: 727036 - DNA, 157 bp, Homo sapiens
aggtgtgagccatctgtgcctggccttaggcgttatgttctttaaaatagagaagcggtaggattacatattattgtgtggcagaataaagtttttctgttataccataatttgtctcaagtttttggcaattactacttctaattctagctttaac

SEQ ID NO: 727037 - DNA, 371 bp, Homo sapiens
  misc_feature (31)..(31): n is a, c, g, or t
  misc_feature (33)..(33): n is a, c, g, or t
  misc_feature (36)..(37): n is a, c, g, or t
  misc_feature (55)..(56): n is a, c, g, or t
  misc_feature (65)..(65): n is a, c, g, or t
  misc_feature (70)..(72): n is a, c, g, or t
  misc_feature (78)..(78): n is a, c, g, or t
  misc_feature (81)..(81): n is a, c, g, or t
  misc_feature (99)..(99): n is a, c, g, or t
  misc_feature (101)..(101): n is a, c, g, or t
  misc_feature (114)..(114): n is a, c, g, or t
  misc_feature (119)..(120): n is a, c, g, or t
  misc_feature (122)..(123): n is a, c, g, or t
  misc_feature (126)..(126): n is a, c, g, or t
  misc_feature (140)..(140): n is a, c, g, or t
  misc_feature (143)..(144): n is a, c, g, or t
  misc_feature (156)..(156): n is a, c, g, or t
  misc_feature (162)..(162): n is a, c, g, or t
  misc_feature (164)..(164): n is a, c, g, or t
  misc_feature (166)..(166): n is a, c, g, or t
  misc_feature (176)..(176): n is a, c, g, or t
  misc_feature (183)..(184): n is a, c, g, or t
  misc_feature (188)..(188): n is a, c, g, or t
  misc_feature (191)..(191): n is a, c, g, or t
  misc_feature (200)..(200): n is a, c, g, or t
  misc_feature (212)..(212): n is a, c, g, or t
  misc_feature (229)..(229): n is a, c, g, or t
  misc_feature (233)..(233): n is a, c, g, or t
  misc_feature (236)..(236): n is a, c, g, or t
  misc_feature (242)..(242): n is a, c, g, or t
  misc_feature (250)..(250): n is a, c, g, or t
  misc_feature (253)..(253): n is a, c, g, or t
  misc_feature (262)..(263): n is a, c, g, or t
  misc_feature (275)..(275): n is a, c, g, or t
  misc_feature (289)..(289): n is a, c, g, or t
  misc_feature (291)..(291): n is a, c, g, or t
  misc_feature (302)..(302): n is a, c, g, or t
  misc_feature (305)..(305): n is a, c, g, or t
  misc_feature (309)..(310): n is a, c, g, or t
  misc_feature (319)..(319): n is a, c, g, or t
  misc_feature (326)..(326): n is a, c, g, or t
gttgtaaaatagtacagtattcgttatggcncntanngtgttagtccgtatggtnnacagccctnagtannnggtttngcnggaaaatcacaagattcncnccatcctcggtantagannannacnagtcattgtcacanttnnctttagctcttntacagngntnatgtaagctntcatgcnntctnccngagagtccnttccagctcgtnccaggcatatcacttgncctngcncgtgangtccaacntcngggtccganntgtacctatgtngccagcagttgctngnttgtagtggtnatncttnnacagcatcntgtcatnccatgtctcggtcaaagtgtgcctaactcactctcaagctttctc

SEQ ID NO: 727038 - DNA, 424 bp, Homo sapiens
ataatagtgcacactgtatagatggcgcgtggctgcattcctctgtgtcccaagaactatctctccccaattgggctgtcccacccctcggctggtcacagtatccgggcagtgctgcgaggagtgggtctgtgacgaggatagtatcaaggaccccatggaggaccaggacggactacttggcaaggagctgggatacgatgcctccgaggtggagttgacgagaaacaatgaattgcttgcaggttggacaaggcagctcactgaagcggctccctgtttatggaataggcgcctcgaatcctatacaaccctttacaaggccagatatgtattagtttcacacaacttcatggtcccagtgctcacagacctgtggacctggtatctccccacgagtcaccaatgacaatcctgagtgccg

SEQ ID NO: 727039 - DNA, 416 bp, Homo sapiens
  misc_feature (5)..(5): n is a, c, g, or t
  misc_feature (77)..(77): n is a, c, g, or t
  misc_feature (89)..(89): n is a, c, g, or t
  misc_feature (145)..(145): n is a, c, g, or t
  misc_feature (260)..(260): n is a, c, g, or t
  misc_feature (286)..(286): n is a, c, g, or t
  misc_feature (347)..(347): n is a, c, g, or t
caaangaaaaagaagattaatttcgggtttaaaagtatatgtgggaaaggagagctgttcaagagttaaagaccttnaaaaattatagncttaaatgcatgtcctgcaaattatattagaactttattagggctgggcacagtgnctcatgcccagtaatccccaacactttggaaggctgaggcgggcggatcacttgagtcccaggagtttgagatcagcctgagcatcatgatgagacctcatcactacaaaaactnaaaaattacctgagtgtgatggtgancgcctgtggtcccagctactcaggaggctgatgaggcagaattgcttgagcccaggaggtnaaggctgcagtgagccactgtacatgccactgcactccagcttgggcaaaaagaatgagaccctgtgtc

SEQ ID NO: 727040 - DNA, 142 bp, Homo sapiens
acggtagtaacagagttcgtgatgtttaagaacgcattcattctaactgggtgagttcgctgtctgtacatcggcgccctccgatctaggggtgcgcgccccagcttgggacactcgcggcgctcattctaagactacagcg

SEQ ID NO: 727041 - DNA, 447 bp, Homo sapiens
  misc_feature (389)..(389): n is a, c, g, or t
caaattcatgtgttgagtttctaatcctaccacctcagaatgtcaccttatttgaaaataagatcattgcaaaagcaatttctagttatgatgaggtcatagtggagtaaagtgggcccctaaaccaatatgactgatgtccttatgaaaaggagatatttggacatagacatatacacagggacaaggctgtgtgaacctgatggttgatattgagtgtcaacttgattgaattgaaggatgcacagtattgttcctgtgtgtatctgtaagggtgttgccagaggagattcacatttgagtcagtgggctggggagatgcagacccaccctcaatctgggtggggcaccattcttaattcagcttgccagcattaaaaggcagggcntgggaaaggaggcaggactttgcttggaggtctttcccaggcccacccttctttttct

SEQ ID NO: 727042 - DNA, 287 bp, Homo sapiens
  misc_feature (21)..(21): n is a, c, g, or t
  misc_feature (41)..(41): n is a, c, g, or t
  misc_feature (107)..(107): n is a, c, g, or t
  misc_feature (151)..(151): n is a, c, g, or t
  misc_feature (153)..(153): n is a, c, g, or t
  misc_feature (176)..(176): n is a, c, g, or t
  misc_feature (283)..(284): n is a, c, g, or t
atgtgtccagtattttaccantggcctagatgtacaaaccnttataccagaagccacaacccctatccatttttaaataaaaaccagggaaatggtttaacaaaccnagggttggtttgccccaagtcattgccttttaaaaatggtttcncnatacataatatatatggaagtgncctaagaaataatagaaacatctttcagaagaatgtagtttgatatttatttagtataaaacgtttgtgcacagtgttaacaaatacaatttttacaaatcaatttnnaaa

SEQ ID NO: 727043 - DNA, 204 bp, Homo sapiens
gtcgaccagcaatatcccagactccttggagtcttgttcctgccaccaggtttctgcctgaggagcctacccagtttataataatgtgtcatgagctcagagcccaaacttttttttactttctgttctctgtgaatgcgcatatgaacacaatcaacaagcctttcaaaagatccacagccacacttctcttgtcgacgcggc

SEQ ID NO: 727044 - DNA, 557 bp, Homo sapiens
gtcctgttcccaccttacctgaaggcattacagtggcatacacagtcccaaagaagacggaggattcggcttctgaagtaacagtggaagactccggcgaaagcttggaagatcttatggccaggatgaagaatatgtagacagtggctggcttctgtcttattttctctgcttatgctagtcccttggaattgaacaatcggaactaataaaacttagcgccgccttagttggcatgtgtatcttcacggagttgttatgctgtgtggaactctagtggtttcctcctgcttccgtatacaacctaatcagtaccacagcgacagaaagagaaggggtggaccatcccatccgtgtctgtgcgtacggctctggacgataaatagcacaaattgaggatggactgactgtgtggcctggtggctgtggctgacaggtgtctgagtgaatggcttcctactggacagttactcactactactctgaccaggagtgactttaaacagcctatagaataaaaacatcaatgtaaatgagctaaatacctaataaaaaat

SEQ ID NO: 727045 - DNA, 320 bp, Homo sapiens
caggaagtcccttgccatcctaaaagcccccccccttttttttaaggagaatggcccagtcctttcccaagtccccccagggggggggatagcattgctttcgtgtaaattatgtaatgcaaaatttttttaattttccccctaaaacttttttattttttttttttttgaatgatgagccttcgggcccccccttcccccttttttgtcccccccctttagaggtatgaaggcttttggtctccctgggggtgggtgggggcacccagggcttccctgtcccctgacttgagcccagttgaataaaagggcccccctta

SEQ ID NO: 727046 - DNA, 757 bp, Homo sapiens
agcggaggagtctggaggagatgcacttcgacaggggaatctggtcggcagccctgacctggagacctgggccgagtgacagcatttaagccagaaggccgcgaccccagtcagcccgagtcggccggctacaatgcgctgcactatgccaggcgaatggggacctacgcatgtggtggccgctatgctgcgttgaaaagcgggagactcaaatgttgagtggccagaaaccacggggggtgccactggtctggcgaccgaagccagggtacatgcggggcacacagaaattcgcggcggggccctgagtatcacactgtggtccacaccccaaagggtgggtgggatgacgacagggctgagccacggctggcgataaagctgactgagaagaggggtccacccaggggacatctagcgcgcatcctcccggggaacacagaccagagtctgaaagaggggactaccggggagacggaaaaggcagcggggtagacactgtgacactgcgggccttgccaaaaaagtgagacctgacgggagactgctatacccaagactgaggaccgtgcagcctatttcgcagcgtgccttttacaagggtgacgacaggacacacggttcctccaaagcccctgtgctttggtgccagcatttcatgctgctgggcccaaggaaccgtggaggggcaagaacataccagggaagaagccccaagtcttggtcacctgggggaaagccaggggagtatcccttt

SEQ ID NO: 727047 - DNA, 107 bp, Homo sapiens
cctcggcctggtgggcgctcgacgcttgcattggtctatcaaaaacatcaaactcagtgggtcagaacataaggtcgagcgcgccgacgccgtcgagcgcgccgacg

SEQ ID NO: 727048 - DNA, 126 bp, Homo sapiens
ggtgaagttcagtgctgaatcgcaacactcgccagtttggaaaaaaacatcttttcggccagggatgaggagacatgttggaactcagaccagacctggagatctccgagggacccgacagccgaa

SEQ ID NO: 727049 - DNA, 831 bp, Homo sapiens
cccgtcttatagagggtcttccttatggagaccgatggtggaccagaggggtcttgtaacggggtggtgccagtgttgaaaagtcgtaaaagagggtgaaaaccagattttggggactatacgtttgttggcccaccccaagtaaatttgttatagcagcatgcgcccgagacgctccttctcccggggtgttgaagccaatgacacacggggggttttcgacacattggcacctacgcccacggtgtttttccggcaattcccccgcacttaaggcccaatagacgagtttggcccgaaaaagtctcctcgtctagcgggagaaccccttttgagggcccgaaacagcttggtagcactttcctctaatacccccagggtatagacgcaagtgttttttgagtcctcctaatacgggaagaaggtctttctgcatcacacgggaccacccagtgcgtcagtgcagcccgtgtctcgtccttaggcgagccggcggtgctatgccccccctagcccgtgtccacacaagagggtctctcccaattgggccgccggaatccccgtgtcgcttccacgcccgggcatcttgcccggcaatcttcaagagaccccatcttcgaacaactccctgaaggtgcgcaaaaggggtgttgagaagagttttattgtaaacaccccccatgaccttgtgtatggcgcaaacccgggcgtatattaagaaggactactaatctaagaataagcggtgtttggaagaagagtcgacaccttcgcaagatgattactacctcccgtaggaacaggagaaaaaattggtgtattttttatata

SEQ ID NO: 727050 - DNA, 154 bp, Homo sapiens
  misc_feature (40)..(41): n is a, c, g, or t
  misc_feature (154)..(154): n is a, c, g, or t
cacaccctctggagctctgccgacgaggacttctctctcnnataaggtccacgtcgctacgagccatcactacaggaccgcgctctgcggcccacaatctccggggagcctgcatcaagatggaggtgagaatcaaggccttggttcactcttn

SEQ ID NO: 727051 - DNA, 407 bp, Homo sapiens
  misc_feature (55)..(56): n is a, c, g, or t
ggcccggggtccctttccagggggggggaggtgttcaaaacaaagcccccccccnntttttccctttttcacaagggccccacccccttgggggggtttttcccctttggggaagggccccaaacttttttctttttaaaaggttgttgggggggaccccaaaaaggggggttccccccccccaagtcctttttggggcaaaaaaaaggggggggtttgggaaaaatttcccttttttttttttccccccccccccggtttggcccgggccccttcccccccctgggggggaaaaaagcttttttggggccccttaaaaaaacccccttttccaaggaaaagggggttttttccccgggcccattttttcggtggggggggttccctaaaaagtttttttcccctta

SEQ ID NO: 727052 - DNA, 889 bp, Homo sapiens
catggtggctcatgcctgtaatcccaacacttgggaggccgaggcaggcagatcatgaggttaggagatcgagactgtcctggctaacacgatgaagccctgtctctactaaaaatgcaaaaattggccgggcgtggtggcgggcgctgtggtcccagctacttgggaggctgaggcaacaagaatcgctgtgaaacctggaggcggaggtaagcagtgagccgaggtcgcgctacagcactccagcctgggctacaaagctagactccatctcaaaagaaaccgaaaaagaaaagtcaaaagaccattctggagtcctctgatgaaaatgagatctatgtcgtgggtatgaaaatgacccatcattcacatgtgtttcctaggcagagtcactgctttgagtgctattggtatcatggtagcgtttgacagccaacaggaatttccttcttagtattcacattgagaaactgtgattaaccatcattctgtggcctaaaaggcaaatcagcagctagaacagttttaaaagggaccatggcagcactctcaagttctgtagcccttttgttgtttgtttactctaatgaggtcctgtgaaaatagccagtgtttgcatagataaatacgcattgtgggcgggcgcggtgctcacgcctgtatcccagcactgtggaggactccaccctggtggatgaagcgagacctcgtccaaaaaaaaaagaaaacaaaaaatgttgggggggcccgcctcaagagttttaacacactcgtggggccgggccaatggaagaacggcccctggccaggactcgggcggacgtgggttcccaaaaaacgcggggccgggtgcacacagggcgggctcgcaagggtagcacacacaccg

SEQ ID NO: 727053 - DNA, 424 bp, Homo sapiens
  misc_feature (281)..(281): n is a, c, g, or t
  misc_feature (399)..(399): n is a, c, g, or t
caaagagaactcgcttctctttaaagtcacggacattgatttttttccctctgactaatcttgagctcagcactagccagtattctcagaagtggctcctaccctttctgttgttctgtgtttgtctctgctcggtgacacccttccctggagagcccagtcctccgtgtattacaccagtgttaactgacatagcatagaccttcttcacacttcagattcatagcagcgatgggatcccttcctttgaagtgaacaagtccttgtagataggtcacccngtcaaaagtgtttgattatctacctttcaatcaacatgagattgcctcttaccattttcaacgattgttgacaggggtcctttgtttgaaaataactggggagagatacgggatttcnaatttgaataagattaaatatattt

SEQ ID NO: 727054 - DNA, 279 bp, Homo sapiens
  misc_feature (26)..(26): n is a, c, g, or t
  misc_feature (243)..(243): n is a, c, g, or t
  misc_feature (245)..(245): n is a, c, g, or t
cgacacttttcaggaacaacaagcanttattcctactttccaagttattttgatgccatggtggctcatacctataatctgagtactttgggaggctgaggtggactgatcacttgagcccaggagtttgagaccagcctgggcaacatagcaagactccatctctacaaaaaaagacaaaatttagctgagcgtggtggcgtgttcctatagtcccagctacttgggaggctgaagtgagtngntcccctgagcccagagaggtcaaggttgtggtgg

SEQ ID NO: 727055 - DNA, 131 bp, Homo sapiens
tgctatcactctattcttactctaaagaagactcaagtacaacgcagaaaataagcggctgaggaggaccgggagtcagtgtggaaagcgagcagcacatgcaatgttgctgtcatgcccctagccggtct

SEQ ID NO: 727056 - DNA, 521 bp, Homo sapiens
  misc_feature (2)..(2): n is a, c, g, or t
gncgacgtactattttcgtttttagaggtgagactgtatgtagttcatggttactgttatgacagcgagagatgtccatctgttggacagcactattctagagaactaaactggcttaacgagtcacagcctcagctgtctgggatcgacccttgtctccctgggtaggggggggggaatgggggagggctgatgaggcccagctgcggttttagtcttgggaccctccctctcctgagaggggaggcctggtggcttagcatgggcaggtcgtgtctcctcctgacccagtggttgcggtgaggggaaacaccctcccttgacgtcaccagtgggccattagctcccgttaccactgcaacccagggttccagctggctggttccttcttctgcccccagttgccttacccttgggttgttgttggagtgagcacctcctctgtagggcacctctcacactgttgtctgttactgattttttttgataaaaagataataaaaactggtaatttctaaaaa

SEQ ID NO: 727057 - DNA, 190 bp, Homo sapiens
acacattaacattggggtctgagatactgcgtttactgtctctacaggatgctattcggctatggctccgcctacataggtctattgggttctctgtctcctgcagacctttgttaatttttgtcccaaaatctgaataaacatcttgcaaagcattgagttataatagtttactgttaggtctacctgg

SEQ ID NO: 727058 - DNA, 241 bp, Homo sapiens
gttcattgatctagcaggatccccttgcatgttcggggtacgccggcacgtgttgaagagacgagtgcgcgcgcgggacgagagacgatcacgagaacgggcatcgccaattgcccggggtccttcactttgcagtcatcatctgtacaacctcttcataattgacctggccttctccatcgatgtcagcctccctgatcatctcatccacctcctcatgggtcagcttctcccccaggtt

SEQ ID NO: 727059 - DNA, 585 bp, Homo sapiens
aaccggattgtaatccttggactcaataccattccattgtttgtgcagttgctttattctcccattgaaaatatccaaagagtagctgcaggggtcctctgtgaacttgctcaggacaattaggctgcagaggccattgaagctgagggagccacagctcccctgacagagttactccactccaggaatgaaggcgtggcaacatacgcagctgctgtcctattccgaatgtctgaggacaagccacaggattacaagaagcggctttcagtcgagctgaccagttccctcttcaggacagagccaatggcttggaatgagactgcagatcttggactggacattggtgcccagggagaagcccttggatatcgccaggatgatcccagctaccgttcttttcactctggtggatacggccaggatgccttggggatggaccctatgatggagcatgagatgggtggccaccaccctggtgctgactatccagttgatgggctgcctgatctgggacacgcccaggacctcatggatgggctgcccccaggtgatagcaatcagctggcctggtttgatactgaa

SEQ ID NO: 727060 - DNA, 1003 bp, Homo sapiens
  misc_feature (7)..(7): n is a, c, g, or t
ccccaanaaaactaacggggctaggtacgaggccggggttgaatcacatctccacttcacataacgcgtgcttacgctaatgccggtggtcttgctgacggcgagttccgcagcgtccgattggctgagggcaactccagcgcagtggagaactgcgttcttccagaatctgcgcgtgcgcttcaaactgtgagagattgactttgcatggcaagtgccataatgtagagagtttctctgaagtctaacagagaaccgttttttcagtgcgcgatcttagactggtaacattagcctctttattgaaggagcctgagatgacgtaacgcaggccgtaagactggctcgacgacgttcccggtgatgacatcgaagacgaagacgatgaaatatatctgggtcagtaagaagtgaaattaaaggtgatgccgaggagctaaaacgccttggagcggacatggtgatctggggaagaacgcgctggataaagatcccgttagatgcggatctgcgcgcggctatggagctcgcccagggtattaagatggaaggtcgccgtcgcagttgcagctcatcggtgaagatgctgcgccagcgcgagtagagcctattcgtcaggcgctggataagctgaaaaacgtcagaacagcaggtggggctgtccatagactgggaatagctgcgcgatcgtctgatcgatcaaggtgatgacgccctcgcgtgagggttttaaatctcgtgggccgatgccgatagtcaggcacgtggcgtaatcatgatccgcaagcgaagcaagggagagaacgggcataagcggggcaatcggaaggcagaatttccaggatctgggcgagtttgcgggaccgagggtaaatccgccgcgagagagaaagcgggcggaagggggccacttggggggaaaaccacccaccggggtaaggcccacgttcatgcggggggggggaaccacagcgcgccaccatatttggtggcaaaataggcc

SEQ ID NO: 727061 - DNA, 1149 bp, Homo sapiens
ggtgtggcagccgtgcggtgctccgagtgacctgtgagcgcaaagcctcagtgcccctggctccctcctgagctgctgccgtgccaggcctgccctgccggtgatgcagttgtggcctgtgtggcctggctggtgtggctgtgggcctgctgctgctcctgtgcttgtctgcagctgtgtgcatgacccagtgtcagtcttggctcttggctagggtaccagcagaagctatcgtcttaccatgactgcgacagacgatacgctgcaagttgagccgctggccagtaccgctggagcttggaaccacagacgcttggcctatctctctgtcttgactcagttggacgcctagctggcaggcatagcaccccagggcccactgttgctagaccccgaccagacggacgcatgacagatgggagtgtaacgtagcaatgccgtggttgtgctgtgacttgggctgcacatgtggcacttacttgccaacgcacatcgactatgtcacgaagatattgtagctatggcatcattcgagacacacacgaacctatggggactacccgacagggccaaactcgaggggacgacctaacctggggctagaaagatactccggaatacccattcactactccttgagacaaccctatacccaacacagaggactgagacacacagcaagcggcggacaaccccacgacaaaaacaaccagccttgacaggcgatcctataccataaacccccaaggcgggcggcacggaacccacggcaacagtaaacccaaccggacagccccattgcacactgacaccggccacaccaacgaccaatggatgacgacacgattggcgaggcgggaccaaacacacaacaaatatgcgaaacttgaggcatgggaacagacaaccagagagccccagtagaagacacgaatacaaaattcacccgcaaattacccacaacaaccacttggagacccaattaatgcgcagcccatgggggcacacgaacacacaagtggaacctgatcccaagccaaccccccaagatgaaacacttatcgccattacaacacacacctaacatcatccattaactaaccctaccatcatcggcaataccataaaattgtccatccgcgaagagac

SEQ ID NO: 727062 - DNA, 213 bp, Homo sapiens
cgggactctgcatgactgggagcaagtcactttaacctctctgttgctcggatttccccttttaaaaagttggggcaaatgaatccttgtgtggtaagaactgtttactacggagtgctgagtaagggcaaaataatacccctttctctatgtatctctgtatgcacacgcactatatatatatatatatatatatatacattcatgtaatca

SEQ ID NO: 727063 - DNA, 762 bp, Homo sapiens
tatagtggccaccattgtctccaggaaggccctcccttgaagttccttcatggatgatgttccgcccccaccatgcacccctgttcccccccttttattcggcccccctttttagagccttcgaccctgcgacacaattttgtttccacccggtggggtttttgacaacagaaggcgtaaaacagaaataggatttcttttcttccccccccccgcatatataacctctcttgttttataatgtacccacggcctaagaccacgcccacctcggcgcttgtggtgcgcggaaatagggccgcgataactgattgaggtgccccccttctcttgcagagatacaacaggatatattgtcacgcacactatattcaccgtgaacacaaaagtttatacccgcccgattctgtcttgtctaccaccacggctgtcatgacaaatgtcctctgatacattatacattcacatctctacgcattatgtccccacacacatgtgctgggtcctcctctaccccacaccactttaatatatgtggcctgaacaccttcttctctcccaatataagatgttttagctagcagttttcggatagttatctcatagatgaccctttcctcgtatctcgcggcgagatttccatatgataacatctgatctactgatgtctaatatctccaaaacaccaggattcttcttctacgcacctatatcggggaaccaaaaatatggattccccacagtcccaacaatagtcacaac

SEQ ID NO: 727064 - DNA, 473 bp, Homo sapiens
ttgtagagacgaaagtgttattttgattcctagccgcagtaattcacacgccgttgcctctaccatgctctggtgtgatacggcccaactctgatttgacatgggagggaactacataagtgggtggaaacaggaggtaaagatgactgggggccatcttggaggccagctactatgcccagcatccccacccagaccttgggcagagcgaggcctgggagtggggacggtggggggaaggagttggacggggcctttctgatggcaagggaagggtcaggggctggttgcctggccgaaggttctctgacccaaacctagagccttgccatggacatcacagctccaggtaagttccagaagcccagaagctgatacctccagattagatatcctgcatggcagaaagaggagcaccgtgcttctggctactgcccccttggtaggcgggacactggggtgtgcagcaagaa

SEQ ID NO: 727065 - DNA, 120 bp, Homo sapiens
  misc_feature (4)..(4): n is a, c, g, or t
ttgnttcctctacgacatcttcttcgtgttcatcacgccctttcctgaccaagagtgggagcagcatcatggtggaggtggccacttggccctcggacttcaagccacccggtgaggaag

SEQ ID NO: 727066 - DNA, 128 bp, Homo sapiens
cgccaagcctactcttgagcgcttgcttgagcgcacgaacctacaatctaatcacgtccacgcaacgcctgtggatgtggaacgtagcaactaacaacagtcacttccgatcggaagtcgtgcatgtt

SEQ ID NO: 727067 - DNA, 171 bp, Homo sapiens
tccccgacttttcacggtgctggcgtgttgagcttgaacgctttcttaattggtggctgcttataggcctactatgggtgttaaattattttactctactctacaaggtatatttcactagctgtccacaagagctgttccctctttgcgactaacagattaaattttaca

SEQ ID NO: 727068 - DNA, 1550 bp, Homo sapiens
  misc_feature (173)..(173): n is a, c, g, or t
  misc_feature (378)..(378): n is a, c, g, or t
  misc_feature (387)..(387): n is a, c, g, or t
  misc_feature (1063)..(1063): n is a, c, g, or t
  misc_feature (1193)..(1193): n is a, c, g, or t
agattagccgccgctaatatgattaataacacacctcattcagctgaacttacccactcaccatctaataattgtctcgctatgcaatgaatctatcgagggtcacatcataatggcgacctgcccgtgatacctaggctagaccttccatccacagggtaatgatcctaagncgcttggcatctcacgtcactcagaatcgcactcaatccgttcagttatgcatctagatccgtgtcctgcaacttcacttatcgacgcagcaggtaaatatttcgatcgcgcactcgaatgtcagctcgcccggataaccaatgaccacgcgttagagaatgagcagaccgtaaagacctagtgtctcaattgatatctaaaggnctcgatctngtttcaacatagcgagctattctagtgaacgatccgagctccatagtctactataacacggaatataccaaatgtatcgtgtcttataaatcaaagaatgatccttatgaacatcaaatctgcgtctagttaagtccgccgtgcgcgtgaactatcgcgaaagcaatatgcaaatcaaggccgatatcagtatgtgcataattgtgttcctatactcccggatggaagggggcaccacacaaatggaatacatgtgactcgaaagcggagaagccgtagcattcgtagaatgtagcatcataacctataatcgcaacttccatggcgaccatccctccagtaacatactcggtgccgaatcatatgaagcggcttaaagttagtaacacacttcggacaaattcgtaggaaagagaatgtggcttaaccatacacgtgtggacgaaccaaacgatagcgcacaaaattcggccgcatttcgagcaaatctgtaatttatggcattgttgtaaagcgcctttggttctacttcatacaacttcctttgggccctcatttctaattataattgttgccgaagcccccgtcatgcgatggcaacattctcgcgagctcatacacatcatttttcttttgggacgagccttgaaatggtcgttgcaatacatgtatgcanagcgcgcacttaaggtaagtactaagccttgccacagtgtcgcggaaatagtaactccaaccccgtttccgaagcccatctaacttacccaccaagcgtgcgagagaaggaagcggctccttcagaggantataacctatagtacgtttgcgcgtcgttcctccttttttagaatggaaaccgattttacgctaattgtcttcacccagaagcctccctaaaagcgaaccccaggataaattattaaccctttaggccgagcccccctttataaaaaaccccttccccccagattagaggcccgaaaatgataataatgcgaatatcggcgtaaaacagaaggctctgaatcggtccgctaaaaaaatagagagagggtgctggagcccaaaatataaatacacctgctactagaaaatatacccctcgccgatatttctataaaaagtatatatttgcccgagacacattatttggcaatatcgaa

SEQ ID NO: 727069 - DNA, 978 bp, Homo sapiens
tgccccctgcggggtggcgccggtagctcttccggcggggcgggattccctgtggcttacgacctggaggaggtgtttatctcgcgcccgctcagcccttttcggacctatatgtcccggccctctgttgcgaagcctttcgggacggtctggcccctcgagcaccagctcttctgaggccctctggccccttttctggcgttcccggaggccccagtgctggccccccaacaggtggcaacccctgcccaatcccatgcttgtggccctggcgccccctgagcacgcctgagcctccgggccacaggttcgttctcagggaccaaacctgaggcagcccctttggatgccctctacagcccttgcgttctctcagcctaggttccccaatttggggacttcaggaccccagaggcccctatgggcttccctctgggaaagccccttagccccgggtgggtcccgccacggaccacgctaagggaaacacgcttggttccctagccactgttccgaatatgcccactcaattccgaggtcattcaatctcttgttttgctgcccttcctggccacaccacaggtggaaagaaaagtttcccaagctataggtcttggcccccttggggaatttcacaccacgtggggcacgcgaagggtgcctgaatttcgcgggaagtcctgaacccgagccctgttgtcacagagttgtggaaggggcttctgagccacgtgtttgggcacggcccgggtttcccactcccgaaggccacgcgttcctgtgcacgagccccactccacctggttctttgccctgaggccacacaataatgtctgtgccacatgggctgaagtgccaccgacacggcccctgtgacacagctgctgcccacacgcacatgtggaagctaggtgggactcattcctaattctgcccttgtaatgagacttgatccccccccccgccacttttttgcca

SEQ ID NO: 727070 - DNA, 447 bp, Homo sapiens
ctacaattctcagatcttacagcagttgatgggtggggtgggcaagacaatcttcccgtgaccacagactgaccaaattcctgcttcatctttgctgagcttaaggaattgttgtgagagagagctggacacaggcatgacacggtttcctaacagcctgcagaggctattaggcatcagtttggcacagagaactacatgcatggcatatctacatatttttctgcgtatctttaaactatcactccaggaagacatgaaggattgctacttagcataagcatttcccctgtgcagtgactgcctgcctcagaatctacctgtgcctacgatcttaagcccagttaatacacacacccatgccccagtatgggacggctcctttgtccgagcagcagggaaagacatgtctttccctgctgctctggtcacagtactagatgggac

SEQ ID NO: 727071 - DNA, 187 bp, Homo sapiens
ttgggcgccaccgttaaaacactccgggattttttttttgtacctctttggctattgcccttgtgtttcccgcccgccccctgtgtgcccccccctgtccatccagatgggtgtttattaaatcccccccttttaaaataaattttttggaattccatgggtaaataaatgctgctttggggatata

SEQ ID NO: 727072 - DNA, 433 bp, Homo sapiens
aggctctggatgcacattgctaagttctcactcccgtatttttttaaaccaaaaatgaccaccacagggtcacccaaacaacaaaacactcacagcttctgttgagctgatggttggaaaataagcagcaagaaagagacaagattagggtcttgggctttttagagtcaaactcatgccttgttccagaacacaaggcagacagtcaagtcagcaaatattcacggagcatctcctcttcctggggcgaggagctggacccggcctctgtccggaaggggcatttcctgcctcagcacaggcgctacagctttgctctcagtcccctaagtaaaggagctgctcagccttgactagcctacaacagccagggctttccggtagattctggcactttctatgccccaccccttgtggtttcttagggctgctg

SEQ ID NO: 727073 - DNA, 1018 bp, Homo sapiens
ggtggtggcggcgcgatcggccgggctgtaaccgtcgtctgtccgggagcgggtggtagcggctagtcggcggccggggacggggcagaggtgacgccacaggtacagcggccggaagcggaggaccagcgggcggcagcaggagacgcagcggcagggcccggagtcagcaagcaagcaaagagggactcgctggaagatgcggcagatcgcacgacccgtcggaacggggactccgggaccggagatatcagcgtcgccgaggactggcggggggaggtcgccgcccgccgtcgtgacatccggataccggacctgcacgaagccggccgccgagggatgaacacgccggacagtcgaggggggcatttctttaggatacacacagacaagtggattgcgaaggttaaagtgatggccatatgtctccactagtttgcacgaagaggtggttttaagagcggaggcgaggttcagttagtgtgggtgagcttcaattatgaaatgggggcagaattacttgaagttggttgaaggggggaggagctttgatggggaaaagggatacgagagaagaacatggaatttgatccgccgtgggagaaaagtgatggaggattcggggagggtccctaattgtggccaagggaatgttaccactgggacctttggaatcatgaacttccctgggatcaatacggatgaatctgggctcctcaaataaatactagttagggcgttgtcatgaagacagctgtgtaacatgctacatgacattacttcgtcacaaataggaatccttcgcaggaggaattaatacgggtagtgcattacagaagtggtggaaaggtgtgaccacaacgagtcttaacagtatggttgggcactgtaaggtgtcactacatgtggtagtcaaagagggtcggatatgggtttccgaggaattgtgcgagtagggaattctttgcaggtagaaacgggaaggaagtacagctggaggaatatatggggagtaatg

SEQ ID NO: 727074 - DNA, 157 bp, Homo sapiens
  misc_feature (5)..(5): n is a, c, g, or t
ccggntgagctcaaatgattgataaggtcaagcaagtcacatgatcataggacacggggcccttcccttataggtagccgaaacagagagggaaggcagcatacgtcagcgttttcttctacgcacttatcggaaagatcaaagacaggccgggcgc

SEQ ID NO: 727075 - DNA, 125 bp, Homo sapiens
actagaatctgactcgcattctgttagacaagcttcttacttctgatatgacatgatgtatggtattctgcaatacggattttatccacaggatcatggtcatcaaaagtaacaaagcaaagctc

SEQ ID NO: 727076 - DNA, 460 bp, Homo sapiens
  misc_feature (353)..(353): n is a, c, g, or t
  misc_feature (360)..(360): n is a, c, g, or t
gccgtgaccgggcattgcgagcctattgctccgtgcactcgtggcctgtgcctgctttagtggtgtttaccctgtcttagaaagcgttgtagtcaaatcagtgggcctatcgtttgaaaccaaaatcaaggagactgccagagaccagcaggggatctaagggatttaccactgggttagcacagacactacacttgaagatttcctagcggctgctgctgctgtttccatgataagaattcagtgagacaaagaacctgccaagctcattaaccgagtagcaggaagagctactgtgtagcctctggtgttccccaactgactcagccctgcagatgggacatcctgtaggncatgtgnatatcacacgtactgatgcggatgttctcagacaagcctagcatacgccaccagtcagaaaggctgtcaaaatattataccttctgtccgctaacaacat

SEQ ID NO: 727077 - DNA, 357 bp, Homo sapiens
gtccatgaaagattgtaattttgaagaaggaaagtgtttttcaccacacatagtctgggcgatctaggccaggcacaatgctcacatctgtaatcctagcactttgggaggccgaggtgggtggatcgcttgagcccaagagtttgagaccagcctgggcaacatggtgaaaccccgtctctgaaaaaagaaatacaaaataatttgcccggtgtggtggccacatacgtgtagtcccagctactcaggaagctgaggtgggaggatctcttgagcccaggaagccgaagccacagtgagctgtgattgcaccactgcactccagtctgggtgacaagagtgagaccccatctcaaa

SEQ ID NO: 727078 - DNA, 139 bp, Homo sapiens
  misc_feature (53)..(53): n is a, c, g, or t
tggtgagtttcagttcttccatacatttcttttttttttctgggacggagctntgctctgtcacccaggccagaggttgtggtgagccaagatcacgccaccctactgcagactgggcaacagagcaagactccatctc

SEQ ID NO: 727079 - DNA, 181 bp, Homo sapiens
  misc_feature (74)..(74): n is a, c, g, or t
  misc_feature (132)..(132): n is a, c, g, or t
gcatgtgccattctatactgtcattccaaattctcatggactacttgcctgcttgctgaaaactgctttgaaanctgcactgaaagctgcactctgctctgtcatctttcatttctgtaacatgatcctcancgatgtaacattcacccaacataaagtattacagttcaagaaagaaaaa

SEQ ID NO: 727080 - DNA, 331 bp, Homo sapiens
aaaagcaaagcaaggccagagacaaccccgaacggaacgccagctgcctggcagattcacaggacaatggaaaatctgtaaatgagcccctgaccttgaatatcccctggagcagaacgcctccttgcagaacagcaatgcagacagacccaggagcccaggaaatgaggtaagagatggcagatcatgaggaatgctggtctgggaaagatgcatcagaggtcattgctgcaaagacttgacagggttacgagggtgtcatgttaaaaaaaataataataacttttggttgcccgtgctaaaaaaataaataaataaaaactccataatt

SEQ ID NO: 727081 - DNA, 675 bp, Homo sapiens
  misc_feature (306)..(306): n is a, c, g, or t
  misc_feature (340)..(340): n is a, c, g, or t
  misc_feature (381)..(381): n is a, c, g, or t
aaccaggtgtatcaacgcaagttgccattacggacgggattatcgatcatgttcgtactaggtaggatagaaaatcatggtagtgaattatgtcttgctgtacgcctttctttcttacaaggaagagatgattcgtctagatatcatgtggtctagatagttgttcgagagtgtctctacagatatctatacataacgtgtataccctaaaattgatgttttaaggttgatgaaatcagtaatttttgatatttccccagttctttttaatggggtcaataatggacattctagtttaaggtggtngatggatttagccatatatgctgctaaagaaatngtctaccttttcttcctcacctgttccatttatgtaaagtngagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagttgaattccatatgtccctgagttatttttatcataaagccacaaatgtattataacagggcaaattgtaatatatataaatcctgaaatcatgac

SEQ ID NO: 727082 - DNA, 255 bp, Homo sapiens
  misc_feature (217)..(217): n is a, c, g, or t
ccaaattctcatgcctcaggctccccagtagctgggattacagccacacaccaccatgcccagctaattttttgtagagacggggttttgtcatgttgcccaggctggtcttgaactcctaagctcaggcaatctgcccgccctcaacctcccaaagtgctaggattacaggcgtgagccaccacacctggcctatagtaggcattttaaatgactntcctacctttgcctttcaaaggatttgaattggcactg

SEQ ID NO: 727083 - DNA, 412 bp, Homo sapiens
cacgatctaggatagcagatactagatgtgagatatagtgtagacggatgtatggtgatattgcagggtgcgctcattaggtgctgagtaggtgctgcgtaatgtagcgggtagcgtacgccaaggctattggttgaatgagtaggctgatgtttcgataataactagtatggggataaggggtgtaggtgtgcctttgtggtacgaaagtgggctagggcatttttaatcttagagcgaaagcctataatcactgcgcccgctcataaggggatggtcatggctaaggtttatagatagttgggtggttggtgtaaatgagtgaggcaggagtccgaggaggttagttgtggcaataaaatgattaaggatactagtataagagatcaggtctcgtccgctgtgtattccg

SEQ ID NO: 727084 - DNA, 236 bp, Homo sapiens
gactatttggagtcgtccgcacggtgctcacgtgtcgacggacacttgtcccgggcggcctgccccgcagtggtcactacacgtcgaccaggctccagctgagcgatctccggaggtcagcacggtgctcacgtgtcgacggaacttgtccacgggacggcatgccccgccgtggtgacctaccaatgtcgaccctgcctgcctgtcgtgccgctgctccgggtaacctggaggac

SEQ ID NO: 727085 - DNA, 187 bp, Homo sapiens
gtgcgatgcgatgcactgtaggcagtcccctgcgtataaggcccacgctgaatatcatcttgtacctgtatggagaagacaccagaccctgggacaggaggacagcggaatcgtgccactgcttcacaaaggcaaaagctctgatgcttctatgcttcttgctgctacgtgctgcttgctgcaaggt

SEQ ID NO: 727086 - DNA, 369 bp, Homo sapiens
tgttagtacctccgctatgcacctcacgtgctcggtccccagcgtcttcccatttgttctctggtgattctgcggtaaggcacctggtacattgcttggcctgtgcttggctctatgtgactcttaacagctaatgatgatcatgcatcaccacagcaggtccttcaaagtgcgcgtgtgggtaccccagctccctaatgtaggctcaaggccccacgaggagctggctgtgtgggcatgaccatcgtctgtgctcagcggtcggtttggcctcccccggttggcgcggtgtgacgggtgctttgcggcgtaagcccggtcacagcggtgggggtatccgtcaggttcagcttgtatactgcttcaatc

SEQ ID NO: 727087 - DNA, 813 bp, Homo sapiens
ggtttttaaaactgttaaggcaagaagtgtcaaatgcttcagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaaatgttgcatcgggactggcttagtcgatatactcaaatgatgataacccctacatggtgcaaaggctcacgttaagagatggtcacagccagcagtgctaccggtggtgtggccctggctttgccatctggggagaagaaagaattagccagtcattaagcccattgggtacgtcgccctttgctgtgcttgatcccacgggaaaggcttgacaacgacgataaagtcagcatacagcacagatgccacacagagtgcataaggctgtggtcttcgggctggggtgaaactgaacagttcctccttacatctctgaagaggtttaccccccattgcaatcttacgggcactttgtcgcacttccagctgtttgagcatgcttgtggcatactctgcagaagcaacttcatttgaaagtggtcttagattatctggaaatacgtttgagcctatcatttataagggattagtggggtctcagtcttcacgaatagaacttatagaaacaacgtgcggaccacaagggcgttccacatctagctacaggcccactttttagcaagggaaccttagctacaaatgttcctaaatgccctggaacataaaaaaaccaaaagg

SEQ ID NO: 727088 - DNA, 240 bp, Homo sapiens
cacgagggggaatcgcaatccatcaggtaattctagacctcagtgtccacgtccagtcggggagatccaccattaatggcaatcggatatatagatgacgtggaattcataaggtacccaatcaaaactttgagaccgaggcaggagccatgggaaccgtgtccatcacataagggtgcgtcttgttgaaactgaaacatacacatcaacatggcccaaccatagacagccccttagagc

SEQ ID NO: 727089 - DNA, 345 bp, Homo sapiens
gcgtcgacggcatcctagaccaaagaataagtaatgatattttcacttaaaagagtgaacatttcggccgtgctcacgcctgtaatcccagccctttgggaggccgaggtgggctgatcacctgaggtcaggagattgagaccagtctggccaacatagtgaaaccccgtctctactaaaaatacgaaaattagccgggtgtggtggcacgcgcctgtaatcccagctactcaggaggctgaggcaggagaatcgcttgaacccatgaggcagaggttgcagtgagccaagatcgtgccattgcatttcagcctgggcgacagagtgagactccgtcttaaaaaa

SEQ ID NO: 727090 - DNA, 470 bp, Homo sapiens
  misc_feature (230)..(230): n is a, c, g, or t
gcttttggaaaaaatgtttccttaaagggacgggttttcttccttgcaaatcctggtggcagatttgatatcccccctggggcagtattagagaacaagattgtgtttggaacccttcgcctcttgggcccctgaaatgaaaaaaactgtgggcccttaaataatggggtagtttcttcccatgaaatgttctctagggttttaaaataggcggggccttttctatggtnctggcccccgcagggttgatttttaaaatagagttttctccggggtgcttttagtttaagaaaagcccagatggggcaaacctttccttttttgaagagaatccccaaagttggttctttttaaagggccatattgttttattttaaaacggggcccctttgggagaacttttaacagaagccccaatgatggtccctttgaattggttggggtttcaaaaataaagccggggagccata

SEQ ID NO: 727091 - DNA, 135 bp, Homo sapiens
atacaatgcatgaaccaccgcgcctgcttttctacacattttttaaaaaaccaatgacagagaaacatgtagaagatgttaaaaatgctgggctctttatctaaagtcctggtaattattaaacactcagcacca

SEQ ID NO: 727092 - DNA, 752 bp, Homo sapiens
gagaagaaaaaacggctaggtagaggcccgggttaatcggcgagggtccatgcgggaatcaacgggctgtggctgcacaacaagctgagggccacggacgagctgtgggcgccgaccagcatcgcagatcctgactcacggacgcggtcatcgacaacatccgtctctgacattccatggacctctcgtcggcagtgaagctcaagttgctactcgggacgctgcacctcccgcgaccgcacggatggacgagatgaagggcgccctaatggagatcatccagctcgccagcctcgactcgagacccctgggtgctcatggtcgccgacatcttgaagtcctttccggcacacaggctcgcttcaacctggcagctggaggcagcagaatcccaacgttccaggatattttgggagaaccttagcagcacaacaggtgggtgagtgtgcaagcgtctgccatgctgccactggcagtgccagatacttgcaacaaaaaacgccctgacgaaccctcgacgggacaccctcactcccccggtgaagcattttcagttaaagcggaaacccaagagcgccacgcatgcgggcggagactgctgcagaagtccacaggagacagaccagcagttgaagcggagcagccggggtgaccttccacgccaagggcccggggatgctgcggaaaatggacaccacaacccactcaaaggcatccgacgcaggcgccttacaagccccggagcccaggtc

SEQ ID NO: 727093 - DNA, 690 bp, Homo sapiens
gtttgtttttcataagttaatatagttaatccggactaattttgggttccggcaggctcggaacggaatattggggcaacctttgggccacgaataagagagcacctagggcgaaaatactcaaagtcgccagcgaggtaatgtttccagcggcaaaataacttggcagggggcccaaaaatctcgttatagggcacgtgggaatggcgggcacgggttggaggagggctcggggtatatcccttctcagcaaagcgggacaagggcttcgggaacggtatggctgggcggaatattggtacatcttcccgtgggcctcaagaaaaataaaagcgggggtgcttccaatactcccagtcgcgtagccaggtggaggatcccagaaccccaaagcgggtccagtggcgggcaaatatcacagccttggcgctatagagcttcccgcccacgagacctcccaaaggggcatagaagctcgcgtgacagagcggaaacattcgcggccgaagaagaaagaaagaataacaccgagtccccccggggtgagtgggcaacccggaaggagaggctagggagtctcagggtgcctcgaaaggtggctcgctcgggaaaagccctgtggacgcggtggggcctcaaaaaggtggccatggaaagaaagctctagggatttccgcacatcgtggaatt

SEQ ID NO: 727094 - DNA, 220 bp, Homo sapiens
taaaaggaactgtgggctttgggagcttttttgggtttaaaaaggggtggggggaggggatccctcccggggtataaaggcagcccaaggtttcccaaagggtcggggggaaacccttttggaaaacatgggtttttgttgcctttctgtgttgtgaaaataaaaaactgctttgtttgttaaagctttttttcccccataaaaaaataaagggggggta

SEQ ID NO: 727095 - DNA, 219 bp, Homo sapiens
agttcgacggagactctcatgcctcagcctggcaacaagacgaacccgtctctactaaaatcacaaaaaaatagctgggtgtgatggtgggcacctgtggtcccagctgtttgggaggctgaggcatgagaatcacttgaactcaagatgcggaggttgcaatgagctgagatcaagccactgcactccagcctgaaccacagaacaagactccgtctc

SEQ ID NO: 727096 - DNA, 459 bp, Homo sapiens
atggttgactctagtaggatccctactcctccagcgcttccggaagcaggcggaggagatcggtgagaagctgcaccgcacgagctcgccacccaggagaaggtgaccctgtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagctcgcgcctgagttagcagctcgcg

SEQ ID NO: 727097 - DNA, 437 bp, Homo sapiens
gaaaaataaaatgtcaaaaagggaattttttcgaaatccccgtcgccctgctcaaaatattagtgaagattttgtagggcatctttatgccaatatctcccttattggccatggggcggcataaaaagcccaattgctaggacttcagttttttcttcagactaaagctacccaagggcttaccaaatatgggggtttcatcagtggctggtcattgtagcctaagtatacaaccaagcttcagggggcaccctttttttcttttcccattttttgttttagtaatttccttggggaactaaataattttccaaaatttttcctaattttgtttttcccgttttgcccaaaacaaagcccctgtttaacccacctgttaacgaataataaactgcccttatcctttaaaaaatggggtatttgtcccccccgtgtta

SEQ ID NO: 727098 - DNA, 265 bp, Homo sapiens
ctcggctcctgcaactctgtctcccgggttcaagtgattctcctgcctcagcctcacgagtagctgggattacaggtgcctgccaccatgcccgactaatttttgtatttttagtagagacggggtttcaccgacgttggccatgactgttcttgaacgtcctgacctcaatgtgatctgcccacctcgtggctcccgaaagtgttgtgaattacagtgcgttgagccactgtcgtccacgcctccaccctgtctgcgttttcta

SEQ ID NO: 727099 - DNA, 320 bp, Homo sapiens
tgcgggttcttctgcttgggcacaagttgcagaacaccctctctggggacgagggttaggctgtgacacggttggtgggtgctgggtgcacaatgcttggctggtattggtctgaagacagagccgggtaaactcgctcccagccccacgcaacggccaagcccaacccggctgcacacaggactcacgaggacccagcacctccagcgtgcccagagctggtgtcacagcctcggctcggttccccagcaaagcagctgagacctccgctggagaggagagttcggcctgaagccctgcccactctgacccgctagggg

SEQ ID NO: 727100 - DNA, 1368 bp, Homo sapiens
  misc_feature (189)..(189): n is a, c, g, or t
tctgaacttttaatgggcctccgggatccccaaagggtacccgggcttctggctgggctataatggcctcagacacacttgggtggtcaatgggtctcagaacaccacttggccatccattaataccggcgggaaggagaggctacttatgggataggtttgagctatgggcagtagctcgctggtccnagaggacatcaccaagaactataaaggtccatgcgaccaatcattaccagacacggcggagcgagatagaggtgggcgaatattcagacctcacagtgttgtgaccctgtgaatgattacagcagaggggaccttcattaattccgtggggccagtggacgcgcggaatccacactcaggcaccagaggatcagtggtgcccagacactcagtggcacctccacaggggtgccaagcaaagggactcccccgatgaggaggccgaggcctcacacatcatgaatagagaggcgcatacgcgggggccctcaccaccttacaccttcaaggccgtgtatatcgtcacacaagactgtgggcgcttctccacgaatgtgttccactcatgtgggaggtccccgcggggctcgaatctctcacacagggcactgtggcacgtgatacgcgatgtctacagcaattctgtggtaaagcagaatcgatgcattcacagccaagagtgtcccaaaaaccctctcgagaacacaggacagtgggtgtgttgttgtgtggaacccccacagttggttgggatgagacacaacgctaccgtaaaaagtccgtgggaaagtggaggcaccccagggtacacatgtgtgtcataagccctcacacagttactacggggaaaacatatcgccgaaaggcccaagagcatcggcacgcaaccattagatgggggccccgcgaggcattggttgtggaccccaagggcaaatccaatggggacacggagggccccccgtgaaacgaaaatgagggggggggaacaacttcgaaacagcaagcaccacaggggaaccaaaaacgcaccacaaacaagatgtgggagcaactacagtggggaccattgggaaacaggggccccattgtacgaaacatggcgcccaacacacgcaacgagacggaaacacaacgcctagagcaggtggcacaggagcggacggagaacacaagctgccttgtgtgagaagagccgtagcgacaagccaccgggggaaccacccacaccgggcagaaccagcgttgtagtaacccaaggcgtgcaacagaaactcggggaaagaggagcgggcgctcaaagagaagttatcaccactctggaaggggggcccccaagagagctacacgcggtaaccc

SEQ ID NO: 727101 - DNA, 1292 bp, Homo sapiens
gcatgttgacaggatatgtgtgtacacttctgactggtgatcagtgcccggcccacggccctgagcggactgcagcctgcttagggacgatggtcaggtcccatgtttgtccctgctgcctccttactggagtgggtccacttgtggccataacgcgcccatccactactctggagaaggtcggatgccgcagtcctgcttgcacctgttgccgcttctgggcatcttgtgagttactttattatggctgtggattgtggtagaaaggatagccagacacattaaacgagttgtgtgtcccccagaagcgcactggagtaattcttatattggtagtattacttgtgcctgtcctgattggcctgtcgtggccttgggagcacggtcgggagaagtagagatatcataagtcagtagccacatcagaggcagggcagtgtctgaggagacatagatgcctgtacctgaccatctgggcctgttgtacctggaggtgctggtaccaatgacctgcgtggagatcaagatactccatcgacatttatactcaaccatgaccaaccgtggtagaccatgcaggacatatttgattaccagtgggatgttcccctttgaggttctggatcacactaagaagtgagtagatcgccccggacttatagactggtgacgaagcgatcccctttgttgcgttgagatgagggccccaaaggtatgggggcattttggcaccccattccaaggactaaacccttttgattggtacacaatggcccatgcaggcctatcttcgcgcaactcccgcgatcaaatactagacgtaagaatcaccccgtggcacaaaggacccattttgaagcccacaaaagtgcgcgaaggttgggcgcaacgcgggaaaacagacacgctatacaaccaattggaggccgaacaacaccgacaaaccagaggggggcttaggcccccgcgcgttggtcaccacaagacaccacgagagataacggagtccgtaccactagggggccagcccatggacacaaggaggtagcagcgacaccagaacagacacagaaaagaataggaaattgcaagcaacccccgatgggcgcagttagccaccttggccccactataacgggatgcgcacaaccccacgaggggagagacagcgaaaggatagcagagtaggacaggcggcagtgaagggacacagcacagggggaagtcaatcggcataggggggcgagagagcaatgagagacgcattaacaactagacaaaggagaacccta

SEQ ID NO: 727102 - DNA, 418 bp, Homo sapiens
  misc_feature (161)..(161): n is a, c, g, or t
ccatgttggttaggatggtcttgactcttgactcctgatcgtccgctcaccctcccaaagtgctgcggttacaggtgtgagccaccgcacccagcctgtggttctcaatgtttaatgcacatcagattgacctaaagagttattaacacattgctgggccncacctccagtatttctgattcaggaggtctgcattggagcctgagagttggcatttctaacaagttcccagataatgctgatgttgctgctctggggaccgtgcttttggaactgccagtacggtatacggcagcagtccccaacccttttggcaccagggcccagtttcatggaagacaatttttccgtggatcagggaggtagtgggggatggtttcgggatgaaaggattccacctcagatcatgaggcattag

SEQ ID NO: 727103 - DNA, 1453 bp, Homo sapiens
tataagaaatcaagcgggtttatatttccctcaaaacgtgaaattcactcttacgggtctcctcagaagctaaacttctccaaagctacagctcagcaattttctccactcagaaacccaagggagaaggggcccgggcataaaagaaaacgaaatgtgttcacagagaggctatataaaagaacccaagtagaaaacaagagggtgcgacaaaaggcgccacatatattcttcactcctcgtgtctccttctctcaggtgggttatcccaaatctctacaattcttggtgtgacacaccacttaagcgggcgcccaggtctcgcgggcgcacaaatgtgtgcgcactgcagacacacagtgcaccaaccgtgcgccacagtgaacaccacaaatcacacagccccccccaagacccaccccacaacacagagaaaaggcaccactcagacaccccccccacacacctacacacagcgggccaaccacctctacccaccagagtagggacaccaccctcccacagaacaaagtgcgcgggagcccacccccgcaaagccgcgcgccacaccaggagagagcccacgaacacaacgaggaagagagaacgccacacacccacaagagcgggcatcaaacaacgagcagcacccatacttccaccacacaactatcaaacaacatgtgcagagggcaacacctcttaacccatctatcttattttcacaaaaaacacaatatctcaccccactaaacaactacacccgactctctccttactaatcccccactctacatctataatctcgtgagccccactacacatcctctccctacataccaccccatcacatcataacccctcttgcccccctaatgaaaaccccccctcagccttccttcacgcgcccagcgcgaaccacaccacgcgccaacccgccatcacagcagaccgcgctcagtccacccacaagacccgggccagccccacccatctcaacgagcaagacgactacccacacagagacaactcataaaaccagggcggccaacccacacacagcgccgcccacaacaacccacacctccccacacaccacccacaaccgcgcgggaaacaaaaagctacgaaaacccccccatcaccaagagcgctctccaaagaaggacttccccgttgggcacgccgacaatcagaccctgtgtagcaaacgaccccaaaacaatacaactcacacatgacaaagaacaaaacacctacacaaacccgctccccacaaacaacctcccgtaggagcggttacagaccacacaccgggcaaccaacagcgagctctccaggcacacccgtcataccaaccgggacaatcgcccacaccacagggggacccccaacccgtcaccatacaccccaggccccccccgattccccgcagcacaaccctacgacgcac

SEQ ID NO: 727104 - DNA, 228 bp, Homo sapiens
ccaggtgcttcgagtaataactagtatggggatcaggggtgtaggtgtgccttgtggcaagaagtgggctagggcattatattaatcttagagcgaaagcctataatcactgcgcccactcatcaggggctggccatggctaggttaatagatagttgggtggttggtgtccatgagtgaggcaggagtccgaggaggttagacgtggcaatacaaatgattacggat

SEQ ID NO: 727105 - DNA, 398 bp, Homo sapiens
  misc_feature (372)..(372): n is a, c, g, or t
  misc_feature (395)..(395): n is a, c, g, or t
aggaacttagattgctgtcagtaaaatagggagccattggagcaagggggtgaccttggtatttcaaagaattgcttttgctgttgtgactagactgaagggagggaaaggtagaaacagggaaatccgttaaaatattgtggtaattcagtccagaattgatggttgccttgaccacaatggtagtggttagcggtgattagattctttatatattttgaaggtagaagcaaggatttcttactgtatttaattcccagtaggttttggggggaacaggtggtgtttagttacatgaataaagttcctttaagtccgtgatttcctgagatttttgatgtacctgtcaccccaagccatataccactgtgncccattgtggaagtccttttatnccc

SEQ ID NO: 727106 - DNA, 253 bp, Homo sapiens
tgccacaaccattcaatgtgggaaagaacagtcttttcaacaaatggtgctgatgaaactagatatcaacagtgtgaaagaatgaatttggggctgggcgcagtgtctcacacctgtaatcccagcactttgggaggttgcggtgggacgatcgcttgagtgtggaagtcctagaccagtctgggcaatacagtaagactttgtctccacaaaaaataaacatgagcatggtggcgcacgcctgtattccagc

SEQ ID NO: 727107 - DNA, 659 bp, Homo sapiens
tgggctctaaagggggtaaagggggtgctatagggtaacatacggaacctatttcaaaaattttaagggggaattaattctaggacgattgggcattgaaaactgtggttggctccacagatttcagagcttttgaccgtagtatacccccggtcgtgtagcggtgaaagtggttgggttataaacgtccgggaattgcactctgttttataaccctaagtgtgtggggcacagctcatgaagttgcaagaacgatctgtggtgatgtaattattatacaaatgggggcttcaactcgggagtcactactcgaatgtgtcaaacgtcaaggaagtcgcaaggtctcgccgtggttctctaggaacataagtgggggaaatgtatgttaggaagtttgaaaacatttagtccagcgcggaaacatccgatgttacatcaataggggtcacagacacctatagggggatggccaaaatacgaatctgcgacaaggcataaaaggggaaagaggaacaactccaagaaaccactacgaacacgagtcaatgtataaacaggaactgcgcgcaaagaggaaacagggcaaggggcccacaggaaagggccacactaggacaagagcagatggcacgggacaaaggaaaataacagtcacaaaa

SEQ ID NO: 727108 - DNA, 628 bp, Homo sapiens
  misc_feature (5)..(5): n is a, c, g, or t
  misc_feature (13)..(13): n is a, c, g, or t
  misc_feature (85)..(85): n is a, c, g, or t
  misc_feature (106)..(107): n is a, c, g, or t
  misc_feature (138)..(138): n is a, c, g, or t
  misc_feature (168)..(168): n is a, c, g, or t
  misc_feature (175)..(175): n is a, c, g, or t
  misc_feature (187)..(188): n is a, c, g, or t
  misc_feature (194)..(194): n is a, c, g, or t
  misc_feature (197)..(197): n is a, c, g, or t
  misc_feature (202)..(202): n is a, c, g, or t
  misc_feature (208)..(208): n is a, c, g, or t
  misc_feature (220)..(220): n is a, c, g, or t
  misc_feature (222)..(222): n is a, c, g, or t
  misc_feature (227)..(227): n is a, c, g, or t
  misc_feature (235)..(235): n is a, c, g, or t
  misc_feature (242)..(242): n is a, c, g, or t
  misc_feature (261)..(261): n is a, c, g, or t
  misc_feature (267)..(268): n is a, c, g, or t
gtctntaaacccnaaccccctttaaggcatgtcggtctcaaggggatttgggattgaagcacagctttctgttgaggaaacctangtgtcactttttagaacattnngaagaaagttgtagggtgggcttttccattnaaaggaatgtgatgatcctaggttctgatnagtgatnagtggtctccgnntatacnctntcttnttttgncacctgtaagtncnggtantggccatnttacatnctcatgtcctgctggaagngcctanntgcctgcaaagccagctaaggcttattatctcaaaagaagatgatttcatgagtgacaggtaggcagtagaggacaaatggacgcacgatactgtatatccaactcagctgggtggcaggatgggttgatgagtgaagtcgacgctcactattggattcttacggactgagagttagtcttgcctctacacggagtcacaggaagggcataaatgcatgttccctgatgtgccctcccccaaagaatgtacctgtactcaaaccaggatgctgttttgctgcattaatcatcaatcgacaagttagtggaagacttcgaagaacaaagatcttttttttttatttgatgtcccagatgtt

SEQ ID NO: 727109 - DNA, 612 bp, Homo sapiens
  misc_feature (5)..(5): n is a, c, g, or t
  misc_feature (13)..(13): n is a, c, g, or t
  misc_feature (85)..(85): n is a, c, g, or t
  misc_feature (106)..(107): n is a, c, g, or t
  misc_feature (138)..(138): n is a, c, g, or t
  misc_feature (168)..(168): n is a, c, g, or t
  misc_feature (175)..(175): n is a, c, g, or t
  misc_feature (187)..(188): n is a, c, g, or t
  misc_feature (194)..(194): n is a, c, g, or t
  misc_feature (197)..(197): n is a, c, g, or t
  misc_feature (202)..(202): n is a, c, g, or t
  misc_feature (208)..(208): n is a, c, g, or t
  misc_feature (220)..(220): n is a, c, g, or t
  misc_feature (222)..(222): n is a, c, g, or t
  misc_feature (227)..(227): n is a, c, g, or t
  misc_feature (235)..(235): n is a, c, g, or t
  misc_feature (242)..(242): n is a, c, g, or t
  misc_feature (261)..(261): n is a, c, g, or t
  misc_feature (267)..(268): n is a, c, g, or t
gtctntaaacccnaaccccctttaaggcatgtcggtctcaaggggatttgggattgaagcacagctttctgttgaggaaacctangtgtcactttttagaacattnngaagaaagttgtagggtgggcttttccattnaaaggaatgtgatgatcctaggttctgatnagtgatnagtggtctccgnntatacnctntcttnttttgncacctgtaagtncnggtantggccatnttacatnctcatgtcctgctggaagngcctanntgcctgcatagtctactaacgctcataattactacggaagattatgtttgcgagtcagatcgctggcatgactggttacttagtgaagtcatcgatgacttctggattcttacctactgagagctatgctctgctctacacggacatgcatgaacgttctatgtgcgtgttcctgaggctcactaccgctgagaatgtacctgctctcaatccacgatctgatatagctgattgaatcgttcgactacttagtagaggtctttagatgcacaatgcagagctgtgtctttgcgtgtgaggatgtcctacgagaggcccttgtgcattagtatagtctagggctg

SEQ ID NO: 727110 - DNA, 819 bp, Homo sapiens
  misc_feature (59)..(59): n is a, c, g, or t
  misc_feature (65)..(65): n is a, c, g, or t
  misc_feature (67)..(67): n is a, c, g, or t
  misc_feature (71)..(71): n is a, c, g, or t
  misc_feature (303)..(303): n is a, c, g, or t
  misc_feature (317)..(317): n is a, c, g, or t
  misc_feature (323)..(323): n is a, c, g, or t
  misc_feature (327)..(328): n is a, c, g, or t
  misc_feature (388)..(388): n is a, c, g, or t
  misc_feature (398)..(398): n is a, c, g, or t
  misc_feature (401)..(401): n is a, c, g, or t
  misc_feature (407)..(408): n is a, c, g, or t
  misc_feature (438)..(438): n is a, c, g, or t
  misc_feature (455)..(455): n is a, c, g, or t
  misc_feature (459)..(459): n is a, c, g, or t
  misc_feature (466)..(466): n is a, c, g, or t
  misc_feature (557)..(557): n is a, c, g, or t
  misc_feature (581)..(581): n is a, c, g, or t
  misc_feature (589)..(589): n is a, c, g, or t
  misc_feature (593)..(593): n is a, c, g, or t
  misc_feature (600)..(600): n is a, c, g, or t
  misc_feature (609)..(609): n is a, c, g, or t
  misc_feature (622)..(622): n is a, c, g, or t
  misc_feature (633)..(633): n is a, c, g, or t
  misc_feature (642)..(642): n is a, c, g, or t
  misc_feature (655)..(655): n is a, c, g, or t
  misc_feature (671)..(672): n is a, c, g, or t
  misc_feature (685)..(685): n is a, c, g, or t
  misc_feature (783)..(783): n is a, c, g, or t
  misc_feature (805)..(805): n is a, c, g, or t
ataagtgaatttaaataatgttgctggatacaaagtcagtatacattaaagcaattacnttattnanatantttggatatttgtccccctccaaatctcgtgttgaaacatagcctccagtgttggaggcgaggcctggtgagaggtattttggtgggcggcagattcttcatcaatggcttggtgccattgtgtccagaattggtgggttcttggtctcactaacttcaagaacgaagccacggacccttgcggtgagtgttacagctcttaaggtggcacgtctggagtctgtcccttctngatcgttccagcangtgttncggnnttttccttcccttctcggttgggtttcgtggtctccctcagctccaggattgaagtccgncaaactctcncgncggtgnnttttcaaaaacctttaaggcaagcgcgttntgggagtcgtttcgttncctncccggtngggctcgttgggctccgttaggctaccagggagttgaagctggcagcacctttcgcgggtgagataattacaagctctttaaagggcagtngcatactgggagttagtttcgttncctccctnggtnggggctncgttggtcntccctcggggctncagaggagttnaaagctagncagaatacttacnacaattgaagttgttnnacaggctttcatnaaaaaaccagcgtggggaccttaaaaggagttaagccagttagttaaggatggtatttgcaaaagagttgaaaagaaacaaaagctttccacaagtantggaaaaatcccccgggaattncccggacccggtta

SEQ ID NO: 727111 - DNA, 112 bp, Homo sapiens
cttccagtagccgacagtatcaggtgcagcgggtcatgcctgcataccacgcactatatgacgaggctaagagatggtagatcactatgcggtccggagcccaagaccagcc

SEQ ID NO: 727112 - DNA, 908 bp, Homo sapiens
atgctgctattggtgggaaaggaactgctcgcgagaaagaagaaaggtggtgtcatagagacagccacagctagatgacaaaaaacttcagttctccgttaaagaagttaggggtaaacaatatctctggtatcgaagaggtgagatagtgttgtacaaaccagggaacagtgatccactttaacaagcctaaggtgcaggcatctctggcagtcgaagcactttcatccattacaggtccagtgctgagacaaagcagactgacagagaatgctacccagcatcttaaagcagcttggtgcggatagtctgacgtagtgtaatggagactggtccggagctctgcacaaacaatctgtggatggaaaagcagcacttgctactggagaggatgatgatgatgaagttccagatcttgtgggagacatttgatgaggcttccaagaatgaggcaaactgaatggagtcaacttctgacagataaaacctgaagaagttactgggagctgctattttatattatgactggtttttaagaaatctggttcatggatctgataaaatctagatctctaatattttaaaggccaagcccctggacactgcagctctttcagattgggttatacacaattcatccttgacgtaataagccgagaagccgcggaatcacagtcggaaccaagattaactaagggtccttggcctaaaagaacaacaacagaacgcaaaacaaaccatgtggggcggcactgggcacagagaaacgtcaagaaccacgcggggcgcggccccaatggacatcgaacacggcacaacggctgccacggaaccgggcacacaggcgtggccccacaaaagccggcgcacaggcggataccaacggggacgcaaaggaacaaggcgca

SEQ ID NO: 727113 - DNA, 579 bp, Homo sapiens
  misc_feature (17)..(17): n is a, c, g, or t
tgatctagaggatcccnacgagggtgtcccagtgtgttgggattacagcatgagccacattcctggccagcacccattttaaaggcaggtactttgaaagtagggaatttaaacaatttacctataccattttctctctatggtttgctaatgggaaaagataattatagagaaaagattatttgaaaagagaagtaaaaatgaggaactttggttcttatggtctcgggttataattttttgggaaacccattaatatcttattcagatagcggagactcgttcttcgtcttcctttttagggaaagaaaacagtagaagaaactttgaaaagatgcatactttaattagaattgctgaaaaaatattggagattttggctgtggtagttaaggttttaacaggctttacttttcagctgaaacctgatttggcatggcaagcaaaggtcctcatttctttagatgaaagtcgcctttagtaatgatccctcaattatttcctctctttttttctcaaggatttttttctacacttgggtttggaacttatttcaaaatctctcaacaactgatttca

SEQ ID NO: 727114 - DNA, 327 bp, Homo sapiens
tgttgcgaggaatgctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagctatgattacaccacggcactacaaccttggtggcacagtgagaacctgactcttaaaaaaaaaaattgtggattggaaggaggcaagaaagaagtcaggacacgggtggcctgtaagtccctaaggacacaatcttactcagaattcctcgcaacgg

SEQ ID NO: 727115 - DNA, 752 bp, Homo sapiens
attgacgaggttgattgaggcgttgcgagccttagctttctcccgaacgccagcgctgagtggacatcgagtgtcgcgggtctcccgactcatcgtgtttgtgtgctcgacatgctggtctgaggtcgtgctctgccgtgctgtccgcggtacaacgtagacaggcgaaacgcagcacccgaacagtgacgaagctttaacgacgcccatctggcaattgtctcctcggacgccggtgacgtccctcccgctggtcatccactccgggaccagaaagctgtgaaggtcgaaacagctgcggtttcctgttttaaatgttacgcagttgtgtaatactagcctgctttgtggagtaggaaatgtacagatgaggagctatcgttcacataactcaacagtctagtgattgtcaagtggggaacgcgacagattctgttcctgtttccacggtcactccagtgccaaaggcagttctacagctaaggccagcagttcagaacctccccttctacaattccaaagacagttgactacatcaggtacagtcaacataacagctgtgactcaagctcacaaactgtgccgagaggtctaccgtttggatgcagacaggtttcattcgggaggaatcgtccctggtcctcggagtgtgcacggctgtaattttcttgcgttcaataatttctgccgatcctacggacgtgaatttaccaaactctgacacagtgccctccacaggcaggcagacaaca

SEQ ID NO: 727116 - DNA, 537 bp, Homo sapiens
cggcacgaggggaatttagtcataattagcaatacaacaatatcataatagatgttgaataaagtactatggagacttcgaggctgaagcgattaatttggtgtcagtttgagaatgaagctggaatgtttttatatattaaagttgaatcttgataatcaatactaaataaaagaaatgaagtggtaggcagaagtaacaccataaaccaaagcatagggttgtggcatcatatctgtaaagagaatccaggttagctggagggatgaggcattagtagagcacgtggagatgtaactggaaaagggcggcgggttaaaggttaaatgttaacacacttaaagacaaccaagaagttgaatgttgttccctaacttcgcggagccctgaagtggcagagcagcataataatatctctgcattgggaaaagccaagtttgtggcaggaagaaactagaagaaaaaaatattgtagccatcctcgtgtgatataatgagagatggattaaagcagggatgagaggctttttaaggaga

SEQ ID NO: 727117 - DNA, 108 bp, Homo sapiens
gggctcggtcctactcttcagccagacagcagtattacagtggatatcagccagacaagcagtattaaaggtggatcatccagcccgacaagcagtattaaaggtgga

SEQ ID NO: 727118 - DNA, 175 bp, Homo sapiens
tggtttggtttggcttttggttaaaacatgtctatagagtgggcagtaaaggctgaattggtcaaatacccctttccaaaattatactggtatttaaaaaataaagggatctacctaatttctatggatttaattggcagtttggtcttataaaaggggtatgtttctcaggggt

SEQ ID NO: 727119 - DNA, 147 bp, Homo sapiens
ttctctttgcaaaaccgatgtgatccttgatcgagaaaaaaatccagaaccctgggaaactgtggaccctagtgtacctcaaaagcttataacaatcaaccaacaatggaaacccattgaagagttggcaaaatgtccaaagggtga

SEQ ID NO: 727120 - DNA, 1283 bp, Homo sapiens
gctgcggtggctcactgcctgtaatcccaggcacttatgggatggcctgaggcgggtggatcactgatggtcagtgagatctgagaccatcctgtgctaacatgtgtgaaacccctgtctctactaaaaatacaaaaaaaatttagcctgtgtgctgcggttggcgggcacctgtagtcccagctacttgtggattgcttgagtgcaggagaatgtgtgtgaaccctgggagctggagggtttgcagtgacgctgacgatcgtgcatactgcactccagcctggtgggacagacacagagactcctgtctcaacaacaaacaaaacaaaaaaacaaacaaaacggggggtggaaacggagccataacaccaacgggccacacccgtgaggctgcagagcgcagaactggacacaaactggtctggcgtggcacccctttatttccaccaactatgacaccgtttaaatatacgcaggacttttaacaaagaagataccatcacagccaaggcgacaggggagagaaaagcggagaaacaggaggagagggggatacccccgagcgcctatatacaagcggcgcagtgggagacgcacattagccccagagggccacagaggcgagcgagcgaaccaaaacttaaagagggcccagccgccaaacacgaacaaaagagacaccaaagagcagcacaaagacaggcacaccccagaaggcaagccaacagagggaacaccccagaggagcaaaagcgaagaggagcgagaccaacaaccaccaatggaaaagcaaggggggcaaacctcgcgcccgcggacccaccccacacaaagcacaccgaccaaccacggccacaaccgggaagaacaacaccgaggtagggcgacagactgtcccacaccaaagcgacatagtgcaccagcggaaacaacaacacaccacggggattcacggacaacggtggccacgagaggcaggggagaaagagagaaaagaagagccaccaacccacatctgaacgaaaacaaggagagccgccgacaaccacacacaggcgggacgagaggaagaccaatcggagaacaggcgaggagaagccacgaagaggacacgaacggcgagagaccaccagaagagagggtcgacaaacagatagaaaggcacacgatgactcacaccccaatgcggcagaaagaacgcaccgcgaccgaacccatgatagcacaagagataacagacccgacacaccacagaacacaaaaccccagaccgtccgaactga

SEQ ID NO: 727121 - DNA, 1054 bp, Homo sapiens
  misc_feature (1)..(1): n is a, c, g, or t
ncagcctgcgcaccttttgtccccgctcgtccccagtgacggcttccgaaagcctttgggtttgcagcgcatttactttgcccctttgtgtagatgttgatggaacctcaggccgcatgtgcagtccgcgggggcccccaggtgtgttcccgcccgttatcctgtggaaagaacgctggcgcgtgtgtgtcccccggcgcgtccccccaggtgaattttcggaccccgtggtcatggtttatttcagccagggcctccaaaggtttccggcacattggccactggggtccacgaggccttgatggaccccccgatttgagtaccccttgcccggagacaccgccggttaggaccttttccccaggaaagtgacccatgttgcaccggccgctgatgcttccagggcccagagtccccttaattatttggggttgccaaaatggtggtattcctccattctgtccgttttgccttgcccttattatgcctgggaaatggtttttctaagaaaagtgtttttctctttttaatagctctatttctcggttaccccaccgtggtaccacgcttcacatattatggaaagggccacggagtaaaatggcttgagtttctttggcttcttgtaccacactaagtttttaaagagtatatgccacttaggttgtctcgtcccaggagaaggtgaagtggtgaaagggttttttacacacaaataataccacagagaattcactgggctgggccactggtgttcttaatgcccgtaatcccacgccacctttgggaggcctgaggctcggaggatcaccactgaacccccgcgagtttgagaactagttctgggcacacacactatgtgaccacccctcgtctctaccgaaaattataaatataaatcacggtgggtgtggtagtgcctcgcctcgttgtcccacgctatttctggaggctgagatgggaggatcgcttgggcccacggaggttcgaggatgcgtgaagctgtgaccctgcccccaccttcccgcctgggcgaccgccagtccttgtctta

SEQ ID NO: 727122 - DNA, 211 bp, Homo sapiens
  misc_feature (155)..(155): n is a, c, g, or t
acccacgctcctacagatatgcttctttaattttcagatagctgctgattgtgtttaactgttcatttatagcatagacaggtatttttgagcaccaagaaacaatccctgaaaattgcagttaaaatacagaaattagctgggagcggtggagntatcgtgtacatgtttgtactaatggtcatggctgttatgggggcggaggggatcc

SEQ ID NO: 727123 - DNA, 139 bp, Homo sapiens
attttacagtctatacagaaactaattaagacaagagttcatattttagctgttcattacattttaggtatttagttagttacaaaccctttcttcttgcgttgagaagcttgggtaccgagtcctcgaagttcgctaa

SEQ ID NO: 727124 - DNA, 122 bp, Homo sapiens
atgatacttcgagtcacttgatgtgtgttgagcatggtctcaaagtcatcgggaactattttcggtacttggttaaccaggctcatcagtgaagcggcccacagtattgctcagtgctagct

SEQ ID NO: 727125 - DNA, 214 bp, Homo sapiens
cttatcctcaccctgatgagtagctagtgattacagcgcgcaagccaccacatccagctaattgtgtgtgtgtgtgtgtgtgtgtagtgtgtgtgtgtgtgtgtgtgtgtgtgtgtatatacctgtgaatctacatattgtgataaaaattctgattattgagagaagatggaccctctctgtcgcccagggtggagtgcagtggcaacaactc

SEQ ID NO: 727126 - DNA, 243 bp, Homo sapiens
ctcggtttattgtgcacatggggaaacccaggtctttagacacacacctgggcacatggcgaaacccagtctctacacacacaaacacacacctgggcacatggtgaagaccagtccctacacacacacacacacacacatgcacatgcactacttgttcagggatgggcatacttcttctgcaatggccagatcataaagttttgaggctgtgtagaccatgtaatgtcacacccactcacc

SEQ ID NO: 727127 - DNA, 274 bp, Homo sapiens
  misc_feature (36)..(36): n is a, c, g, or t
gggtcgcaatgcttgccaatggcaccggacctgctnccccggcagctcgaatgacagcagtgcccggtcacaggaacgggcaggtgggctggggccgagagacgccaccacatcggtcagcgagtccctgcccaccctgtctgactcggatcccgtgcccctggcggcggtgcggagatcaacgaagacacaggaggctttgagtccctcgcagaaccctttgcctgaagcgcgtggggtggggggtggcggggtgtggggttggtgggggggg

SEQ ID NO: 727128 - DNA, 183 bp, Homo sapiens
aacattcgtcctcaaaagcagtgatctgctcctccagcatatctgttccaactttatcatcttcaagctatcacacatgtatttagtaagtttcttaacttcactgtatccctactggacactatgtttaggatgagaccccatgactaatgccgtctggtacacgaagtgttcacgggtacc

SEQ ID NO: 727129 - DNA, 528 bp, Homo sapiens
atctttttcctcaaaatacaagtcactctgaataatatcacagcttatcttgtatgtgtctggcaatgactggctgtctctgtgtcatagatagctcttattattttgagatacgtcccatcaatacctaatttattgagagtttttagcatgaaggattgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggtggataagcttttggatgtgctgctggattcggtttgccagtattttattgaggatttttgcatcgatgttcatcaaggatattggtctaaaattctcttttttggttgtgtctctgcccggctttggtatcaggatgatgcttggctcataaaatgagttagggaggattcctccttttctgttgattggaatagtttcagaaggcatgttccagttc

SEQ ID NO: 727130 - DNA, 337 bp, Homo sapiens
tctagaggatcccgtgatcggtaactatggttgggtgaacctcatctttactaaaaatacaaaaattagccgggcgttgtgacgcacacccatagtcccagctaactccggaggctaagacaagagaatcacttgaacttgggagacagaggttgcagtaaatctgagatcactccgctgcactccagcctgagtgagagtgagactgtgtctcaaacaaacaaacaaaaaacaaacaaaaaaatttgcattgtaaattgtacctcaaatttgagcagttttagtgtttgtgtaaattaaagtcaaaagcagtccacaataatgtttagtaatactg

SEQ ID NO: 727131 - DNA, 316 bp, Homo sapiens
gaggtgatctagaggattccggtattgagtggcatgtgacaaggatctgagatccatcagagtagacttcaagttggagaaactttatttggacaggcattcttgttacttgaagtggtgatgctaattttcaaaaacagtaaaagctggtttctcctaaactattttccttgtggtagtagagatcaagtgggtcagaaacaagtcctgagcacttggtttcctttcgagacgcgtcattcggaggcaatctgtaaaactagcacaaggtctcccgctgttaccactggctcatccacatgattagcagcagtgc

SEQ ID NO: 727132 - DNA, 133 bp, Homo sapiens
ccgaggtcaaccaccccgggaacccctttccaccatagagacaacccctcgctagacgtgaactcagatcttgtcggaggaaggacaacacaacccaacgcgaaaccaatttccttattcctagttgctaagt

SEQ ID NO: 727133 - DNA, 557 bp, Homo sapiens
  misc_feature (14)..(14): n is a, c, g, or t
  misc_feature (65)..(65): n is a, c, g, or t
  misc_feature (114)..(114): n is a, c, g, or t
  misc_feature (129)..(129): n is a, c, g, or t
  misc_feature (239)..(239): n is a, c, g, or t
  misc_feature (262)..(262): n is a, c, g, or t
  misc_feature (397)..(397): n is a, c, g, or t
  misc_feature (426)..(426): n is a, c, g, or t
  misc_feature (429)..(430): n is a, c, g, or t
  misc_feature (443)..(443): n is a, c, g, or t
  misc_feature (446)..(446): n is a, c, g, or t
  misc_feature (456)..(456): n is a, c, g, or t
  misc_feature (527)..(527): n is a, c, g, or t
cccacatgacccanacacggtctggagttcccctggtggaccgaaaccctttctatgtggaagtnattgtcatgtggcccttgcttagtaaacaatgggtcagtctctggagancagtctatgtctctngaggggtctcacgtgggcgtctatttctccgtcactattggtgtccgtcgcgctgccgaagcctcacccgggtcctggtggaatcctaccggaagatcaaggaggcaggncagaacttcgagatcatcttcgntagtgcagacaggtcggaggagtcttcaaacagtacttcagtgagatgccctggctcgccgtcccctacacggatgaggcccggcggtcgcgcctaaaccgggtgtacggaatccaagggttccccacgctcatnatgctggacccgcagcgaggtgatcacgnggnngggggggggtggnggnggtggaaggngggggggtggggggggtgcgccctggcaccccaagcccgtgctggagctctccgactccaacgccgcgcanttaaacgagggcccctccctcgtccttttt

SEQ ID NO: 727134 - DNA, 535 bp, Homo sapiens
cctcatctgccgcagcgccagcaggcgcatctgcgtgtgcgccagcacgcggatgacatggcagtacttcttcatgctgctgaagtccttgtccagctgccgcttgccagcgtcgtcctgccacttcttgcagtacttggtgaaggccttcttcttcgacttgtgccagttcttgtagaagcgcctcttgcactcgtcactgatgtgctcggcgaacaccgtcttgaaggtgcggaggccccgcggggtctccacgtagcccacgatgcccacgaccaccatgggcggggtctccacgatggtcacggcctccaccacttccttcttgttcaccttggagcccggccggtccacctcccgcacgatgtgcgtcatgccggccttgtagcccaggaaggcggtgaggtgcacgggcttgctcgggtcgtccttggggaagctcttcaccttgccgcggtgccggctgctgcgcttccggggcaggaagcccagggacccgtgcctgggcgccgagaacttcctgtgcgacatcgtg

SEQ ID NO: 727135 - DNA, 147 bp, Homo sapiens
atgcttgaggggctggccggccgatatcgacgtatcccggaaccggtacgacgtgaccgcttggcgtaccgtttgtacctgccgtgattgtcaatcgctgttggagcgtgcgcccagggcttctgaacactggcgtggccagaagga

SEQ ID NO: 727136 - DNA, 207 bp, Homo sapiens
ggtgttatcgatgccacatacccacttgctaagaactttcttgcgtgcttatcttttcaaggcaggtgacagctttacatagtaaataggccttcatactcaaagagactaggtcaggagccacctttttttttttttttggcttctttaaatagctagtgatttggaaaggatggaggccccggccacggggacccttgagctcag

SEQ ID NO: 727137 - DNA, 196 bp, Homo sapiens
ggccggaaggttaatccaagccaaaagatcctttcccattttaattaagtggctggccacggtcccggcccaatccgccttttaactggaaattgggtggtgaaccaaccccaaccttggcttttctggtggccacaggtggcccaaccctccgtttgtagggatttttggcagcttccccttctgtcgtcttctc

SEQ ID NO: 727138 - DNA, 340 bp, Homo sapiens
aatagtgttttcttcatagggctacagtgagccagtgcgtagtgtctggaatgtgggacgtgctcagaaaagggtagttatcactgctgctgagtaacgagagcaggctagaggagaatgttcatagccccctacctctacctttgcccccaagtcagtaagcggcaactaaaggcagggagccatctcggaagtgctggaggcccacactcaaggactccaagtgtgactgatattaaagaacagcaacgtagattttagggcatcatctgtctaccccattggtactttgaacacttcaagtaattattatctctgttataataaataatgcaattga

SEQ ID NO: 727139 - DNA, 981 bp, Homo sapiens
aagcagtcgtatcaacccagagtggccattaccgccgggaatcatttgaactcaggggacgaaggctgcaatgagcagagatcggcgccactgcactccagcctggtgacagagtaagcactctggtctcaatggaaccaataccaagacacagagaaccaaacaaaacagtttgtggcgggggcactagcgagcggctgaagatgatttcattatccaccccggggttggggcggcaccgggcccccaatcgagtgtggtgacaccgtggggcacagagggggtgtggccatggggaccacccggggcacaacaacaggcgcggtgggggtttcgccgcccaatagaaaaccccggggggaacccccgggtgttcttcaagacacctcccaggggaggggtcctggggggaccaccctgcgggttctcacagcagggaggcccgagaggcggagtccgagattgacatatactccccggcgcgggggggtttacccaagtactgcaaaggacaatggcacgggacttgaggatggcaagaagcagctggaagacaggccttcagcagccatgaacgcagttctgccaagtcattccgtgtcattgccacaccagatgcgcctgtttcctctgcgccagaaggaaggccacctgatggagatccaaggtgaacggaggcactggtggggcgagaacgctggactgggcccgcgagacggttgagcagaaggctactgtgaccaagtgtggggcaggatggagagaccgagtaacggggtgacagggcagggtacaagggtcccagctgtggccaccagaggctgcccgagaccacgagactggcaagggcggagggacggaaccgggaggacattcgtgccggggcaaggccatcgggaacaaaataaggcgggcctagaggggcgagaaagccgagacacgaaaccgcggcgcagacagcgaggggagaagacacagcag

SEQ ID NO: 727140 - DNA, 2062 bp, Homo sapiens
  misc_feature (222)..(222): n is a, c, g, or t
  misc_feature (230)..(230): n is a, c, g, or t
cgttaataattttcttcaatgtaaacattcctaataattttgattgttgctccttagtcaatcatttcccaaaacatgattatttttaatatatgtaaaatatttaaataataaataataaaaggtaatgtgtccattttaaatttgttcccagccatacacagtagttccctgatacaaaatgctatgagaataccgactattttttcataatttaatttnaccactgnacctgattttagtacataagagtctaaatattaagttattcattctaaaaggggaaatcagtaaaagcaaggaatttatgaaatttttgctgtaatttcagtatctgttatacaggggaagaatgatcaggaaaaatataagctgacaacttacccttttgctttttaacaacaaaataatattgaaaatatattagaataactcacagatccagaagttggtggaaatggaagaatgttttagaaaataccatccatatgtttatctaagaaagtctcagaatttagtgacactaatacagttcataaatactgtaatacagtggagagagttggaatgttattttggttttatttcatcagcacaattattaaaaacaacaaaattaatgagacgttttgttataatcagattttttttttaccatattgcaagttataaaatgtcaacttatactaagtacctaacaactgacttttattcacttgttgtgacaagtttttaattaccaaattaagaccttttcagtatctatgagtaaaagaaatagatgattatatcagaccaggagcagagaatttataatatgtgctttatagcaaaatgtattaaattgtggttaaaatttatagctcatatgtagctgctgccaataagaaggctcagaattgttctgtggattaatttttacatcctgttttctgtcacttttaccaatcttcttggcctcatgtacaataatgtaaagccaatttgatgaaatggttcaggttgtagcagtctataaattgtcggtacattcagctcttctaggtgagcaatactgctgctatttttctagaaatagcaatcatttaaaaatgccaaatagctaactgctaccaactctttcttgtatcttgtctctttagagaaggaaatttttgtgtgccagtaatcatcaaagaggtgttttataagagtgttgatgttcagaagttcatgaaagtattttatccgtataatttgctagtgagctaaaacaatataatttatgtaaatctttatatgtacaaaatatatagtctgttgtacttgagtaatttggtctatggaattttaaatgccttcatttagcagtaatattcacatttttattttagacagttaagttcatgtgtttgattttgtcatgtcagcataaatgagaaaaagaagtggatcatgcagctaatgagtaaccaacattttgtaaagttttaaagttttagcaaacaacattattccatctcatttaaaggttaaaaaagaagagacaactctagccaaagtagaaatttatattctacacgtccaaactgtctcctagcagcttttggactatatatcacttgatgttaaagtatcttttatttgtaataaatattccaaatttctatttagaagctctaatgtatacctagattaaatcaaatcacagttttatgcttttaaaatatattgtatttcaaactgtatattttaatttctgagtgcatgttatatagtatttaatacttcagatgtcttggcaaattcaatataagtatttattcccacaagcgatatatgggatatctcttaaaaattatgaatatgtaccatttccttcaaagtcatcctagcctatgctgtatcaaaagtattgtatattttatggagatttagtgatatacatgtaaatgttttttaagttattttattgaagttcaatctttacataaaattaaaatctttttttaaaaaaagtgtcagtgccagaactgtaaatgaaaataatcaaataaaagttaaaataattcattactcctta

SEQ ID NO: 727141 - DNA, 441 bp, Homo sapiens
  misc_feature (55)..(55): n is a, c, g, or t
  misc_feature (142)..(142): n is a, c, g, or t
  misc_feature (364)..(364): n is a, c, g, or t
aaataagagaagaaggaagggagggaaggaggaagggagggatcaggtgggggtnggggagtacatatcaccatacagcctgcctggggaatctgagtcctcctttgctatgacatccaaaaaagattcagaaatgctgttngctattttttattcacccacaaatgtaccagttaacccactaggcctcgaattccagccagtagctaaaattattttcctatgagaaaaacgctcttgaagcgttagaggtttcttatctgcagggtctctgggaaggtttccaaatttgttacactacagaaatactttggttctttttttccccttcctcattgcaaaatctaagcctctcgcttgtganaatcttgatttataccaggtttttgtcctgggctagctccagttccttctttctggatctactggtagttagcgtcc

SEQ ID NO: 727142 - DNA, 1064 bp, Homo sapiens
  misc_feature (222)..(222): n is a, c, g, or t
  misc_feature (230)..(230): n is a, c, g, or t
cgttaataattttcttcaatgtaaacattcctaataattttgattgttgctccttagtcaatcatttcccaaaacatgattatttttaatatatgtaaaatatttaaataataaataataaaaggtaatgtgtccattttaaatttgttcccagccatacacagtagttccctgatacaaaatgctatgagaataccgactattttttcataatttaatttnaccactgnacctgattttagtacataagagtctaaatattaagttattcattctaaaaggggaaatcagtaaaagcaaggaatttatgaaatttttgctgtaatttcagtatctgttatacaggggaagaatgatcaggaaaaatataagctgacaacttacccttttgctttttaacaacaaaataatattgaaaatatattagaataactcacagatccagaagttggtggaaatggaagaatgttttagaaaataccatccatatgtttatctaagaaagtctcagaatttagtgacactaatacagttcataaatactgtaatacagtggagagagttggaatgttattttggttttatttcatcagcacaattattaaaaacaacaaaattaatgagacgttttgttataatcagattttttttttaccatattgcaagttataaaatgtcaacttatactaagtacctaacaactgacttttattcacttgttgtgacaagtttttaattaccaaattaagaccttttcagtatctatgagtaaaagaaatagatgattatatcagaccaggagcagagaatttataatatgtgctttatagcaaaatgtattaaattgtggttaaaatttatagctcatatgtagctgctgccaataagaaggctcagaattgttctgtggattaatttttacatcctgttttctgtcacttttaccaatcttcttggcctcatgtacaataatgtaaaaacccatttggataaaaaggggtcaagggtggtacaatctcttaaaatgggcgggacacattaaacttttttgagggggacaaaaa

SEQ ID NO: 727143 - DNA, 116 bp, Homo sapiens
tggaatcgagctcggtaccactagtccacggttgggtactagatccaggggtggctactagtcacggttggctactagtccacggttggcttccacggttggctactagtccacgg

SEQ ID NO: 727144 - DNA, 265 bp, Homo sapiens
cagtgcctgctgtcgtttattgccgaccaagctggagcacggaaaatctacgcggtggaggcctgcaccatggcccagcacgctgaggtcttggtgaagagtaacaacccgacggaccgaatcttggacatcccgggcaaggtggaggaggtgtcactacacgagcaagaagacatcatcctctaggagcccatggtctacatgctctataacgaactcatgctggagagctaactacacgcacaagaagtacctatagcccatc

SEQ ID NO: 727145 - DNA, 940 bp, Homo sapiens
  misc_feature (342)..(342): n is a, c, g, or t
  misc_feature (369)..(369): n is a, c, g, or t
agcggactggaagttccgtctactccgtgcgtttacggggtcctggaggtagagctcctgggacctcaagcttgggggaaagttccggtcggggagattgactcccacccgagcaccattctttcaaatcgcgacctaccgggacgcctgggtcctaccgcgagggaggagcaggcgggaggtcgtatgccgatagcttataagactcaatccaagcttgcagtagcatgggggcgcagactttgtctactacacggataagctcgtctccacatgaaggaagatagacgaggcgaccctctggagcaccccaggtgtctagcctgtcaccatctcattgcnagagctacattagttagaagatccttngtagggaatagtgcaacttatgggacgctgtggcgcctgcttcaacaaccaggaagttcaatcatgttttgggtaacgcagtgattgcgcattagcaggcaattccaaggactgcccaattcacgatcctctcagaaattctcggtcaaagtataactccccgatggggactggttgataccaattgttggcactgtaggtgcattgatgcatcggacccttggtctggacagggtgcgggttccaaagtgcaaagttgatgggccagagccaaccaatgtacggtgaacccgcggtgactcacacctggggggtccgatgcgcaccagacaggttaaccttagttcgggcagtaacgcgacgtcctaggtacctcgggggattacctttgtgttccgccacaggatgacccagttttcccacggggagctccccacagagggttgtttcgcggggtaccccttggagcggctatgattccatcttaggtcggtggctagtttgtttgtgggtggctggttgtttgctagtacgctcgttgtggtcggtggttgtcctggtgtttgttggc

SEQ ID NO: 727146 - DNA, 128 bp, Homo sapiens
cgtcctctcacctgggcttccaaaatgctgggactacagcatgagcaccatgcctggcagtgtcatggaaattaacctgttgtgcattatgcaaatattatggtcccattcttgtgctggttccgctg

SEQ ID NO: 727147 - DNA, 544 bp, Homo sapiens
  misc_feature (11)..(11): n is a, c, g, or t
cggagagaggntagggatgctgtcgtgttgtgtacgtgtctttctcccgctgctgcatataatttttcaagggcttgttgtatttttttcatgactcctttagggggcagcacataatagcaatcaagctgttattggatatctgaacaatgttgaagcaaaagtaaacttggcattgttattttgttatctgtgagttgtttgacctgatataaattctaggtatcagtttaggtcagtcaggagcgcttttctttccctgtgcatttcttcttgtggctcatattgatacagcccctgattgtttaggtttttcaaaaaagggatttggttattttctggtggttgttccccttagggtgaatatattcaacccaaaggcccccttgccttcacaggcggaaaccgtttcccaagaactaccttggaaaggcatttcttgggacaaattgtgggactttggaacacttggaagggagatgcattgaccattagaagggaaaggagctgatgccaagttctgcgggagctttgagttctgaca

SEQ ID NO: 727148 - DNA, 650 bp, Homo sapiens
  misc_feature (3)..(3): n is a, c, g, or t
cancactaagaaaaatataaacatactattcaataccaaagtgacagaaaaattacttatatctacttatcataatactaaactctcaactagcaacataaccaattttcataataaaacagtctttactaatttaatcttcatacttcataacaaaccaaaaccccataaaatttccacattacataattttaccttactaacacaatcatatccttaaagataaccatcattcccccaactaaaacaaatacaaactaatatatcatatttttttaactaccatatcaatataatctaaatcttcaataaagattgtatataaataaataaatactactaagtcaatatatataaaatatacctaaaacagacacatatttatatacaatattcatacaatgcaaaattaaatatttttacaatatatatttaaaatagaaactcaccataatactaccatctaaaaatctttataaaattaatttaatatcctttagaatttggactctaatagaactatatgaaatttaagatacctgttcactcttgcatatctcataaaccttatgaaatcacctgactataatgccatatcgacctttacacacctatactttaccatgccatatatgccactattccacact

SEQ ID NO: 727149 - DNA, 938 bp, Homo sapiens
  misc_feature (67)..(67): n is a, c, g, or t
  misc_feature (70)..(70): n is a, c, g, or t
  misc_feature (76)..(77): n is a, c, g, or t
  misc_feature (79)..(79): n is a, c, g, or t
  misc_feature (97)..(97): n is a, c, g, or t
  misc_feature (130)..(130): n is a, c, g, or t
  misc_feature (135)..(135): n is a, c, g, or t
  misc_feature (161)..(161): n is a, c, g, or t
  misc_feature (168)..(168): n is a, c, g, or t
  misc_feature (184)..(184): n is a, c, g, or t
  misc_feature (219)..(219): n is a, c, g, or t
  misc_feature (231)..(231): n is a, c, g, or t
  misc_feature (242)..(242): n is a, c, g, or t
  misc_feature (245)..(245): n is a, c, g, or t
  misc_feature (247)..(247): n is a, c, g, or t
  misc_feature (249)..(249): n is a, c, g, or t
  misc_feature (255)..(255): n is a, c, g, or t
  misc_feature (261)..(261): n is a, c, g, or t
  misc_feature (287)..(287): n is a, c, g, or t
  misc_feature (323)..(323): n is a, c, g, or t
  misc_feature (325)..(325): n is a, c, g, or t
  misc_feature (338)..(339): n is a, c, g, or t
  misc_feature (350)..(351): n is a, c, g, or t
  misc_feature (389)..(389): n is a, c, g, or t
  misc_feature (392)..(392): n is a, c, g, or t
  misc_feature (394)..(394): n is a, c, g, or t
  misc_feature (504)..(504): n is a, c, g, or t
  misc_feature (509)..(509): n is a, c, g, or t
  misc_feature (522)..(522): n is a, c, g, or t
  misc_feature (600)..(600): n is a, c, g, or t
  misc_feature (627)..(627): n is a, c, g, or t
  misc_feature (630)..(630): n is a, c, g, or t
  misc_feature (640)..(640): n is a, c, g, or t
  misc_feature (645)..(645): n is a, c, g, or t
  misc_feature (671)..(671): n is a, c, g, or t
  misc_feature (707)..(707): n is a, c, g, or t
  misc_feature (716)..(716): n is a, c, g, or t
  misc_feature (755)..(755): n is a, c, g, or t
  misc_feature (821)..(821): n is a, c, g, or t
  misc_feature (831)..(831): n is a, c, g, or t
  misc_feature (873)..(873): n is a, c, g, or t
  misc_feature (875)..(875): n is a, c, g, or t
  misc_feature (894)..(894): n is a, c, g, or t
cggcgggacctgctcggaggaatggcgccgcgggttcaagcactgtcttcctgttggccctgacaancanagccannanctgggctctgacgcccantcactaactcaacaagcatgacgtggagagaanaaaancctcgctggatcgccctttcaaaaanttggaanctgccttctactccancgtgggactcagcagccttggtgctcaggtgccanatgcaaaaaaanaatgtacctanatnananataaanttgatnccagcaatgtggattccctcttctangctgcccaggccagccaggccctctcaggatgtgananctctatttcaaannagaccaaaganntgcttctggcagctgtcagtgaggactcatctgttaancananataaaatgcagttgcagctctaagtggctttggccttcccttggcatcccaagaagaactcagtgcccttactgctcgtctcagcaaggaggagactgtgctggcaacantccangctctgcagacancatcccacctgtcccagcaggctgacctgaggagcatcgtggaggagattgaggaccttgttgctcgcctggatgaantcgggggcgtgtatctccagtttgaanaangactggaaanaaaancgttatttgtggctgccacctacaanctcatggatcatgtggggactgagccatccattaangaggatcangtcatccagctgatgaacgcgatcttcagcaagaagaantttgagtccctctccgaagccttcagcgtggcctctgcagctgctgtgctctcgcataatcgctancacgtgccanttgtggttgtgcctgagggctctgcttccgacactcatgaanangctatcttgcggttgcaantcaccaatgttctgtctcagcctctgactcaggccactgttaaa

SEQ ID NO: 727150 - DNA, 153 bp, Homo sapiens
tagtactctagcggatccttattttttttttaaggatttgagccagtaaagtagtttcactaatgggataaaagtgtcaacatagtgatggcaaaacaaaggcagctccagcccttgtttccacctttgtttgcagctcaggggcgctgtccc

SEQ ID NO: 727151 - DNA, 200 bp, Homo sapiens
  misc_feature (13)..(13): n is a, c, g, or t
  misc_feature (45)..(45): n is a, c, g, or t
  misc_feature (52)..(52): n is a, c, g, or t
  misc_feature (86)..(86): n is a, c, g, or t
  misc_feature (106)..(106): n is a, c, g, or t
  misc_feature (118)..(118): n is a, c, g, or t
  misc_feature (126)..(126): n is a, c, g, or t
  misc_feature (134)..(134): n is a, c, g, or t
  misc_feature (138)..(138): n is a, c, g, or t
  misc_feature (142)..(143): n is a, c, g, or t
  misc_feature (173)..(173): n is a, c, g, or t
  misc_feature (179)..(179): n is a, c, g, or t
  misc_feature (183)..(183): n is a, c, g, or t
gtagaggtggggnccttccaagagggacaggcctctccccagcgngccttcnctcccacggtttttatggatctgcaccacgactngtaccttctgggggagatangcgatttgactntgaaaaantggaaacnggcnaggnncttttgaagacttttggaccatgaaaaggngcgagngctnttcagcaaaccgtagtt

SEQ ID NO: 727152 - DNA, 213 bp, Homo sapiens
tgaactgaacgccgaacagattttcgttcattttggttctcagcgctttgttataattttttatttttatggcgctttggtgagggaggtaggtggtacgtttgtgtttaactatttttagttgggtgatgacgcgaatagtgtaaggagtatgggggtaacttatggtgggccatacggtagtatttagtcggggcattacagataggccga

SEQ ID NO: 727153 - DNA, 309 bp, Homo sapiens
attacatgactcattacttaaggtctatatttaattacagagtgtaaatttatcaagtgcacattaggtttataaacaagaagctacatttttgcccttcagatactacttacagtgtcctgactggtatacacatattttggtatcaaaggggataaaagccaagtttgtctggtgacatttcctttcacgtatctctttaagcagcacttctgttactaaagttaatgtgtttactctctttccttcccacattctccattcaaaggtgagctaagtcctcctcggtgagtctgtattaactgcctg

SEQ ID NO: 727154 - DNA, 7119 bp, Homo sapiens
  misc_feature (4315)..(4315): n is a, c, g, or t
gggctctgggaccgcagttgctgaaatggaggcagaggtgtgggaggcagaaggctacaacctagttctggactcggacctgtatgatgcggatggctatgatgtcccagaccctgggctgctcaccgaaaagaatgagttgactttcacggagccgtcgcaggtcctgccctttttgaccagcagccaacagtggcaaagcctgaccccgcgcgcccgcgcccgccggctgtggctgcttctgcgcaccagcctccacgaagtcgtggaaaaggagaagagagccgagctgcgcgcggcgcgcctgacgcatgggctggaaccactgcgccgcctggaggtggcagccgggctgcgctcggtggcgcaggacccggtgggtggacgcttcgtggtgctggacggcgcgggccgcctgcacctgcacaaggaagacggctgggcacaggagacgctgctggcgcctgtcgggcttacggggctggtgaccgtgctgggcccgctgggtgccgtgggccgttttgtaggctggggccccgcggggctggcaattctgaggcccaacctcagcctgctgtggctgagcgagcagggggtgggcagggccccgggttgggcgcccacctgctgcctgccggttcccgacctcaggctgctgctcgttgcggagatgaacagcagcctggcgctctggcagttccgctcaggtggtcgccgcctggtgctgcgagggtcagcactgcacccgcccccgagcccaacaggcaggctcatgcgtctggctgtggcgccggttcctccccaccacgtcctgcgctgcttcgcggcctatggctcggccgtgctcaccttcgatctgcatgcctggactctcgtagatgtgcgccgggatttgcacaaaaccaccatctcggacctggcttactgcgaggaagtagaggcaatggtgacagcttcccgggacagcaccgtgaaggtgtgggaggctgactggcagatccggatggtgttcgtgggccacacaggcccggtgacggctatgactgtgctcccgaacacgaccctggtgttgtcggcctcgcaggacgggacgctacgcacctgggacctgcaggcggcggcgcaggtgggcgaggtagcgctgggcttctggggccaggacaagctgtcccggcgcgtgggccgtctgctggcgccggtgcgcccgggctggccggtgctgtccctgtgcgcgagcagcatgcagctgtggcgcgtacgcgagctctactcgccgttggcgcaactgcccgccaaggtgctccacgtgcagttggcgcccgcgttgcccgcgcctgcgcaccagtcgctgcctacgcgcctcgtgtgcgcgtgcgccgacggctcggtctacctcctgtcggctgccaccgggcgcatagtgagctcactgctgctggagccggaggactgcgcggcagccgtggcctactgcctgccgcgcgaggcgctgtggctgctgaccagggctgggcacctggtccgcgccaacgcggcgcgctgccccatgagcgtgctgcaccgcgtgtgcccgccgccgccccctgcgccgcagccttgctgtctgcacctgtacagccacctcacggatctcggaggcgccttctcctcctgggagatcgtgcgccagcactggggcgagttgcgctgcagctctgtggcctgcgcctggaagaacaagaaccggtacctgccagtggtggggcacacggacggcacgctgtcggtgctggagtggctctcgtcgaagactgtcttccaaacggaggcgcacagcccgggcccggttgtcgccatcgcatccacctggaacagcattgtgtcttcgggtggggacctgacggtgaagatgtggcgcgtcttcccctatgccgaagagagcctgagcctgctgcgcaccttctcctgctgctacccggccgtggcgctctgtgcgctaggcagacgcgtcaccgcgggctttgaggacccagacagcgctacctacggcctggtgcagtttggcctgggcgacagtccgcgattagaccaccggccccaggacgaccccacggaccacatcactggcctgtgctgctgccccacgctcaaactgtatgcctgctccagcctggactgcaccgttcgcatctggactgctgagaaccgcctcctgcggctcctgcagctgaatggtgcccctcaggccctggctttctgcagcaacagtggagacctggtgctggcgctgggatcccgcctctgcctggtgtcccacaggctctacctgcctacatcctacctagttaagaagatgtgccggaaggccccagacgtggtggacgaccctccgctgccactgatgagccaggagtcactgacttccgcccaactgcagaggctcaccaacctccatggggcagccagcctcaggtcccatggaggcctgctcagccctcctggaggccctcctttcccactctgggtgggggcctggcggtgtggggccctctggagttgatacaagcctgcctgagccctggcacacccgtttggggttggtccttgtcccagcctctgccccagcccactggcatgccacccagcatcccacctgtgcctgtccctgtttgcagcgaggccttgtctctcatccatcgtcggagggcaacatctcagcacctggtgccgaaggaggacttggacgccatagtggcccgggaccgagaccttcagcagttgaggctggggctagtggtcccagcagcccagcccccaccctcctggcagcagcgccaggaaggctttgacaattacctccgtctgatctacggctctggcctgctgggcatgcagtctggaagggggtcccagcagtggagtgccgggaccctcagagtggagagagagacccgggatgtgtgtgctgtaccccaagctgcccactgtcttgcccgggctgaggtcagcactgcagcccaaacagtgccaacagccctgtccccacaggacctgggagccctgggccagcacttctcccagtctccccgagtcacagtgccgatcccacccacccaccgtagggtgcacagcaaggcatcccagcttctggcccgctcctcactgagccactacctgggcatcagtctggatctgcagctgcagttggagcagctccgagggaggacgaccatggccctggacctgccatcctcccacttgcagtgcaggatcccactgctgccaaagagatgggacaaggaacctctctctagcctcaggggcttctttcctgccaccgtgcagccccacaagcactgcctgaggcccatctgcttccccggctatgtgcccaactccgcggtgctacagcagatgtggctaaatgcggagccaggggcaagccaggatgccctgtggttgtggcgccccaggccatcccaagcccagtggcagaggaagctgctccaatggatgggggagaagcctggggaggagggggaggaagacaagaaggaagaggaggaggagaaggaagacgaggagctggactgggccttggcttccctgagcccgcactccaaccagcagctggattcctgggaactggaggatcagagtgctgtggactggacccaggagccccggcggcgcagctgcaaggttgccaggacccaccctcatccctggcaccgtcatgggagtttgctcttggatgagcattacgggcatctgcccaagtttctgcatttcttcatctaccagacctggttcaaaaagttgttccccatcttcagcctgcaggcatacccggaggcgggcacgatcgagggcctggcctcgctgttggtggccctgctggagaagaccacgtgggtcgaccgtgtgcacatcctgcaggtgctactgagactgctgcccaacatgagcagtgatctccaaggccagctgcagggcctgctcgtacacttgctcaacctggaccagccccccagcctccaggaccagacacagaagaagttcgtgatactggcgctgcagctgctcctggcctgctccctggagtcccgggatgtggtgctggagctcatgtcctacttcctctactctcccgtgcactgccggccagagctcaagaagctgctgcacgggctgggccttcaggacccagagggcttcctattcaaggagatgatgacctgggtccagggcccagacctggactccaaggccggcctgcgcacttgctgccaccagaaactggaggacatgatccaggagcttcaggagaccccancgcagacgtcagtggtctctggggcacccacacgcgcctccgtgataccctcgggcacctcctggtcggcctccggcatcttcgggaggctctcgcaggtctcagaggtgcctttgatggtggtctcacctgcggagccgcactctttagccccggagctccaggcccagcggatgctggcacccacgcgcagctgggggacccctcagctccgtctcagagtgctctccgagacgctgaagagcttctgcctggagcccgaggcccgcctgcaccctgccgggcctgctcagctgcccggagagccgccgccgctggaggagaccgactggtcgcactcgcagctgctggacttgggccccatcgacgcgctcaacttcttctgtgagcagctgcgggcgcagcagcggagttcgctccaggagaaggctgcgcacccacacccgccagtgccctacacggtggcgccggtgcccgacatggtggtgccacctccgcgggagcactggtaccaccccatcctccggctgcaggaggccaagccgcagaggtccgcgaggtccgcgatgagactgaggggccccatgccgtcccggctctgtgcgggccgcaccctggacggccccatccggacgctgaagctgccgttgccgcgtgtggagccgcagcctttccccctggactggcctatgcccccgcgcccgctgcccccgcggctcctgcagccggccctgcagcgctactttctgccagcggacgcggaccctgacacctacagctgaccgggctggtggcctcagcccgcctggctctggggcctgtcattggtatttggccaaggcctgcatcgggaataaagtccagagaatttctttctgcaggatgccgcctgctttggagggccccggggtgcgcacggcgtgtgggcgtgcggcctgaacccacagtggcggcggaaggcaggagccggaggcctggcggaggtggccatcgtgggcaccagcgttcccggaggggtggccggcctagggcagaggagacccatagcggggtaccatccgctgggcactgagcaaacgttttctgctcaagtactaggtgttgagatgcgggctgaccttagagaacgtgtcctgggccagcccacagcctggtgtggaggggagtccgggagggcctgggcggtcccaggatgagccttccgggtcgatgcaggtgagaccaggagtttgcagaccttgctttcgttacttttattctggaaaagagaagaattgacaaaggcaccaggagcttttttctgagcggcaacgcagagcatcctctgacccctttagcctgaaagtccctaggggaggggcttggtccggaagggctcggcctctgggccgggctcctctgccctgtgtggcctggcagggcgcaagacctgtgcacagagttcttggggcagctctggggggaatccccggcttttacacctgtcttttgtgttgtctgagcagtgatttccctcctgtatctgtagcctctgactttactagtttcttcttgatggctctggttagaatcgcttctccacaccttccctgtcaccccaaactgtgcggtggctcttgttatggggccaccaaatggctgctctttcccaggccggtgcttgacacagtggtgccaccatcccaagagcatgggtgcgcaggaccgtgcgggacagccaagttgctgggcccagctgaacctgcctcttcacctccaggcactaccgcatcctcccactgcagaaggccaaggttcacaggtgtgcgatgagactgaggactgagtctgtcactagaggacttgacactttttataaaaaaaatgagtaaacctagatacctcgatcagtgtctagcgatgtcaaggcccccagtttgggttcaagcctgctgggacagtcctgcagctgctgggtcacagagtggccaaggccctctgatttttggtcaggacacagaaagatagcagggggcagggggggatctgagggaccccacatgacttacaatcagacaaggtaggtcagaggatttctttatggctatctgttttgttttgttttgttttgttttgttttttgggatggagtttcggtcttgttgcccaggctggagtgcagtggcgtgatctcggctcactgcaacctctgcctcccggattcgggcgattctccttcctcagcctcctgagtggctgggattgcaggcgtgtgccgccacgcccggctaattttgtgtttttggtggagatggggtttcgtcacgttgaccaggctggtctcgaactcctggcctcaggtggtccgcctgcctcagcctctcaaagtgctgggattacaagcgtgagccactgtgcccagccttctttatggctatctccaagacagcaaaggcaggggaaagtcctgccttggggagaaaaaggagggtgggaaaaggtcaaagagaaagatgctgttgtctgagtcttgcctctgaggcctaagttccccaacattataacaagggatatgggagttataagccaggaactgtggatggaaaccaatgacagatatcataatatcacacccacacatcaggcaagagacttgttccttaaaaattatctagtttagccgagcgtggtggctcacgcctgtggtcccagctgcttgggaggctgaggcaggagaatcacttgaacccaggaggtggaggttgcagcaggcagggatcacaccactgcactacagcctcggcaatagagcgagactctgtgtc

SEQ ID NO: 727155 - DNA, 6351 bp, Homo sapiens
  misc_feature (5479)..(5479): n is a, c, g, or t
gggctctgggaccgcagttgctgaaatggaggcagaggtgtgggaggcagaaggctacaacctagttctggactcggacctgtatgatgcggatggctatgatgtcccagaccctgggctgctcaccgaaaagaatgagttgactttcacggagccgtcgcaggtcctgccctttttgaccagcagccaacagtggcaaagcctgaccccgcgcgcccgcgcccgccggctgtggctgcttctgcgcaccagcctccacgaagtcgtggaaaaggagaagagagccgagctgcgcgcggcgcgcctgacgcatgggctggaaccactgcgccgcctggaggtggcagccgggctgcgctcggtggcgcaggacccggtgggtggacgcttcgtggtgctggacggcgcgggccgcctgcacctgcacaaggaagacggctgggcacaggagacgctgctggcgcctgtcgggcttacggggctggtgaccgtgctgggcccgctgggtgccgtgggccgttttgtaggctggggccccgcggggctggcaattctgaggcccaacctcagcctgctgtggctgagcgagcagggggtgggcagggccccgggttgggcgcccacctgctgcctgccggttcccgacctcaggctgctgctcgttgcggagatgaacagcagcctggcgctctggcagttccgctcaggtggtcgccgcctggtgctgcgagggtcagcactgcacccgcccccgagcccaacaggcaggctcatgcgtctggctgtggcgccggttcctccccaccacgtcctgcgctgcttcgcggcctatggctcggccgtgctcaccttcgatctgcatgcctggactctcgtagatgtgcgccgggatttgcacaaaaccaccatctcggacctggcttactgcgaggaagtagaggcaatggtgacagcttcccgggacagcaccgtgaaggtgtgggaggctgactggcagatccggatggtgttcgtgggccacacaggcccggtgacggctatgactgtgctcccgaacacgaccctggtgttgtcggcctcgcaggacgggacgctacgcacctgggacctgcaggcggcggcgcaggtgggcgaggtagcgctgggcttctggggccaggacaagctgtcccggcgcgtgggccgtctgctggcgccggtgcgcccgggctggccggtgctgtccctgtgcgcgagcagcatgcagctgtggcgcgtacgcgagctctactcgccgttggcgcaactgcccgccaaggtgctccacgtgcagttggcgcccgcgttgcccgcgcctgcgcaccagtcgctgcctacgcgcctcgtgtgcgcgtgcgccgacggctcggtctacctcctgtcggctgccaccgggcgcatagtgagctcactgctgctggagccggaggactgcgcggcagccgtggcctactgcctgccgcgcgaggcgctgtggctgctgaccagggctgggcacctggtccgcgccaacgcggcgcgctgccccatgagcgtgctgcaccgcgtgtgcccgccgccgccccctgcgccgcagccttgctgtctgcacctgtacagccacctcacggatctcggaggcgccttctcctcctgggagatcgtgcgccagcactggggcgagttgcgctgcagctctgtggcctgcgcctggaagaacaagaaccggtacctgccagtggtggggcacacggacggcacgctgtcggtgctggagtggctctcgtcgaagactgtcttccaaacggaggcgcacagcccgggcccggttgtcgccatcgcatccacctggaacagcattgtgtcttcgggtggggacctgacggtgaagatgtggcgcgtcttcccctatgccgaagagagcctgagcctgctgcgcaccttctcctgctgctacccggccgtggcgctctgtgcgctaggcagacgcgtcaccgcgggctttgaggacccagacagcgctacctacggcctggtgcagtttggcctgggcgacagtccgcgattagaccaccggccccaggacgaccccacggaccacatcactggcctgtgctgctgccccacgctcaaactgtatgcctgctccagcctggactgcaccgttcgcatctggactgctgagaaccgcctcctgcggctcctgcagctgaatggtgcccctcaggccctggctttctgcagcaacagtggagacctggtgctggcgctgggatcccgcctctgcctggtgtcccacaggctctacctgcctacatcctacctagttaagaagatgtgccggaaggccccagacgtggtggacgaccctccgctgccactgatgagccaggagtcactgacttccgcccaactgcagaggctcaccaacctccatggggcagccagcctcaggtcccatggaggcctgctcagccctcctggaggccctcctttcccactctgggtgggggcctggcggtgtggggccctctggagttgatacaagcctgcctgagccctggcacacccgtttggggttggtccttgtcccagcctctgccccagcccactggcatgccacccagcatcccacctgtgcctgtccctgtttgcagcgaggccttgtctctcatccatcgtcggagggcaacatctcagcacctggtgccgaaggaggacttggacgccatagtggcccgggaccgagaccttcagcagttgaggctggggctagtggtcccagcagcccagcccccaccctcctggcagcagcgccaggaaggctttgacaattacctccgtctgatctacggctctggcctgctgggcatgcagtctggaagggggtcccagcagtggagtgccgggaccctcagagtggagagagagacccgggatgtgtgtgctgtaccccaagctgcccactgtcttgcccgggctgaggtcagcactgcagcccaaacagtgccaacagccctgtccccacaggacctgggagccctgggccagcacttctcccagtctccccgagtcacagtgccgatcccacccacccaccgtagggtgcacagcaaggcatcccagcttctggcccgctcctcactgagccactacctgggcatcagtctggatctgcagctgcagttggagcagctccgagggaggacgaccatggccctggacctgccatcctcccacttgcagtgcaggatcccactgctgccaaagagatgggacaaggaacctctctctagcctcaggggcttctttcctgccaccgtgcagccccacaaggtgagaccccctcccagctcctggagagccactcctctccaggcatcactcttgtgcctgccatctcccctttgctacaaatctttgtgtccaaatctgacccaagggccatgcccacctacaaccagagggccaggctgtagcctcccacgcacccctcacccctcacccttcaccctctgtctagccctgttccagtacagctgtgtttgtggccacaggctccttgctgctctgggagctgacatcaggcaaagccagtccccccagccggttatgccacacacccctttcccccgtggaggcgctgggagggcaggtcccctagggacttttcctggaagatcagaatccctgccctttagaggagcaaagtcaagggaacctggccctttagaatccactgtcttcccaccctcacgtacaccaggtgcccaggcaggcctcagcccctcccccagcatattcctggcactgtcacctgcccacgtgggtaattgactctttgggcctgggtgccaccatcatgctcttcattgccctttctccaagctccttccttcctccctggcccctgtgcttcttttagactttcttgtcccagggctggggccaagtcctgtaaggagcttgcagggtgtcagggcccctacaagccagcacttctccaggtttcccttctcgtttgtcagagctgatgctcactgagggcctcgcccctggtatctcagggttctcctgccatctgtgttgagagtaggggttgctagctcagccagctctcggaggcctggcaggcagagctggactggcggctgaggggctctgagaggttatacaggtgaccaagggtggtgtccaggctgggggaatccaggtcctcagcattccctgctgtgcccacctccagcactgcctgaggcccatctgcttccccggctatgtgcccaactccgcggtgctacagcagatgtggctaaatgcggaggtcagcagcctcggatccccgactcagctcgcctcccagagaaagctcgaggcaaggggcagggctgggggttttgccggcaggggagggctctgctgtccttgcaacccatcaggcaccatctcttgcccctctgcagccaggggcaagccaggatgccctgtggttgtggcgccccaggccatcccaagcccagtggcagaggaagctgctccaatggatgggggagaagcctggggaggagggggaggaagacaagaaggaagaggaggaggagaaggaagacgaggagctggactgggccttggcttccctgagcccgcactccaaccagcagctggattcctgggaactggaggatcagagtgctgtggactggacccaggagccccggcggcgcagctgcaaggttgccaggacccaccctcatccctggcaccgtcatgggagtttgctcttggatgagcattacgggcatctgcccaagtttctgcatttcttcatctaccagacctggttcaaaaagttgttccccatcttcagcctgcaggttggagggaactggggatgcatgagaagcatgggttagggtgagggacaggggagaaggtaggggctggcttgggtgtgacatgggagcagggcctcagcatgctaccctgcaggcatacccggaggcgggcacgatcgagggcctggcctcgctgttggtggccctgctggagaagaccacgtgggtcgaccgtgtgcacatcctgcaggtgctactgagactgctgcccaacatgagcagtgatctccaaggccagctgcagggcctgctcgtacacttgctcaacctggaccagccccccagcctccaggaccagacacagaagaagttcgtgatactggcgctgcagctgctcctggcctgctccctggagtcccgggatgtggtgctggagctcatgtcctacttcctctactctcccgtgcactgccggccagagctcaagaagctgctgcacgggctgggccttcaggacccagagggcttcctattcaaggagatgatgacctgggtccagggcccagacctggactccaaggccggcctgcgcacttgctgccaccagaaactggaggacatgatccaggagcttcaggagaccccancgcagacgtcagtggtctctggggcacccacacgcgcctccgtgataccctcgggcacctcctggtcggcctccggcatcttcgggaggctctcgcaggtctcagaggtgcctttgatggtggtctcacctgcggagccgcactctttagccccggagctccaggcccagcggatgctggcacccacgcgcagctgggggacccctcagctccgtctcagagtgctctccgagacgctgaagagcttctgcctggagcccgaggcccgcctgcaccctgccgggcctgctcagctgcccggagagccgccgccgctggaggagaccgactggtcgcactcgcagctgctggacttgggccccatcgacgcgctcaacttcttctgtgagcagctgcgggcgcagcagcggagttcgctccaggagaaggctgcgcacccacacccgccagtgccctacacggtggcgccggtgcccgacatggtggtgccacctccgcgggagcactggtaccaccccatcctccggctgcaggaggccaagccgcagaggtccgcgaggtccgcgatgagactgaggggccccatgccgtcccggctctgtgcgggccgcaccctggacggccccatccggacgctgaagctgccgttgccgcgtgtggagccgcagcctttccccctggactggcctatgcccccgcgcccgctgcccccgcggctcctgcagccggccctgcagcgctactttctgccagcggacgcggaccctgacacctacagctgaccgggctggtggcctcagcccgcctggctctggggcctgtcattggtatttggccaaggcctgcatcgggaataaagtccagagaatttc

SEQ ID NO: 727156 - DNA, 145 bp, Homo sapiens
tgagctcggtcctcagtacatggaggatgagcgccttaggatctctttggcaagtttgggcctgccttaagtgtgaaagttatgactgatgaaagtggaaaatcccaaaggagtgggatttgtaagctttgaaaggcatgtaaga

SEQ ID NO: 727157 - DNA, 429 bp, Homo sapiens
ctgggtctatgcatcattaatatgtatatgcccgtgttattgcctcttgtgtgatctgtaagaaaggctattgctattgattcatcatcagattaatctcttatgttgtatctttatcagtggcaatattttgttcatatattcctgtggaattaaggcttgatataaacccttgtaaaggttttttgttccttcccaatagcaataataatcaagaatcaatgtgtatctcatgcatactgtcgcaagaaaaaatataagtattatattaaaaccattctatattgtgacaaatgttcaaaataaaaaatggttgtaattgttgtgattttattttttaaatcaaccaaattattgatttcttaatggttttgaaggtaactattagtattgtgttgtctaaaaaataaatataaaaattaaagttga

SEQ ID NO: 727158 - DNA, 102 bp, Homo sapiens
aaccttccatgtgtgtgggagggactgtgtgggagatgattgaatacggggcggtttccccacactgcctcgtggcacgaggatggggatctctagagtcga

SEQ ID NO: 727159 - DNA, 209 bp, Homo sapiens
catgtaatcacgtttggaataccatgcaacacaagtcagcaaggacaggagtcggtccaaaggagccagctagggggaaaggtgacagacacggacacgcacgcgctggcgaccgacctcgcctgtggtctctaagggggccatgtggttaatttataaggtttcctccccacaggagttctgactgtgctctggaggtacttggcata

SEQ ID NO: 727160 - DNA, 113 bp, Homo sapiens
ctatcgtgtcatggagatgagagtatggggatggcttaggttttggctgggtgtcagaggttaagataagaggtgtcatgacatgatggacttacgaggcagagaacagacag

SEQ ID NO: 727161 - DNA, 157 bp, Homo sapiens
gtttatcctgctcagctcctgggtagctgggattcaccaggcgctcgcccacacgcctggataattgtggtactatatagtacgcgccgcggtttcaccactgttgtgcaggctggtctccaacctcctgacctagtgatctgctcgccttgacctc

SEQ ID NO: 727162 - DNA, 281 bp, Homo sapiens
ataagtgaccaaggcccaagacacattccccaggagtgtctgagaacacgtacccaaggtggttggttacagcttgattttatacattttagggggacagaagcttcaatcagacatcaatcaatacatgtaagatgcgcattgcttcggtctgaagagttggaacaactcaaagtgcaggcttcaaggtcataagtggattcagagattttctgattggcaattggttgaaagagttaagtaattatctaaagacctagaatcaataaatagaaaggagt

SEQ ID NO: 727163 - DNA, 558 bp, Homo sapiens
  misc_feature (131)..(131): n is a, c, g, or t
  misc_feature (175)..(176): n is a, c, g, or t
  misc_feature (178)..(178): n is a, c, g, or t
  misc_feature (197)..(197): n is a, c, g, or t
aaatgtccacttttcagataatataatgcctaccattatactaacagaatcatatggtaggtgatttatttgtttattcattatgtatacctgtgggattgcgggttcttgacgctatgataaaaacactnaatgtattctgacatgagtgctctaatagcctccttctcctcanngntaaactgcatacattactntcaaaataggtataatattctgtccgcctttgagctattacctgttcctgtttccctttgtcacctaagcaaggctttttctgagaaagtagggaatggtttcaaatgttgcatactataagaataatcattgggtaactgttgtttagaccaacacttagaaatactctatttgcgccttctcattcttaatcttaatgagtgttgatatgtggagcacaaataatgaaggtgccactatatggcttgccaaagttacctccttgaatagacatggggcattgacttggataggtcactggtgaaccttgcttgaaaaaaggaccccctccccttggggttttcgcttgagtaactgcgt

SEQ ID NO: 727164 - DNA, 140 bp, Homo sapiens
gccagccggcgccatcacgcgggagtcatacccgtccatttcgatccaggcctgcccatccaggcgccgaatgcccaatgcgtcctggccggtggccgcaacgggggcctggctttgaaacggcgtcaaatcgagttgcc

SEQ ID NO: 727165 - DNA, 433 bp, Homo sapiens
tttcaataatcctgcttgatgaagctaaatgtagataaaaaaaaaattgcaaagctagttagaaacatgctccataaaggcaatacttttcacaaatttgcttttcactagctacaagctaaaccgtaaccatcgtccatgatgagaatgtgagtacatttttatttacgcataattttaatataattttaaaaaataacaggcaaatgaatgtggctgacatctgggaagtattaatatagttgaatgctaagttaggtctgaacatcctgacagctaggacaaaaatatataggatttgttttgatcttatccaatgagaccaattttcctataaacaagacaagttttatccttaaattcaagggagaactgattgtgtaagctcctaaaacaatgtaaaataaaacaaaacgaagttaaaacaatgaaa

SEQ ID NO: 727166 - DNA, 1192 bp, Homo sapiens
acaaatactaggacacaggagcatgaatgttacattctctagtgcgcttcacctagtttaactagggcaggggggctacgaatagttatcaagtgatatcactcgtgtgataggtgctaagaagagccgatggcacagagtctctgaggcacatagggaaaactcttggtacagtacacgatggggaccacagtgtcatgcggaaatagtgtcagggcaggctccttagtagatcgagggagtgctagcagctgagtcttgagtatgtagctcttgcatagtgtaagagctatgaggcgaagtggaggcgatacaatagtatggctactttgaccagataatgatcagtgtggaatggttggatggtagaggtgttagtgttgggagatgcagtcatagggtagcagctgcataagattctaaggggttaaggtatgaatcattaagtggtgatggagaatcactggttgtttgcttaaggtatagtctgctagtttgatgtttcctatgaaagcaggttctcacttgtcattgcgccaggtctggcagtgcaggtggctcgatcgtgattcacgtgcattctcgagttctctgggctcaggtgattgtcccacccttggcctctggcaatacttggtaccaataggcatgcaccaagctaagactgggtcgtatgggtacgaagacgacagaagtctcactatgttgcccaaggctggcatcaattctgggctcaagcaagtccttcaaccttgggctcccaaagtgcatgggataccaggcatgaagccattcataatggctcggaagatacattggaaaacatgaaataccattggaagcttgatcaaacagaagataggcaacaacatgaacgacacaacagttaggagagaacaaagagaaagagatggaaaccgctaatgagcgagaggtaggcctgccgcagaacaagggcggaatgaaaccacaacggacaagaaagaagaacagaaagagagcaaagaaaacgagaacaaagggtgaggataccacaatccacagaaagataaccaatatgaacaacgtgcaacaccaaccacaacctacgaaagcaacgatacaaagaagacaaaaagaggcagagaaccaacaaacagacaccaagcagaagcggagaccagcagcagcgcgactcctcagaggccgacct

SEQ ID NO: 727167 - DNA, 431 bp, Homo sapiens
gatagatagggtggttgcgagtggtaaatgagttgacgcaggcgtccgagtagcttagttgtggcaagtaaaaatgattaaggatactagtataagagatcaggttcgtccttaagtgttgtgtatggctatgatttgtctgggttttttctttcttttcaagtttcagtgatttataatcaaagtatagtgtgatagcagtttgattttgctcaggttcttttactttcttttaggaaataggagatgattatgcattctttggctgaggtgaagagaactcagacataacattggagttactgtatcttggcacttaatctctaggttccctagattttttttttgtttttttttttgaatccttagtccccttttccaaacttttcttccggggcatggggacgccaattttctcccggagacacatc

SEQ ID NO: 727168 - DNA, 272 bp, Homo sapiens
ttttggaagttaaaatttaaatggcttttgccccaaacaatagattttcatatgggtgaggggaattccatgtggatatcagttccccaacattacaaaaaaattttatggcccaaaatgaccaacgaaattgttacaaaagaatttatccaattttgatctttttaaatttttttaccccccctggaaacagaccaaaaaacattttggggttttaaaatgggaatttgtataaagcattactttttttcaaaaaattgttttttaattta

SEQ ID NO: 727169 - DNA, 199 bp, Homo sapiens
  misc_feature (58)..(58): n is a, c, g, or t
  misc_feature (60)..(60): n is a, c, g, or t
  misc_feature (75)..(75): n is a, c, g, or t
  misc_feature (124)..(124): n is a, c, g, or t
  misc_feature (156)..(156): n is a, c, g, or t
agcactgcctccctgtgtgactggagaagaggacgttgtcacagataaagagccaggntnaccagctcctgacgnatgcatcatgaccatgagacacaactggacaccagacctcagccctttntgggtcctgctcctgtgtgcccacgtcgtcantctcctggtcagagccacaactgttttgcagacccaccaaaag

SEQ ID NO: 727170 - DNA, 264 bp, Homo sapiens
aaggagagcccacggaggtgtgagtacgagagagagctccttgtcctacattcgttgagaatggtcttggcctatgccttatggggggggccgttgtgggcggagtgagccgcctaaaaccatgttcctcaaagatcatttgttgcccaacactgggttgctgaccagaagtgccaggaagctgaataccatttccagtgtcatacccagggtgggtgacgaaaggggtcttttgaactgtggaaggaacatccaagatctctg

SEQ ID NO: 727171 - DNA, 472 bp, Homo sapiens
ttatgggattcaaagctctaagcagatccgtcaaaagggggtgcgtggcagacgctcagttaagcaaatgctgagagtcagaagggcagtgaagctggcagccactgtttccattccagttttcagccgctgcctgtctccagcaaagcttcactaagtaattttctgagaacaaaagagattgaaactttctcctcaaatcgcctggtgtggtcgaatactcctgtttggtttggttctgcttgtgctccctctcgtctcgtaggtccactgtgataccgtgataaccatcggagggcggccattaagcggctttgcagtattctgaaaatcttttacagaagcagctgcttggtatttcgataacttgaccccactgttctcttggcttagctatggttctaaactttattgtaagtaaacattttaaagaaaaactgacgcttgttttcaaggaaaatcatacataaag

SEQ ID NO: 727172 - DNA, 335 bp, Homo sapiens; identical to SEQ ID NO: 710916
  misc_feature (25)..(25): n is a, c, g, or t

SEQ ID NO: 727173 - DNA, 266 bp, Homo sapiens
  misc_feature (76)..(76): n is a, c, g, or t
  misc_feature (110)..(110): n is a, c, g, or t
  misc_feature (121)..(121): n is a, c, g, or t
  misc_feature (183)..(183): n is a, c, g, or t
cccgagttccttcaaagtgtcctaaaagaccccctccccaggtgtggatccccaccaataaagccatttaaaatgntatgggctccctggcctcccaggcccccaaggcnggcaaaaaggncaaaaaggaggaagccaaaaagttagactggagggaaagggtagcttagtctgcttaggggnctgcatgggaagcccggaatatagggttaaatgtgtgttatctgtaaccattacagcctaaataaagcttggcacctttttta

SEQ ID NO: 727174 - DNA, 392 bp, Homo sapiens
gaacggacctaacaggactctgctgaaggcaggccatggtgatcagactttacccggggatgatggaggacaaggaacctgatcagatatcacggtgatcagataccacatcaccagaggcatgatggaggatgaggaactcaatcagatatcaagggtgatcagtatcaatggtgcaggattctggataaactgacttagcaggattagacaatgtgcagagataaacacagaagcccaaaaatcagggcttgagaagagttcagggagcatgagtagagttcggtcgagaaaatcttggtcaatagcagtcctgcttttttttttattcttttcgtgggatacaaagtttccctctggtggcccaggcgggagtacaggggggcgatctc

SEQ ID NO: 727175 - DNA, 563 bp, Homo sapiens
ggccgtggaggagccggatgctgagccgggaagcaggaagaagactggaggagccgggcgatagttagcaggtgcaatgccgcggctactctccctcgtagcgctccaatcgtgcgcctgtcatcgctgctcttcctcctggtgcgcaataccgaagaaggtgtgcccatgaggataacggaagttcctgatctaatgagcacactcctttgtatcagcggccacgagaagagaacggactgcgaggcgccatggaggctcatgggaaggagaacgcccatgggccggagcaaggatgtgcgtgggcgcggtgagcccttctagttctgttgtcgtgaaccgcgaatccagcactcctgtatccctcactgggtcaccgcccggtgcgatgagctggacacggaagtactgcgaggccatcttgtccgggatggacggctctaacatgaaataatgcttggaatatgctgtgtatggtgaaaggatccccttctgctccggacgcatcttggtggcgccttgacctgggggtgggctcccgcgtgcagcccagggcgaggatt

SEQ ID NO: 727176 - DNA, 194 bp, Homo sapiens
ccaatgcacctttgaaacagctcctgttgacaccagcacacctgtgaccaatttttccgaagcccgttcatctcctacaactggtgaaggtaccagcatgccaacctcaactcctagtgaaggaagcactcgattcacaagtatgcctgtcagcaccatgccggtagttactcctgaggctagcaccctttcag

SEQ ID NO: 727177 - DNA, 361 bp, Homo sapiens
  misc_feature (347)..(347): n is a, c, g, or t
  misc_feature (352)..(352): n is a, c, g, or t
caacgaccgaggcgatgacggcgacccgcaggctcatgctctttttcattggtgctggacgcgtgtggtgaactcctgccgatcttaagccaatgggcttgcgtcacgcaattgatcgggtatcgtcccgattgaccggcacgcgtgaaagaggtgcgccccgttcacccgtcgaccggcttcatcgtcctcaggcaatccgccgccagttgctgataaatccgcgtgcctttcgccttcgcttcgatctccgcgtcgctcagccgccgcacgacgcgccccggcatgcccgcgagcagcacgccgcgcgcacgttcgttaaccggcctttcacaaacgcggcaggnggcgnacgattcgt

SEQ ID NO: 727178 - DNA, 349 bp, Homo sapiens
acctgcagggattggggctctctctggtttgttcgcctaactcccgcctcaaaggccacgaatttcttgaaaccaggtaaccgaccaaaacctaatgtgcatcagtaacattaacatttatctactgccccgactctctggcttgccactacctactggtgtccagttgcagacagactaaaatgcactgacggactcttaggattgctgcctcctaagttatcaaagcctccctctgttgatgtgaatgaggaactgcttggttgttaaaggacattttgctccctgctggcccaaacaggtccttatctaggtttgctccccactgccccaaacaggtctggcagga

SEQ ID NO: 727179 - DNA, 231 bp, Homo sapiens
gtgcctagagggctttccccgtacgccaaaccaacagaatatactttcttctcatcatcacatggcacatactctaaaattgcccacataattggatataaaacaatcctcaagaaaagtaaaagaaccaaaatcataccagacacaagcttggaccacagcacaataaaaatagaagtcaagactatgaaaattgctcaaaaacatgcaattatattgggcgtacgggga

SEQ ID NO: 727180 - DNA, 481 bp, Homo sapiens
tgggaaagacccactcctcccattcatgataaggtaatgctatccaataaaaaccccaaagcaggcataaaatatgaagtagcgaaactcaggcaggcagaaagcagagtggtttagacatggctgctgtctgcagcagggagaagttcctggcaacatgaccctgaaaataacaatgagtgactgaagctaagaaggaagaatcttccaaggactctgaaactagatattttctcaagccccacctatggacaaacacaaatcatggagaaataaagatgccagtctccaggaagcaccagagttaaattcattctggaatttaactcctggcattaacggttagctgggagattaaaacaaaccaacacacaaacacaaaaaaataatcagtggaaaaaagttaaaaaaaatcaatggacagtggtttcatagcagatggcaaagaggaatattaaaagctgtattttatttgaaaatc

SEQ ID NO: 727181 - DNA, 622 bp, Homo sapiens
cgaacgggtagatagaagaaggcagtcatcgataccagctacgagccatgtgaccagcttgcagaaacgaggactgtaattgtcgtgaggtatttcctccttcttttaaaaacatggccaggtgctgtggctcacgactgtaatcccagcattttgggaggccgaggcgggaggatcacttgaggtcaggagctcaagaccagcctgacccacgtggtgaaaccccatctctacttaaaatagaaaaattagctgggtatggtggtgcacacctgtaatctcagctactcaggaggctgaggcaggataatcacttgaactcgggacgtggaggttgcggtgagacaaaatcacaccaccacacttcagcctcggcaacagagggagactctgtcttaaaaagcacacaaacaaaaaacaatcaaaaatgtttgtgcatgtatacacttgtactaacaaaaatgagttcattttatttcctttctcttttatcaagtgacataagatttattgaattcacaccagcatttaagtatcgttaactttatataatagtatttgggtaggggataggtgagtttctggtcgtatgaagtatagttatgtagggtgtaatatgatc

SEQ ID NO: 727182 - DNA, 125 bp, Homo sapiens
tggagtcggtaccagaactcaaatttcaggagggtcccacaaatttccagactgataaaagtggctcaatgtgcctaaactgttcatacaaacaatttggtttatcataaacacctgtttccttc

SEQ ID NO: 727183 - DNA, 1285 bp, Homo sapiens
gcttgtccattcagtgttaatcccatcaccatcttccaggagcgagatccctccaatattcaagctggggacgatgtctaggacgcgtgagtacgtcagtggagtccagcatggacgtgcttcacctaccgatggcatgcaaggcgtgggtggctacattatgctagggcgggtagccataagagggtcatcatctctgcccccttctgcatgcatgcccccaatgtatcgtccatgggtgtgaacctatgaagaaagtatgcactaacagccttcaagatcatcagacaaagtgacactacactgcgacacaccaatcatgctatagcaacgccctgtgcacaacgtgtcaatccatgactaactattaggatattcgtggacaggactcatgtacccacgaagtaccatagcacatacatctgacacaccaggatagactgtgaagatggtgcccttccggagaaactagatgcgccggtgatgagcccagcagggggtctgactaccagacaacatacattccctgacactactacatgtgcgctgaccaaggctgatggggcaacgggtcaatcccttgcagctgcagacgtggacagctccactgagcatgggccttgtcacgatgtccaccaacgtgccaaaaatgtgatcgagtaggtgtgaccgtgcatcatgccgttctagcaaaaatctggcaaaatatgatgcacatcacggaaagagtgagtgaaagcacgggcgtcaggaaggaaccgcccgtcaaggggcaatcctgggctaccactgcagccacacaggatggaaccacctcatgacacacagaagaggaaaaccaatcacacaacaaccttatgaccgcacagggagaggagaaggccatcaaaagaacacagacggacaagagccatcacccgtggagaggacgaggaaacaagggcacagcagaaaaggaaggaggcacaaacaaggcgccaacgagccgatcgaagcaagaagaacacgtgaccgaaggcgccgagagaaaacaagaagagacacaagcaacaggaagggagggagaccgggagcgagcacgcccgcacacgaaagaccacggaggggcgcgagatcgacaaagagaaggagacgaacgacagaagaaaagagcgaacaccagccagcaagacgagacgggaccgagagggcaagcagccggcgcggcgaaaggaggtgacggagcgagaagaacggaagcacgaagaaagaagatagacacgatcagaggagaggagagcagcag

SEQ ID NO: 727184 - DNA, 949 bp, Homo sapiens
  misc_feature (197)..(197): n is a, c, g, or t
  misc_feature (221)..(221): n is a, c, g, or t
  misc_feature (452)..(452): n is a, c, g, or t
  misc_feature (502)..(502): n is a, c, g, or t
  misc_feature (603)..(603): n is a, c, g, or t
  misc_feature (656)..(656): n is a, c, g, or t
tgcctggtttaccgagctgagacccagacataccagctcttataacaatagactcggcttaaacgagaatgatctatcgtgctcctgtggtccggcaggcccaacagtgctccaagcataattagtagtaggaagccactgggctggtgccgtggcgcggttcttgataccacactatgaatataacactcgccacntggaagctgcgcacagaactaganacactacagacatcactgtcgaacgccttgcgtgaagaactagtataacaagaatctggacggcactcctatgagaactagagctaggagtctcagtgactatagtatgtgaatcgagcgcagacaacaccacattacttgttgtcctcgtgttgattacgcatgcgtctgttcccatagaatacgcaaaccacatagtatgcaaagcgtttatacttgagggcacgcacnacgaaagctccttcttagacaacacttctatagtgatagtattgacgctngctctagcgcgcatagagatggctaactagacatcatcttggaagcatcatagtgacacaaatactcttgatatcaagagcagtgtagcaatgttgcatcnacctcattacacagggcactcagaagctacagcactcaatgcaagcatgagcngttacagagcatctaagacaccactcgcttcactcgattttctgaggtcccacgtgaagaccatgtagtacttttgtggcacgaattaaatagcattgcagtgctggcattttcagagcctcacttttgcgcacaattaccgcctctatttaggtggagtgcgtaattaccaatgtcacttgggccggtccgttttaaccaacggtctgtgatctggttataccccctggcggttacccaactttattagcctttgcaggaacataccccgtttcgccaggatggcgttaata

SEQ ID NO: 727185 - DNA, 704 bp, Homo sapiens
accaccatctgaaaatatatcatagtatattaatatatcaaaaatggcatatacaatataataataatattcaagcacaagctaaggaaagtaaagcatctaaaaatcatacatgttccaggatagctgctaagcggataaagaaaataatagtattatagaggacagcgattaaaaatgtagaaaaatactgtcttattagcaacttatcataacacatattacatttggaacccctgaagagcaataccatgtacttatttgtctgaataccatcaaacctaataaagtacatttaccaaaagtagacaataattgtttcccagataccccagtactgtatgcattggatatgtacaataaaaagttgctgatccattgaaagaaccaataaacaaatttaagtttgtagaatgatcagggtatgctcagccctgagacattataacaagaagacacaaaaaatcgaaaatacattcatcatccttcatatacaaaaccgtattaaatcaagtaatgaaaccagctaaaatgaattacatgcccacaggaaacataatgaagtgctcctgtgcattctaatataactgttctttcccatgtctcctacttgcgccaaatttcctccaaatctgcaccaaaattcttcataaggcaggtcgctataaatatatcaacctcatgagtcgtgagaatttacccta

SEQ ID NO: 727186 - DNA, 591 bp, Homo sapiens
  misc_feature (1)..(1): n is a, c, g, or t
  misc_feature (30)..(30): n is a, c, g, or t
  misc_feature (66)..(66): n is a, c, g, or t
  misc_feature (69)..(69): n is a, c, g, or t
  misc_feature (79)..(79): n is a, c, g, or t
  misc_feature (85)..(85): n is a, c, g, or t
  misc_feature (88)..(88): n is a, c, g, or t
  misc_feature (105)..(105): n is a, c, g, or t
  misc_feature (131)..(131): n is a, c, g, or t
  misc_feature (143)..(143): n is a, c, g, or t
  misc_feature (146)..(146): n is a, c, g, or t
  misc_feature (155)..(155): n is a, c, g, or t
  misc_feature (161)..(161): n is a, c, g, or t
  misc_feature (165)..(165): n is a, c, g, or t
  misc_feature (226)..(226): n is a, c, g, or t
  misc_feature (278)..(278): n is a, c, g, or t
  misc_feature (282)..(282): n is a, c, g, or t
  misc_feature (291)..(291): n is a, c, g, or t
  misc_feature (296)..(296): n is a, c, g, or t
  misc_feature (384)..(384): n is a, c, g, or t
  misc_feature (409)..(409): n is a, c, g, or t
  misc_feature (417)..(417): n is a, c, g, or t
  misc_feature (440)..(440): n is a, c, g, or t
  misc_feature (445)..(445): n is a, c, g, or t
  misc_feature (453)..(453): n is a, c, g, or t
  misc_feature (461)..(461): n is a, c, g, or t
  misc_feature (580)..(580): n is a, c, g, or t
ngttacggcagcccttttatttttccttanacaatgacgtgttgctggggcctaatgttctcacanaanagtagaaaancaaaanttnttgtcatctcttcaaanaatcgagaattgcgtacaaaaaaaancttacataaatnaanaatgaatanatttanaggngtaaatgcaaaccgcttccaactcaaagcaagtaacagcccacggtgttctggccaaaganatcagcaaagaaaggaaactgggtcctacggcttggactttccaaccctganaganccgcaaganaaaanaactggttcttgccagcctctagagaaatcccagaacactcagccctgacacgttaataccctgcacagatcagaggctgctggccanacagactcaccaagccacaaacttntcttccanaagcacgttcttaccttagccangaagnaccaagcnaaaagtantaaaggttgaactcaaagatatgtacagggtattaaacaaataccaaggggaacagttaacttcaatacaaggtcaaaatcagcaacaagttctacaatccagtgctgatatcagaaanaagcttcaagg

SEQ ID NO: 727187 - DNA, 730 bp, Homo sapiens
tattatagttccaaggggaactcaggggttaattatcgggctagcaaagggagggaccagtaacaacgtgccagaaggcctcagggactcagaagggaggcagcaggctaaaaggagccggtgaccacactttggggggcatgagatactcacataagacgtggtgcatacggcgcaccgtggcgcttgggggccaccgtggtcgtggagtgggcagtggtggcgctcaagcggggaggaaagagggtgcttacctcttcttagtgggtcccctcgtgtggtccgaggcgcacacaccagaagtctgtgggagcaacacacctggggggtgcgctccggagtattcccacaagtgctctcaacacaccgcagggggccccacgctatacacggggacatctctgtgggcagacacaacagcggggcatttcacacaaatatcaccgcgtggaggaaaccggggcgtctacaaggggaccacgggggggtatgtgtgcgatacagaagggcgcacatctgtggcacaagagaatcccgtgggccacttccacgtggttgtgagcccagcttcccacaaaaacacctcgtgggggaggagtccacggcggggtgatacccggggcacagacacgacaagagagttatgacccccaaagaaaagatttacggagaacacttaccgccatcccaccaaacgcgtcgtagggggacccacctctgagaaccatga

SEQ ID NO: 727188 - DNA, 125 bp, Homo sapiens
cgcagtggggttggggtatttcgttaaatgttagtaagggtagggaaacgaggttgacctgttagggtgaaaagaattattcgaatgctatatggcttgtcagggaggtagcgatgaaagtaata

SEQ ID NO: 727189 - DNA, 119 bp, Homo sapiens
actcatcacgctctcatggcaagaatttgagaaagtacatatatactcaggttctaattttaatagggaaggaaaaagttacagctcagtgcaccatgaagttgaggcagagatggaga

SEQ ID NO: 727190 - DNA, 408 bp, Homo sapiens
ggtatccccagctgcggggggggtcccagacattctgcagttccctgttattcataaaaaactccacccacagtgtgcggagagacttattaggttatggtacacgaggtccctacgggcaggaaattgaagtgcaggttttcgactaggatccagatcaagatcactttcttgggcagaatgaagctggatgtatggaatgtgttacaggctagcgttctggattattggttccctctactacggtgggcaaggccaagtttcacttgcacgtgctcacgaactggctgtcacttttgtccgcatgcagatgatcctggtgcaggttctactgtgaacatcggggagtctcctctctaccagatcccccgtctgttgccctctttagttgtctacctccgatcgggg

SEQ ID NO: 727191 - DNA, 138 bp, Homo sapiens
  misc_feature (60)..(60): n is a, c, g, or t
  misc_feature (74)..(74): n is a, c, g, or t
  misc_feature (135)..(135): n is a, c, g, or t
gagcccccacatggtgctggatggctcgcagcgccgctgtcattctaacgagagccaganccatcgatgacaanctgggagtgtgctggcaggaagtgggggctgacctcgtgtgcagccaccctcgggtggacngtt

SEQ ID NO: 727192 - DNA, 263 bp, Homo sapiens
gccaagcagtcatataatgaaccagtaagggtcatcttgaagactttggaagccaaccattttccctttagccttttcatagtcttttttgtactgaatgtcactcgccgcctgcctaagcagcatttggcagctctaatgggaatcgcatcagttctcaggtcatatcccttcttgctcaagtctttcaagtctgctttgtacatattctcactgatattgtaggcattaactttagcctggatgaactgcttgggctgttt

SEQ ID NO: 727193 - DNA, 229 bp, Homo sapiens
tactggcctgcaggaggagagtcgctacctacgggctgtcttagccaacgagactggactggactcgcttgctgagccgggtgagcggcgtgggatctgcgtgttgagccacctcgcttcttcagagactcgcgccgccggatggccacgtactagcgctctgtccggctgggcaaagcaggaaggcagcgacctggctggatagacggacgatctcggccggtggagg

SEQ ID NO: 727194 - DNA, 860 bp, Homo sapiens
aaacttgcgtatatagactactagttctgggcttgatgtctgcatttaatactccgtgattgtaaatcagtccctgtttctcaaaacctcaatttcctgatttatgaggtaggaagctgtgagaattaaaggagataaaacattttgtgtagtgtctggtgtagagtggaccgttcaataagtgttaccttttgttataatcagatgctaattatatattaatagtctataatcctttgtaattagatttttgtgtaattttttaattagatgtaatgttttgtaattatatatattttataatgagatgtgttttggatcataagtcctctgggagtcagaagaaaaatatacttttcacagagtagggtaagatatgaaccaagccctaaatgacaggtgtgattcgttaaccatgagaaaggaagggaggctcttcaaagccaaaagccaaaactgcacctggcgtgggagcttctaaacccgcgatctttgtgagactgaagggacacaggcctgaacagaacctgtgcttcggggagcagtggggagaacagagcatctcagaggcttgtttcaccctctagtgtaagtcttctgtgccttttctgttctaaagaaacttttggaattgctacctgcttattgtatttttttggtctctttaaactgctctgacaagttcaatacaacatttcccacttaaaaaaaataggcagtatgaatatcacacaaagagcagtggatgagcctttaaatatcaggcaaaataaacagaccagaaaaatatggacattctagaagctgaggcattttttaaatagctgttttgtttttataattactttgtttggataaat

SEQ ID NO: 727195 - DNA, 158 bp, Homo sapiens
  misc_feature (8)..(8): n is a, c, g, or t
  misc_feature (52)..(52): n is a, c, g, or t
  misc_feature (55)..(55): n is a, c, g, or t
  misc_feature (147)..(147): n is a, c, g, or t
gcgtcagnacggtcgtggggacatcggaagatgtgattgggtgtagtgcacnacnaacgtacagtttgttctgattgcgtggatgtatcttggagcgagttgcggacgtataatcgaatgcgggaagtgatctggcaatttcatcangcccgaggagc

SEQ ID NO: 727196 - DNA, 460 bp, Homo sapiens
gagtgtcttcaagataagccaaagctgcaaatctatagtaaagaaaacagccaggcatggggtggctcacggctgtaatctcagcactttgggaagctgaagcaggtggatcaccagagatgaggagttcaagaccagcctggccaacatggtgaaaccccatttttactaaaaatacaaaaaatttagctgggcatggtggtgcggttactgtagtctcagctatcatccggaaaactgaggcaggagaatcacttgaacctgggaggtagaggttgcagtgagccgagactgctccactgcactccagcctgggcaaaacagcgacacttggtctcaaaaaaaattaattataaaaaatatgctttgtgttgatagtgacatcttcctataaaaagtaccatgtactctcatcattcaggggcgcatttgtatgccatcttgaagaacactcgggtac

SEQ ID NO: 727197 - DNA, 114 bp, Homo sapiens
catagtgataacgccctgcctcacatgatcatcagaacatgcatattaccatcacaatgagataccatcttaagccagtaagactggctattattcaaaagcctgaacacaatg

SEQ ID NO: 727198 - DNA, 1596 bp, Homo sapiens
gaggttccagccggagcggtaactgggcgcaggtcccagccgccgcactaaacccggcccgtgcggtgattggacgcaggccccgggccgcggcggaggcgggcgatccgaaagaggctggtgctggctgcatggggaggcggcggcagcgggtggaccccgcggctggggcccgggccggggccctgcctgaggccatcgccgcgttgagtcggtcgctgccctcgggacccagccccgagatcttccgccgcgccaagttcgaccgtccggaggcgacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgcc

SEQ ID NO: 727199 - DNA, 1540 bp, Homo sapiens
gaggttccagccggagcggtaactgggcgcaggtcccagccgccgcactaaacccggcccgtgcggtgattggacgcaggccccgggccgcggcggaggcgggcgatccgaaagaggctggtgctggctgcatggggaggcggcggcagcgggtggaccccgcggctggggcccgggccggggccctgcctgaggccatcgccgcgttgagtcggtcgctgccctcgggacccagccccgagatcttccgccgcgccaagttcgaccgtccggaggcgacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccaggatccacctgtacacacgcggctgccacagcgaccagagccttagccatctgtctgtcactgaagcagagatgctcagggacccagagggaggccagcagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgcc

SEQ ID NO: 727200 - DNA, 1499 bp, Homo sapiens
gaggttccagccggagcggtaactgggcgcaggtcccagccgccgcactaaacccggcccgtgcggtgattggacgcaggccccgggccgcggcggaggcgggcgatccgaaagaggctggtgctggctgcatggggaggcggcggcagcgggtggaccccgcggctggggcccgggccggggccctgcctgaggccatcgccgcgttgagtcggtcgctgccctcgggacccagccccgagatcttccgccgcgccaagttcgaccgtccggaggcgacctccgcgctctggcagctcctcttccgtgtgctctcgccactccctgcgggcaacgccttggcatcgctcgccctggggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccaggatccacctgtacacacgcggctgccacagcgaccagagccttagccatctgtctgtcactgaagcagagatgctcagggacccagagggaggccagcagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgcc

SEQ ID NO: 727201 - DNA, 107 bp, Homo sapiens
gctggatataatacacatctgtcgaaatacttataaaggccatcaattttgatcgaagctcccgactcatgacggatttgtttactccgctgaccaccttcgtactg

SEQ ID NO: 727202 - DNA, 462 bp, Homo sapiens
  misc_feature (35)..(35): n is a, c, g, or t
ggatgtacataaagatagaatatgtaacttgaagnacaagaggaaaaaagttaaaatgaataaggccccagagaaatgtcagacaccatttactgcaccaacatacccataatagaatagcagaaggtgaggcaaaagagaaagggacagaaaaaatattcaaagatataatacctgaaagcttccctaattttatggagaacattaacatacatccaagaaatgcaacaaactccatgtaggaaaaatgcaaagagaaccacactcagacatacagtcatgatgttgaaagccaaagatagaaaatcttgaaagcagtaaggtggaaacaactcatcaagtaaaagagaaccccaacaaaactatcagctgacttgttagaatagagaccattagatagtgaaatgacatgttcaaagtactgaaaatagcagaagtactgagaatagcagaaggtgagga

SEQ ID NO: 727203 - DNA, 200 bp, Homo sapiens
gcctttttttacccgccggaagctacagcttttgcccccccaaaaaaaccccacccttttacccaccgcggacccaaaaacagcaaaaaccaaggacctctcccaaccccaacccctcctttttggcccttccttccccccctcccagcccacccccagacacctcaatcccccaaaaggatgccctaaacctctcctaa

SEQ ID NO: 727204 - DNA, 181 bp, Homo sapiens
ctgtattctgtggtcgattctctacacggatcccctactactgtgcggctgtttgttgtcatcgcactccttatcggatcccgatgttccatggtcatcgctcctgctgtcgattcaatcaacacgcttttctggaggtctgatgagcgtcggcctccgctaaggagtgtgtcacaattca

SEQ ID NO: 727205 - DNA, 364 bp, Homo sapiens
gtcgactctaaatggatccccatagatggcccactgcactcctacattcctctgtagtagagacaacgtgttgtaatctcagtctgcctgtagggcgtgattctcagctcaccagactcaacttggagatcttacattgatagcgatcatgagacactgaacggagatgctacatattcctctcttgcagcaaaaggttttaaatgcgttcgactaaacctacatgataaaagatcaccaactcagagtccgatcacagtgaatggaaactcatgaggtgcctgtgagtctgataagtccctatcggaggccgttttccccctcggcatattctctcatttgcctctctcctgctttttttcct

SEQ ID NO: 727206 - DNA, 204 bp, Homo sapiens
gtgctgtcgatcttctgtgataggctcgaaggtgtgggtcgtttgggtaagcatcagtactccatggcagaccagccctctggggacaggtctgtatcatccagctttctaaggtttgggtggctggcctgtactttgcttcctgtatcttacttgtacttatagcttctttcactctgttgttggactgggtcgtgtactgtg

SEQ ID NO: 727207 - DNA, 310 bp, Homo sapiens
cccccaaatccccaaatttgggggccccggggggtttttttggggccccaaaccccaaaataggccccccttttgggtttttcggtttctatttaaccccccaaaaccaaaggtccccccggtttggggtggttttttaaaccctttttttcccttttttaggttttttttaaaaattttttagggggaattttttaaccgggggaccccccgaagggggttttttactggttccccccatttgggccaggattggggggttccccggggttccccccgggccaaaaggggggggaaaaaacctttttta

SEQ ID NO: 727208 - DNA, 256 bp, Homo sapiens
acctcctaccacgcataattctatgttaagcctaaacctcagtatgtcagaacttgactatgtttggagatagggcctttaaagagaggagagttaaaatgagatcattaggatatccctaatccaatctgacctgtgtccttataagaagaggaaatttagagtcacagccattcaggaatgtacatgtacagaggatagaccatgtgaagacacagtgaggaggtggccatctgcaagccgtggggtaggaggt

SEQ ID NO: 727209 - DNA, 1007 bp, Homo sapiens
  misc_feature (14)..(14): n is a, c, g, or t
  misc_feature (16)..(17): n is a, c, g, or t
  misc_feature (346)..(346): n is a, c, g, or t
  misc_feature (598)..(598): n is a, c, g, or t
  misc_feature (634)..(634): n is a, c, g, or t
  misc_feature (675)..(675): n is a, c, g, or t
  misc_feature (695)..(695): n is a, c, g, or t
  misc_feature (747)..(748): n is a, c, g, or t
  misc_feature (754)..(754): n is a, c, g, or t
  misc_feature (881)..(881): n is a, c, g, or t
gagataaggaaganannaaaataaagataattcgggagtacaattgacaaagcgtgtgggcgccagcctccagcagtaactgtgttccattcttggagggttccggtgagaagaacgcccctactgcggtatgaggacgcagagaatcggcccctggacatagacgaggtggaagcgcctgaggaagtgagtctggacccgaggagattcgagcagttctgccccggtcatcaacgagatgcgcgaggacatcgcgtctcttatacgcgagcacgggcgggcgtacctgcggaccaggagcaagctgtgggagatggacaatatgcttatccagatcaaaacgcangtggaggcctcggaggagagcgccctcaatcacgtgcagcacccgagtggcgaagccgacgagagagtgtcggagttgtgcgagaaggctgaggagaaagccaaggagattgcgaagatggcagagatgctggtcgagctcgtctggcgaatagagagaagcgagtcttcttgaaggaggagatccgtggtacggtcggaactatgctgagcttggatgaaactcagtagtcgccctaagcatgggtaaccngcgccctgtaaaaagtactgtctagggctgcatccnccactttatgcatcaaacattgagcattgggaacaaacgtngcggtcaagagggaaagaantgcgtgctggctttcggtagggccgtagtatacccgctttcttgttggcctnntccttnccacactgggtactatgagaaagataccaggtaccttcggtttacgttttgtgaaacataaaagccactctcataaggcagtcgccagagtagacctgctatgcactaaggagcttggggatgccantgagacctaggcctggagcacagtgtacgccgggagaaacctgggaaggagatgtagagtaaagcacaaggccttacctcgaattccaagatggtctatagaacaagtttgtcagagacccgggtt

SEQ ID NO: 727210 - DNA, 1156 bp, Homo sapiens
gagcggattcaccattttccatcgagaaacacagctttgcactggatgacgatattaaatcgaactcacttatgggaaattttgccctcggggccaggaatttcggcccgaggcccaaatttgagtggggagcaaaccatttctcggttgccctttcccattttgtgccacatcggagaaccgttattcctaagagaatttttttttctacaataaaacccataccccatttatttctttacgtgggaaagggtatttgtaaaagcaagacaaactccaaggttggtaatgaacaaattgacaccagctggtatatttcccatcaccctagcaaaaacaatttctttcctcactgcaggcgaagaacaagctaatcacagaaattacgtctactaaaattcctaagtttacaaaaataaggtccactggatcaagtgtatacccactggatcaagaatgtcacaacatgactaggaaacaatgcagccaacttaaaagaaaaaattaacttaaggatagcaaaatgccatacatttacatagtctcagacaagcaacatccattcttcaatgtatctggtgccagctaagaactataaaacctcaagttaaatcaaatagcagctacaggggcaagttccaaaatctctatggatttatagagcacgagatagttaccattttgaaaacttacctttcagtacttaaatacctaagtttaaaaaatggcttctgcaccagctaccctcactgagcaagcattcttttgtcatttatggctgtttgagattatggcagaagatcagcctgtagttcctcattgaagaaatgcagaactcgatcagtacttcagcagttaatcgttggaaccgcgatgccccgttccctggccgcggccgcttctccaggacccgcggcgacggcaagagggcgagaactgaggccccaagtggctccgcgccgagaagcctcttcctgggcgccctgacgggaggttaaagtacgcttggccgggccagcccggtaagcgaccccccggatacccccgcggtggtggcgacgcagacgcggaacagggggagagagtggcgacagagcggcggctgaggtgcagagcctccctaacgcgagcgggaggagacggctggcggcccgct

SEQ ID NO: 727211 - DNA, 1178 bp, Homo sapiens
  misc_feature (14)..(14): n is a, c, g, or t
  misc_feature (16)..(17): n is a, c, g, or t
  misc_feature (346)..(346): n is a, c, g, or t
gagataaggaaganannaaaataaagataattcgggagtacaattgacaaagcgtgtgggcgccagcctccagcagtaactgtgttccattcttggagggttccggtgagaagaacgcccctactgcggtatgaggacgcagagaatcggcccctggacatagacgaggtggaagcgcctgaggaagtgagtctggacccgaggagattcgagcagttctgccccggtcatcaacgagatgcgcgaggacatcgcgtctcttatacgcgagcacgggcgggcgtacctgcggaccaggagcaagctgtgggagatggacaatatgcttatccagatcaaaacgcangtggaggcctcggaggagagcgccctcaatcacgtgcagcacccgagtggcgaagccgacgagagagtgtcggagttgtgcgagaaggctgaggagaaagccaaggagattgcgaagatggcagagatgctggtcgagctcgtctggcgaatagagagaagcgagtcttcttgagcgcggtcggcggtttccagccaatggattctggtcacactggtggagattggctgacaccctggagaaagccgaaaccagagagcctttgtgtttcctctttttccctgttctatgctctgttctcacttacgcactacgttgccgtgctatggtctgtggttgactgacctcaatatgagtttcgatgtgtacccgtgttttggtcgggccgtacatctgttgtgacaagatgctctcacaatacggacacttagggcctagattgtaagctcttggcacgcagtcacctttgtttcccgggcttgtgcgtggttatttctaacattttttggaggtgctgtggtatttcttgttgtgaccctgatagctccctgggaactttgggtctgcgtgtgaccccattgaggacttcccagttgggggtcctcccagctctgggggtgccgaaggactgcttaacttctggcagaccgctccttgcgcacctactgggcgaccggccccatttcacggggagtgtggttcgccgacctggtgggcccgtgactctggcaaacgctcgggaaggatatggcgtttggcactcactggtgggcccagcgcggcagtttttcgcacaaatcgtgtggcccacttcgtcccgtggggttttgcc

SEQ ID NO: 727212 - DNA, 575 bp, Homo sapiens
  misc_feature (28)..(28): n is a, c, g, or t
  misc_feature (66)..(66): n is a, c, g, or t
  misc_feature (252)..(252): n is a, c, g, or t
  misc_feature (389)..(389): n is a, c, g, or t
  misc_feature (391)..(391): n is a, c, g, or t
  misc_feature (410)..(410): n is a, c, g, or t
  misc_feature (412)..(412): n is a, c, g, or t
  misc_feature (418)..(418): n is a, c, g, or t
  misc_feature (432)..(432): n is a, c, g, or t
  misc_feature (448)..(448): n is a, c, g, or t
  misc_feature (450)..(450): n is a, c, g, or t
  misc_feature (454)..(454): n is a, c, g, or t
  misc_feature (458)..(458): n is a, c, g, or t
  misc_feature (470)..(470): n is a, c, g, or t
  misc_feature (475)..(475): n is a, c, g, or t
  misc_feature (483)..(483): n is a, c, g, or t
  misc_feature (486)..(486): n is a, c, g, or t
  misc_feature (560)..(560): n is a, c, g, or t
tggggtgggcagggggtgagggggatcngctagcgaaggctgcgctcggggtcagcgatgcttctncctctgggacactcatcatgcccgtccctagggcacgttgcctctcttcttttgcgaagctttcatgaggtctgacatgaaatcttgctccccgcctcctgctccgccggggtgccctgggttctcttgcctcttggggggcacaggaggcctcttggccaccgcggggggcggcctggcggggtngggggcgggggcgggcgcggagcgcgggcgagcggacggacggcgagacggagaggcagctctgagccacgcgatccacatgcgtaacagaacggcgggggcgaggggcacgaaagtctgggggcggctccatgaantncgggggcggcggcgggggnanagggtnatcgaggggaggcngcggtggcggcagcgncnaganatcntcgggtggggcnggcangcccccgncgnctgtgcccttggccttgaggggcgtggcgggactgccgctggtgtcggaggacctccgcaccggagggagcggnggaaggctggacttg

SEQ ID NO: 727213 - DNA, 222 bp, Homo sapiens
taaatttttgaaaagcgaaaattgaggtccttctattcccaaaccagtaaaagcggggtcttcatttctagggctgatgtgaaaacccatggtcagttgttgctgcgtcaaaaatattaaaaattctttttttttaggtgggcatccctgataaacttgtccgtgaaaggtgaaaaccccttaaatgtaagatgcgtgagtaaaattttggtaaagaggcca

SEQ ID NO: 727214 - DNA, 827 bp, Homo sapiens
ggggagacttccggcagggggggcgcggggtctgtgctgaacggtcttcgtgaagcgctggggcgcgatgattgacgctaagggcctttaccggcgacgactgtcgccgcttcgacaagtattcgcttggatccacgttacagaaagttatgggattcctttctaggcctacattatacctcggctctactggccagtagtattacattggtgccgaggcaccttggtggagaatcagtgggttatatcatgggtaaagcagagggctcaggagctagggaagactggcacgggcaggttgcagctctgtctgtggccccagaatttcgacgcctctggtgggctgctaagacttatggagtactagcaaggaacgatttccagacgggaccaagggtggattctcgtggatctctctgtaaagagtatctaaccaagttgcagttaacatgtaggcaagcagttgggctacagtgtatataggacggtcatagagtactattcggccagcaacgtggtgagtctgatgaggacgctcatgatatgaggaaaggcaactttccagggcatactgggaagaaagtccaatcgttaccattaccctcagtcctgtgaggcctgaagacatttgcataaccctgtggcagtggttcttcaggcaagatactctagcatgcttatggacaagatccttgtcatgggtgactctggagctctattagggggacccgtctcacttcaggtcttaagattccagacatcaggtttcattattaacctcttgtccgttgccatatctctaacggattggcccatcataaagggcg

SEQ ID NO: 727215 - DNA, 655 bp, Homo sapiens
ttcctcatatagtccacaacgtggcgtactatgaatgggaacctcattgtctggatgtcctccctgctgcagctcatcaaagtggaattccaatatttttggttacaagaacggagttcagttactcaaggaaggggaggagctcttcctcatatcgtttgtttgcagccagaaatcaaaagctgtcgtttctgttcagtacttaaatacctaagtttaaaaaatggcttctgcaccagctaccctcactgagcaagcattcttttgtcatttatggctgtttgagattatggcagaagatcagcctgtagttcctcattgaagaaatgcagaactcgatcagtacttcagcagttaatcgttggaaccgcgatgccccgttccctggccgcggccgcttctccaggacccgcggcgacggcaagagggcgagaactgaggccccaagtggctccgcgccgagaagcctcttcctgggcgccctgacgggaggttaaagtacgcttggccgggccagcccggtaagcgaccccccggatacccccgcggtggtggcgacgcagacgcggaacagggggagagagtggcgacagagcggcggctgaggtgcagagcctccctaacgcgagcgggaggagacggctggcggcccgct

SEQ ID NO: 727216 - DNA, 1165 bp, Homo sapiens
  misc_feature (14)..(14): n is a, c, g, or t
  misc_feature (16)..(17): n is a, c, g, or t
  misc_feature (346)..(346): n is a, c, g, or t
gagataaggaaganannaaaataaagataattcgggagtacaattgacaaagcgtgtgggcgccagcctccagcagtaactgtgttccattcttggagggttccggtgagaagaacgcccctactgcggtatgaggacgcagagaatcggcccctggacatagacgaggtggaagcgcctgaggaagtgagtctggacccgaggagattcgagcagttctgccccggtcatcaacgagatgcgcgaggacatcgcgtctcttatacgcgagcacgggcgggcgtacctgcggaccaggagcaagctgtgggagatggacaatatgcttatccagatcaaaacgcangtggaggcctcggaggagagcgccctcaatcacgtgcagcacccgagtggcgaagccgacgagagagtgtcggagttgtgcgagaaggctgaggagaaagccaaggagattgcgaagatggcagagatgctggtcgagctcgtctggcgaatagagagaagcgagtcttcttgacggacggagatcggtgcgttcacagctgaggactgtagtcaactggtaaggatgaactgacaccttgcaggcaaactgaaacagcttgtcattttctctgtctgtattccggtatagtacagttacaccccatgtaacagtctcccttatggtcagtgcttcgatgacctcgatatggatacagattatcaaatgtgtctgggttccgggacaatattaactcttgtcaacagacatacgtctcaggacagagcaaccatggcggcttacttacagtacggatacaaacaggtggatcacgtaatattactatgattacttcgcctagatagttactctgacaaatgtagggagcaatagggaccttcgataattcatatgggctggtaaaccctatggtgaaccctgactcggtactcatcggaagcacgttcaagcaacgttgagaatccaggaattcttcccaagcctctttacgcagggttccatgtggggacagcagccagtaaccggcctacttgggcactggaagacccctgggttgacacgcacagtgttcatttcacttgggagacctgccttttggcccttcaccaacttggggtgaaggaaacagcgagagaaccgggggcagcaacttcgccc

SEQ ID NO: 727217 - DNA, 107 bp, Homo sapiens
taggagggggcaggcgaatataaagggaatgggcccagtaggagaagagaatcactaaggcaggccaggcaggctgctcagctgcccacagcaatctcaccctctga

SEQ ID NO: 727218 - DNA, 682 bp, Homo sapiens
tagttgagaaaaggtgcatcaagtatatacactggagacacagaagaacaaggttaagagagtttttgaagaaaaagtctaaaggggttattaggtgaggttacgatctgcttccgtaaccgaatccacctctttatccgctgtcgtatatctgccaaagccactccactgtctcagcatttccattgacttgaaaaagtccttgttgctccagacctcctttcagtacttaaatacctaagtttaaaaaatggcttctgcaccagctaccctcactgagcaagcattcttttgtcatttatggctgtttgagattatggcagaagatcagcctgtagttcctcattgaagaaatgcagaactcgatcagtacttcagcagttaatcgttggaaccgcgatgccccgttccctggccgcggccgcttctccaggacccgcggcgacggcaagagggcgagaactgaggccccaagtggctccgcgccgagaagcctcttcctgggcgccctgacgggaggttaaagtacgcttggccgggccagcccggtaagcgaccccccggatacccccgcggtggtggcgacgcagacgcggaacagggggagagagtggcgacagagcggcggctgaggtgcagagcctccctaacgcgagcgggaggagacggctggcggcccgct

SEQ ID NO: 727219 - DNA, 413 bp, Homo sapiens
gacgtatgaatggaatcatgctgttgataaagcatcacgttagtcacccatggactaggatcctgtcaggatgcgagtgccacctagtgggtgactgtagtgtgacaccctgagggacacgatgtccaaatgtaggaacaagaggagatgcgataaaaacctgccaagcacacaggaggacgcactttaccttccgatcagaactcaacagacattttccctcattacttatgaggaaacagaaaattcctaaattggtcccatttttcgaccaaagcactatttaagaagggattctagaagaatcaagtatacacatttcacatgggttacacggcattctatctacccacagaggtataaagaacagatccacaacacacaaacacatgcacgtcaaacagcattcgagg

SEQ ID NO: 727220 - DNA, 226 bp, Homo sapiens
tagctcacccctggctccttcccagcctgggcatcctatgagttccaaggactcatatcagctactcggaacatctacgaagcgctcactgcacacaggatactgaaggtgtagaaatatatactacacataccagatggttatctatctatatggcttgggtgagacggagctagtgtgttagtcatgggcatgattgctctgcatttagattgcatacccatgt

SEQ ID NO: 727221 - DNA, 631 bp, Homo sapiens
  misc_feature (20)..(20): n is a, c, g, or t
  misc_feature (53)..(53): n is a, c, g, or t
aactaacaggtgccctgccnacccagcccggcctaatttttttgtatttttantagagatggggtttcaccgtgttagccaggatggtctcccatctcctgacctcgtgatctgcccgtctcggcccccaaagtgctgggattacaggcgttagccaccgcacccggcctttcagtacttaaatacctaagtttaaaaaatggcttctgcaccagctaccctcactgagcaagcattcttttgtcatttatggctgtttgagattatggcagaagatcagcctgtagttcctcattgaagaaatgcagaactcgatcagtacttcagcagttaatcgttggaaccgcgatgccccgttccctggccgcggccgcttctccaggacccgcggcgacggcaagagggcgagaactgaggccccaagtggctccgcgccgagaagcctcttcctgggcgccctgacgggaggttaaagtacgcttggccgggccagcccggtaagcgaccccccggatacccccgcggtggtggcgacgcagacgcggaacagggggagagagtggcgacagagcggcggctgaggtgcagagcctccctaacgcgagcgggaggagacggctggcggcccgct

SEQ ID NO: 727222 - DNA, 811 bp, Homo sapiens
gctgcagtttgctgggggttcacttcaggtcctactcatctggttcactactgcacctggagatgacactcgaggaggctggagaacagcaaagatgggtgcctgctccttcctctgggatccctgacctcgagggacactgacctgatgccagtaggaatgctcacatatagggtgtctgacaagccctgctggagagtctcacccagttgggtggcaagagatgcaggaggacctgtttaaccaagcactttggctgtcccttggtggagggtgtatgccgtgctcgggggaaacccacttgtctgggctgcccggattccgcagaactagcaggaggaaagactaagtctgatggtctgtggagacaacggcaacccctcccactaaaggctcaggcccaggcagatcagagttctgtccctgagcccctggctggagttggagttcctgcagggaggccccgcccagtgaggagggataggtcagagtcaggcctgaagaggcactctggccacagcctgacacagccgtggtgctgggctgtgggaatacctcttaggaccaagccatccagcctccctggctcggtggaagtgccgcctggagctatggagatggttgctgcccttacccccgccctgggagcttagtgatttaggcaggctagcagtcccagtgttagctgacaccccactcccacaaggagctcagacagcttacgatagcaggaagtggagctgtggtggatggcaatcctcacctaagaactccgcaggttaggaatattctaactgaatgtatagagaaa

SEQ ID NO: 727223 - DNA, 229 bp, Homo sapiens
  misc_feature (44)..(44): n is a, c, g, or t
ttttttgtcccccggtttaaaggggggatttttccagagggggntgtttcccgcccgcccccccaggaccccaccaaaggcccaaaaccccgccaaaaaggctaggggtattgggtaaatgggcgggacgggggggcccttattatttgagttaagccgttgtttagggggaaaaccccgtaaaaaattaataataataataataaaaaaaaaggggccgccgttctta

SEQ ID NO: 727224 - DNA, 302 bp, Homo sapiens
cgagttagtctgcagaaattttttttacattccatttcaaacactgtcttgaattaccagacataatataaacacataaggtgccaaataacctattaatctagaggaaactttttctttacaggcttcccatctattcacaattgtgctgcagagtgtatgatgtcccctaaatatgcaggtggaattgtttttttgcctatttggtatatgtaattaactgtagtcgcttctagaaaggatagacaaaatttctacaaacttcacagagaaggaaccaaccatttacctcttcactcgaa

SEQ ID NO: 727225 - DNA, 388 bp, Homo sapiens
gcccaattgattcttatatatataacacaatctcaggtaatagaaaacataaagtaaattatgccctattagtctgaaaaagtgagtggctatccaaagtcccaacaatgtcaacactatttaagaatctagttcattaacaattacaaaacgtacatattcaaaagtaagagtaggcagggcgcggtggctcacgcctgtaatcccagtaatcccagcatttcgggaggccaaggcaggcggatcacaaggtcaggaaattgagaccatcctggctaacatggtgaaaccccgtctctactaaaaatacaaaaaattagccgggcatggtggtgggcacctgtattcccagctactcgggaggctgaggcaggagaatggcatgaat

SEQ ID NO: 727226 - DNA, 3318 bp, Homo sapiens
agcggggtgtgggcgccgtacgtgcgcgcgcgcggcggccagaaagcggcgctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgcttttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgcagatgagcaccgtgtccagtgccacagcacaaggcgcctccccgccccaccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtga

SEQ ID NO: 727227 - DNA, 3151 bp, Homo sapiens
agcggggtgtgggcgccgtacgtgcgcgcgcgcggcggccagaaagcggcgctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgcttttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgcagatgagcaccgtgtccagtgccacagcacaaggcgcctccccgccccaccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtga

SEQ ID NO: 727228 - DNA, 658 bp, Homo sapiens
  misc_feature (107)..(107): n is a, c, g, or t
  misc_feature (335)..(335): n is a, c, g, or t
  misc_feature (345)..(345): n is a, c, g, or t
  misc_feature (436)..(436): n is a, c, g, or t
  misc_feature (445)..(445): n is a, c, g, or t
  misc_feature (572)..(572): n is a, c, g, or t
  misc_feature (634)..(634): n is a, c, g, or t
  misc_feature (658)..(658): n is a, c, g, or t
agtgtgagttcgaatgaagaaaaaaaaaaaaaaaaaaaaaaaaaaaaaaaaaaaaaaaaaaaaaaaaaacaaattaaaaaaaaaaaaacaaaaaaaatatttaaaanaaaccaaccttttgcctcccctcccccctttaaacttttttacccaaaaacccttttttttttttcccgggggggggcctatttccccctttcccccttaaaaaaagcgaataaccttccctgcccccctttcccccccccaactttgaaaaacccctgggtccccaacttaaaccctttccccccacccccccctttcccaccgtgtgtgaaaattaaaaggcccancccaattccnatttccaaaattttcccaacctaaatgtgaaattttaatctctcccccccattttttacccaaacccccccaaaattctagatacacccanaaccttgtnaacccccggggccgtttcggaaattcctctatattacccccccccccccccaaccccctatcccctttttgggcgtggcccccccctaacccttccccctacctttttttgcgccccaagcccaaancccccaaaagccccaaaagaccccaattttttcgggaagcccgggcttttccttttttttancttggtctcccctcccccccctcn

SEQ ID NO: 727229 - DNA, 590 bp, Homo sapiens
tgcctctacatgcgtatgcctgggcgcagaatgggcctgtccaccaccttctggaaggccgtcacccactccctctgggtcggactccgtctcgcaggctagacagaaacttgcggtcggtcgtgacttgtaatgaccctgtcgggccaggtggtggccctgggtggacggcgggaacccatgcagcaccgtgtagccactctccttgctgccaatgaagacttcccctcgggcgaaggcgtccagggggtctttgaagtacatgagcctgcggtcatccatggtgaaccagcgcttccggaagccttccgtttgcttgggccccgtcttctccatgtagccttccttcaggtagttcctggagagctttggcaccagatctgcgtcgctggcccctgggaatgccacctgcaggtagtggaagcgagcagctcggagtgcattgaaccagtccacaatctccttcccgtcctcatggtagatgaagatgttacgggtgctgttgtccttcaggtaggtgacctgcaggccgtgggggtgggcgatcttggacggctggaaagtggcgttcaggtgctcgatcttcatca

SEQ ID NO: 727230 - DNA, 1560 bp, Homo sapiens
agcggggtgtgggcgccgtacgtgcgcgcgcgcggcggccagaaagcggcgctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgcttttcgaggccatcagcttaatcattcaccatgacagtgagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgcagatgagcaccgtgtccagtgccacagcacaaggcgcctccccgccccaccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtga

SEQ ID NO: 727231 - DNA, 274 bp, Homo sapiens
ccgggccccctcatgtcacggtatcgataagcttatctgatgtatgctggctaagtttatacgttagtttgtaaagttggggttcactgtgtagcccaggctggtctcaatctcctggtctcagcctcggcctcccaaagtgctgtgattacaggaatgagccactctgcccaccccgtatataactattctaagtacctctcataacagatggaagcatgcaatatttgtccttttgtgtctggcttacttcatttagcacaatgtcttcaag

SEQ ID NO: 727232 - DNA, 519 bp, Homo sapiens
agttgtgggtgcctccagagagtggtccctgggcatggcccacagggttctgcatggcggatcctggacccgagggctgtgtgagcctcggcgtgcccgttgacctgctgtgctctctgtttcctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgcagatgagcaccgtgtccagtgccacagcacaaggcgcctccccgccccaccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtga

SEQ ID NO: 727233 - DNA, 469 bp, Homo sapiens
ttaagaacaggtgaggtaggaacaaggcatacatagggtaaacatctctcgagagatgattcatataccactcccgcagagcccgcagaatctggcctttctttctcctttcaattctaatttccaatcgatcctccattcctcgggggaattggcgaatgagctcaagaaaagggggcctccaaacactgggccccaagggacattggcaaggcatgtcttctttccggagcccctcatctaaacgctccagctcttggcggaaatatttgcgcttgacatccaagtcgaggacacgaatgtagtctaccaggacagcaaaaggcccatcagcaaggtgggtcgtggactgccgtaggatctggtttaacacagtgcggtgagtctctgcaaagcgaaggaacttctgtgtgtcagggggcaggcttaaggagatgtgcatagatcagggctcccgggagaagaatgg

SEQ ID NO: 727234 - DNA, 375 bp, Homo sapiens
ggtctccgttctcggaggggtgctcttggcttgtctgcggacttgtgctggctgctccgtcggaggactggcggccggagccaagtctcttgcttggcgtgtagagagggcggcttggttgtggagtggcgacggagacgactctgtcggtgtgggctgtgttgttgcggtgacggccgggtgtggtggttccttgggttgttgcttgcctcccttgttgtcccttggtgttggtgctcgtcggcttgcgttggctcggtcagctagtgtgaggcagcgtgtgctactttctgctgtctagggtgtcgccctacgtgcccgcgtgggtgtcctcttctctggtcggggtatgtggtctagaaaactcgttcgcat

SEQ ID NO: 727235 - DNA, 159 bp, Homo sapiens
gagaatttcccctatttatgcactaggtttactgtgactctttactttgaggttctctggaggtaggatattaatttggataacctacatgggtaatgaaattatggatggaggacggtgtttataaattaacctatggtacagaggaaccgtacgtga

SEQ ID NO: 727236 - DNA, 189 bp, Homo sapiens
ccttctgcctccctctccatatctccttcccctacaccctccctccccacaacctccctactcccctgggcactcttctggcttgactggatggaaggagacttatggagacctacccgttggccctgatgtctttttttcttttttttttttttaaccaaaccaggaccaaacccaaaaatgtcccca

SEQ ID NO: 727237 - DNA, 842 bp, Homo sapiens
accgacgtcggattccgttccgacgcggagccgccagctgcatggtcgtcccgctggataggcggctgtcggacgcggactgggagcgcgcactgttgatgcgtcgagcgaacgtgacagggggccattggccgcatgccatgtgccacctgcggcttgtgtctcacctgtcatctggactcagcacccaggctgcacgtctgacacctgagaggcgagagagtggggccggcctaggagccaaggctggggccttgcgctctgtccccaggatggtggccttgtttgtcctaaacacacccagcacaggttctggcttcctgacatgctgtggaggcagggagggtgggtggccacatgtgcttgagggttttcaccctggccctcagttgcctgctgtgcgggtccctggggcagctgcaggggctcacggacccatcagggtctccacagctcccctgcagtgtgtgcaccccacaatgtctgcggctcttcttccggcgtgtcgggctttgatcacagcatagccacgtcagtggcgtgcgcctctcgcacaggccattctgggtctggtggtgccaggtgccgtgacacgccgtgctgggcttgtgctgcagctgggtggtgtggccctcattctcatgttccagctgctgggcagtgctctgcctgtgtgctgcgcctgcaggctgcgtgtgctgccgtggatctcctgcatcccttgacccctcccgccatcagaggaaaggctgctccccgaggcaccgcttccctgtgcggcgctgcagaggggccctcagtgtggcactcctcgtcaaagaaaaataaaggctagaactgca

SEQ ID NO: 727238 - DNA, 198 bp, Homo sapiens
acataacatttttgccttcatttcacccttgatgaatctgagcgattctgtgtcttgcagttgtccttcttgagtgagtatctccgtcgctgttctctgtagtttcctgcagtttgcctgctggccggctgtgcaaggttggggatgttctcctgaattatattctgcagtgttgtccaacttagttccatactcccg

SEQ ID NO: 727239 - DNA, 4627 bp, Homo sapiens
agcggggtgtgggcgccgtacgtgcgcgcgcgcggcggccagaaagcggcgctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgcttttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgcagatgagcaccgtgtccagtgccacagcacaaggcgcctccccgccccaccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtgaacgtggcgtttgtgggagtgtcactgagatggcccgtgctgccgcccaccccgcctcggagcctctgggagcagcagtgccactgtgcatggcgtgggctgagccttggtgtgtggccgtcctggtggctgcacacctggcgtcgtcctgggcccttgggaggagcacagctgaccctggttttgctgcagtcccagctggactgttttcccaggcaggattttaatctagaatttagaaacatttgtatttgtaatgacttctggcaaaagcacgtgtcctggccggatgtaactgttctcctttcccagctcctgtttgtgaagggcgtctgttatgctcctgcagtcgccgaggccttggatgtgcagccaggggaggagcgtcctgccggccccgcagggcccccaggactccagggtaaagtgtgggccggtggcgcaagactcagaggtgtgctcgtctctttcctgtcagagtgggcgtccccaggccacggtgcaggcctgagtccttccaccggccccgtccagtcgtccctggaggggctgtggaggaaggacgcctctgtgtggtcaggaagtgaaggggccattggccgcatgccatgtgccacctgcggcttgtgtctcacctgtcatctggactcagcacccaggctgcacgtctgacacctgagaggcgagagagtggggccggcctaggagccaaggctggggccttgcgctctgtccccaggatggtggccttgtttgtcctaaacacacccagcacaggttctggcttcctgacatgctgtggaggcagggagggtgggtggccacatgtgcttgagggttttcaccctggccctcagttgcctgctgtgcgggtccctggggcagctgcaggggctcacggacccatcagggtctccacagctcccctgcagtgtgtgcaccccacaatgtctgcggctcttcttccggcgtgtcgggctttgatcacagcatagccacgtcagtggcgtgcgcctctcgcacaggccattctgggtctggtggtgccaggtgccgtgacacgccgtgctgggcttgtgctgcagctgggtggtgtggccctcattctcatgttccagctgctgggcagtgctctgcctgtgtgctgcgcctgcaggctgcgtgtgctgccgtggatctcctgcatcccttgacccctcccgccatcagaggaaaggctgctccccgaggcaccgcttccctgtgcggcgctgcagaggggccctcagtgtggcactcctcgtcaaagaaaaataaaggctagaactgca

SEQ ID NO: 727240 - DNA, 228 bp, Homo sapiens
tctaaaggatccccctcagcttatacttcccaaaaccgtagttgtgttaaaatatattgttattaaattgttgtgccagtatatattcactcagaaatcgtcttaagactctaaggtggtctcagtattgcaatatcatgtaagtgagtttctattggccggcatgaggattctgtcacaatgaaagaaaactgtttatatagaccccattggaaaagcaaaacgctt

SEQ ID NO: 727241 - DNA, 292 bp, Homo sapiens
tagttctgtgtacagatgacactggtggcacacatcggcgggtcagcgctagaatcgaacctcggcagctaggtagcgaacactcagctgactgatatacccttgggcaacattacttgacctttctgtgcctcagtttttcttacccattaagtagggcttattttgactaactacctcgtaccgtttctgtgaggattaaaagagatatgtcacacgtaaggaaatagtgcctcgcatgttagtatgtcctctgtgttttatagagtaacgctggagcttcaactttcta

SEQ ID NO: 727242 - DNA, 343 bp, Homo sapiens
tttgtcggcccccgggtcccgcttttttcaggtttccttttttgggttattccgcgcccggcggtttggtggcctttgtgccgggaaaaccggtccttggtgctttttttggtgggggccggtaaggttttttgtctttcctcccttggggggtttgggttgccctgggctttttttttttggtggggcccttttctgcctttggccgggtgtttttagccattttggggttccctttttggggttcgggtttttcccttttttggttttttgcttgtcccgctttttccccctttttttttttttttttgggatttccatgtaggggccttgtccctttcca

SEQ ID NO: 727243 - DNA, 475 bp, Homo sapiens
tgctatagataaatgcctggttttatataaacatttgtgaaatttaagaatacagttttcagccacatctaagtggaggaattatcagaactgctttaatagctctttgcataaatgtgtgcatatatatgtataaacgccacaggagatattaaatttaagtcaactggtgggcatctatttggaagggttggctaaatagaaataagaaaaacagtactgactgtagtcataaataatcagtaaatttggtcttactgtgcaaattccaaaaatcctacttcttgttaggcaatttaaaatacttgtgatacatcaggcaattattacggtataaataagcaactgaagtcacttcagataacactgaaaaactcttgccgtacagcactgataaaagataagcatatcaaacacagttttgaaccatcttttatgtaccatttcccatcacatttatatcttcactactacc

SEQ ID NO: 727244 - DNA, 3281 bp, Homo sapiens
agcggggtgtgggcgccgtacgtgcgcgcgcgcggcggccagaaagcggcgctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgcttttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctggcgccgtgaaggcgtggaccggctgttgtggggtggctgggtgtgtgtcagactcggctctgtggtcggcctctgtctggctccgggacatttgcagtggttgtaaacgaggtgtgttgggaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgcagatgagcaccgtgtccagtgccacagcacaaggcgcctccccgccccaccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtga

SEQ ID NO: 727245 - DNA, 102 bp, Homo sapiens
gctggctttcaagaggagtacctctgttctcacaaatttcctgggaagacccaatcagagctggtgaaatagttgttccacggtggacggacgagacattcc

SEQ ID NO: 727246 - DNA, 4839 bp, Homo sapiens
agcggggtgtgggcgccgtacgtgcgcgcgcgcggcggccagaaagcggcgctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgcttttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgcagatgagcaccgtgtccagtgccacagcacaaggcgcctccccgccccaccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtgaacgtggcgtttgtgggagtgtcactgagatggcccgtgctgccgcccaccccgcctcggagcctctgggagcagcagtgccactgtgcatggcgtgggctgagccttggtgtgtggccgtcctggtggctgcacacctggcgtcgtcctgggcccttgggaggagcacagctgaccctggttttgctgcagtcccagctggactgttttcccaggcaggattttaatctagaatttagaaacatttgtatttgtaatgacttctggcaaaagcacgtgtcctggccggatgtaactgttctcctttcccagctcctgtttgtgaagggcgtctgttatgctcctgcagtcgccgaggccttggatgtgcagccaggggaggagcgtcctgccggccccgcagggcccccaggactccagggtaaagtgtgggccggtggcgcaagactcagaggtgtgctcgtctctttcctgtcagagtgggcgtccccaggccacggtgcaggcctgagtccttccaccggccccgtccagtcgtccctggaggggctgtggaggaaggacgcctctgtgtggtcaggaagtgaaggggccattggccgcatgccatgtgccacctgcggcttgtgtctcacctgtcatctggactcagcacccaggctgcacgtctgacacctgagaggcgagagagtggggccggcctaggagccaaggctggggccttgcgctctgtccccaggatggtggccttgtttgtcctaaacacacccagcacaggttctggcttcctgacatgctgtggaggcagggagggtgggtggccacatgtgcttgagggttttcaccctggccctcagttgcctgctgtgcgggtccctggggcagctgcaggggctcacggacccatcagggtctccacagctcccctgcagtgtgtgcaccccacaatgtctgcggctcttcttccggcgtgtcgggctttgatcacagcatagccacgtcagtggcgtgcgcctctcgcacaggccattctgggtctggtggtgccaggtgccgtgacacgccgtgctgggcttgtgctgcagctgggtggtgtggccctcattctcatgttccagctgctgggcagtgctctgcctgtgtgctgcgcctgcaggctgcgtgtgctgccgtggatctcctgcatcccttgacccctcccgccatcagaggaaaggctgctccccgaggcaccgcttccctgtgcggcgctgcagaggggccctcagtgtggcactcctcgtcaaagaaaaataaaggctagaactgcaaaaaaaaataaaacactccacacaacctccccaaacacacacacaagaagggggggcgagaactccggggcacacaagcacccgtcttaaaggccaagatgataaaaggccggcgcaccagagcagcgcagacggttctgagcactttgggtgaccacacaaggccaaagttgatctctcggtattctcttataggacgggtctgcgccata

SEQ ID NO: 727247 - DNA, 3143 bp, Homo sapiens
cgcgatctcggctcactgtaacctcttctgccgggttcaagcgattctcctgcctcagcctccagagctagctggcaactacaggtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgcttttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgcagatgagcaccgtgtccagtgccacagcacaaggcgcctccccgccccaccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtga

SEQ ID NO: 727248 - DNA, 369 bp, Homo sapiens
gtcattaaggcttcactattggccgggccagtgggatcacggccggcattaacgcggggatttcattccgttgttggacaaaagcgcgcatcagggtgggtgcgtgaaatgaggggagggcgccggcacggagtaatcggatgggttcgttagagtaaaggcgtttgcaaaaaggcggggcgggaataagtggtaagaggttcccccacgcgcggcgttcggtgatttgggcgtcgtatatagcgtcgtggatgcgcagtttcggcccgggtattgaaccctaccgggcgcgcgttcgtcccggaacaggggggcgggcagggcaacgggttgaagcgtacaaggagtgtgcggtatggtcgcggtgct

SEQ ID NO: 727249 - DNA, 3123 bp, Homo sapiens
cagctatgactaggtacgagagctcgctgttatggacctggagcggtgcggcctgaccagtcaggtaaatgtccagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgcttttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgcagatgagcaccgtgtccagtgccacagcacaaggcgcctccccgccccaccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtga

SEQ ID NO: 727250 - DNA, 212 bp, Homo sapiens
ccccctccccgggtagctgggatttgaggcatgcgccaccacacctggctaatttggtatttttagaagagacggggtttcaccatgttagccaggatggcctcgatctcctgaccccgggatccacctgctttggcctcccaaagtgctgggaggccgaggtggccagagttgatcagtctgctgtaggctttgaatacccggggaggggg

SEQ ID NO: 727251 - DNA, 1434 bp, Homo sapiens
gagccatggggcattgatgctctcctgccccggttcgcgtgtgccctggtgcaagagcagctgtgcccgctgggagcggaaacgcgcctgcacctgccgggagctgctagagacctgagctggtgctaccaagaacatgctgcgggcatggtggccactgtactttattggggcatcctgaaagccaaggtggacccttgtgcacacctgagcgccagtgccctgtttggctcctgtggagctcatctactggcagccagccagtgagctgcattcctacctggaaggaacggactgctggaggccacaggcgctgcagcgcgccttctgccgacacctttgcgcacgctctatacccacatttgcctgccaacctcaacgagacggtcccagtaccacccctgcaggaggcaggcttacaacgcaacacccgtacacggttctcccggaaggcttctggtcactgcgcctttccacgcgaacagtgcccaggcccattgaagctactggccgcggcccattccaggcctacccagaggaccctggactcctctcactgcccatcttgcgcaacaggccctccccagaagggccctgacgcaactccttcggtccgcacagccttctcggcgcctcgcagcagcaccacgacggggtgccccgaacccaaggtgcgccttgcacctcacatccatatcacgggattcaccagcagcggggccttggcctccggaacttgggactacaacggctccaggccaccttggcgccccaagtaaggaaggctccacacaatactcgttactctaggaggctcccagcggacacatacacgcaacagagaatacttggcacgcgaacgactacccctcttctcggcgaccaggactgtcataccaagaagtagtccttccctggaaattagacagtcttgtaggagtcgaccccgaaactgcgccaatcaaaagagcgccgcccgtatgaaccgtcctacatacgtcgggcacgtaggactgcaggctctttgtccacaataacagtcctccagacgaggcacactccgagtgcgttccgatcagaactgatcgcgcgtaggagcaccttcgcacaccaacttgggcgaggtcaagctacgcagtacgcgagagcaccgctctggtcacgtttgctttgtcagtttactgaagtggcgatctgagcgcattgcagatttggtcgcgtctccacgtaacaacagtaggtcaagcaacactaccatctcggggcggccccaccactaacagtgcccagcgaccgtgtacttgcgcctcggaaccatacggaagacaaccacgtacgcgtaacctatcttaaacgagggacccagctagctaccgtaccaagtagtgcacgcccagacttcggcatcacattcgtcgaaccagctagggactc

SEQ ID NO: 727252 - DNA, 892 bp, Homo sapiens
  misc_feature (5)..(5): n is a, c, g, or t
  misc_feature (24)..(24): n is a, c, g, or t
  misc_feature (41)..(41): n is a, c, g, or t
  misc_feature (58)..(60): n is a, c, g, or t
  misc_feature (64)..(66): n is a, c, g, or t
  misc_feature (75)..(75): n is a, c, g, or t
  misc_feature (94)..(95): n is a, c, g, or t
  misc_feature (108)..(108): n is a, c, g, or t
  misc_feature (114)..(114): n is a, c, g, or t
  misc_feature (117)..(117): n is a, c, g, or t
  misc_feature (119)..(119): n is a, c, g, or t
  misc_feature (122)..(122): n is a, c, g, or t
  misc_feature (124)..(124): n is a, c, g, or t
  misc_feature (126)..(126): n is a, c, g, or t
  misc_feature (167)..(167): n is a, c, g, or t
  misc_feature (171)..(172): n is a, c, g, or t
  misc_feature (227)..(227): n is a, c, g, or t
  misc_feature (232)..(232): n is a, c, g, or t
  misc_feature (239)..(239): n is a, c, g, or t
  misc_feature (259)..(259): n is a, c, g, or t
  misc_feature (273)..(273): n is a, c, g, or t
  misc_feature (280)..(280): n is a, c, g, or t
  misc_feature (282)..(283): n is a, c, g, or t
  misc_feature (321)..(322): n is a, c, g, or t
  misc_feature (332)..(332): n is a, c, g, or t
  misc_feature (335)..(335): n is a, c, g, or t
  misc_feature (337)..(339): n is a, c, g, or t
  misc_feature (341)..(341): n is a, c, g, or t
  misc_feature (353)..(353): n is a, c, g, or t
  misc_feature (362)..(363): n is a, c, g, or t
  misc_feature (367)..(367): n is a, c, g, or t
  misc_feature (371)..(372): n is a, c, g, or t
  misc_feature (376)..(377): n is a, c, g, or t
  misc_feature (403)..(403): n is a, c, g, or t
  misc_feature (436)..(437): n is a, c, g, or t
  misc_feature (440)..(440): n is a, c, g, or t
  misc_feature (494)..(494): n is a, c, g, or t
  misc_feature (519)..(519): n is a, c, g, or t
  misc_feature (522)..(522): n is a, c, g, or t
  misc_feature (525)..(525): n is a, c, g, or t
  misc_feature (531)..(531): n is a, c, g, or t
  misc_feature (571)..(571): n is a, c, g, or t
  misc_feature (661)..(661): n is a, c, g, or t
  misc_feature (753)..(753): n is a, c, g, or t
  misc_feature (775)..(775): n is a, c, g, or t
  misc_feature (838)..(838): n is a, c, g, or t
ccttnatctcgggggtctctatangctttcttccacctggnacttctgcctcctcctnnnccannncctcccgcntcaggcctgttgtgctcanncccccaggacctnccctcnccnangcntntngcctcattgtttggttaaagcaggaccccctccccctcctntatnnacctcctctctccgactgaacagatggatagagatcccgggcctcatcggggagnggaanggccagncggtgccgggaaagggaatnggtttggggaaaanaaaacananngaggagccatggagaaggtggccccaggagggaggagnngggaattcgntangnnngnctggggcctganacggaatgnnggcnggtnncggnnggggtgggggcccctgggttcccagngtgggagctggctccgatgctggctggctcctnngtncgctgacgtcgccgcccagatggcctccaggcttaccctgctgtaccctcctgntgctgctgttggctgtggatagagnctnctnaaatcnaaatgctaccagctccagctcccatgatccagagagtttncaagacagaggcgaaggtgaatgtcgcaacaacagttatctccaagatgctattcgttgaacccatcctggaggtttccagcttgccganaaccaactcaacaaccaattcagccaccaaaataacagctaataccactgatgaacccaccacacaacccaccacagagcccaccacccaanccaccatccaacccacccaacnaactacccagctcccaacagattctcctacccagcccactactgggtccttctgcccaggacntgttactctctgctctgacttggagagtcattcaacagaggccgtgttgggggg

SEQ ID NO: 727253 - DNA, 707 bp, Homo sapiens
gcgttgttctggattcccgtcgatagacttagagggaaactgtcacaagtgtccggagcccttgaatgtcctgcaaatgaaggagcgagtgatgtccttaagttccttgtcagtcaggaatcccacgttaggggtggcatgcaagtactgtagacgttcccagagtggagacaagtactatctagttagacatggaaacacgtgatcgtgccatcctactagttcatagaagtcgtcaaggagtgagccgtgggagaacgcgttctgcgtggcagctcgtgcagttgttggcattgaaaaccctgctgactcggtccagtgttatatcctccaggcaagtacgtgcgccagtaaggcgcgtgatgcttgaaggtttgctgctgccacgtgggagccatctccaaattgtctgtgcccgcttcactcctggaaccttcatcgtaaccatgatccatggcacgccttccggtgagccacggtcttggttgtggttagctggaccgccgagtgggctgaccagcacagtcctctcgcggaggcctccttgatgttcacctacctaccgttgcgctgtgtgacacagattgctcctctgcgctatgtggaccttgccatcccatgcacaacaggggagctcactcagtgggtttaatgtgggtggatgctgggctccgggaagttctgcggcctgccgtgggaccatttca

SEQ ID NO: 727254 - DNA, 126 bp, Homo sapiens
gtgactctacaggatcttaggcgagtcggtacatgtacgtcagttggcaggttgcgttcagctggccgggaagcgcaggcaggtggtgacccgctcatggtgggcgacacaggtgtttgaggtccc

SEQ ID NO: 727255 - DNA, 265 bp, Homo sapiens
gactcatagaggatccccctgggaaggctgccagatgcaagctgtcattagatctaccattctggggtctgaaggatggtggccctattctcacaggtccatggaggcagctgccccagatagggactctgtgtgtgggctccaactccacatttcttttctgcactgccctagcataggttctccatgagagccccacccctgcagcaaacttctgcctgaatatccaggcgttttcatacatcctctgaaatattgacttctg

SEQ ID NO: 727256 - DNA, 163 bp, Homo sapiens
tcagcccgtcagccgcggtctgaactcagatcacgtagactttaatcgttgaacaaacgaacctttaatagcggttgcaccaatttggggtgtccatgatccaacatccgaggtcgtaaaaccctattgtcgatagagaactctacgaatctcctctctcctg

SEQ ID NO: 727257 - DNA, 957 bp, Homo sapiens
  misc_feature (167)..(167): n is a, c, g, or t
  misc_feature (169)..(169): n is a, c, g, or t
  misc_feature (171)..(171): n is a, c, g, or t
  misc_feature (185)..(185): n is a, c, g, or t
  misc_feature (188)..(188): n is a, c, g, or t
  misc_feature (199)..(199): n is a, c, g, or t
  misc_feature (212)..(212): n is a, c, g, or t
  misc_feature (220)..(220): n is a, c, g, or t
  misc_feature (226)..(226): n is a, c, g, or t
  misc_feature (249)..(249): n is a, c, g, or t
  misc_feature (252)..(252): n is a, c, g, or t
  misc_feature (257)..(257): n is a, c, g, or t
  misc_feature (272)..(272): n is a, c, g, or t
  misc_feature (294)..(295): n is a, c, g, or t
  misc_feature (302)..(303): n is a, c, g, or t
  misc_feature (322)..(322): n is a, c, g, or t
  misc_feature (341)..(342): n is a, c, g, or t
  misc_feature (356)..(356): n is a, c, g, or t
  misc_feature (425)..(425): n is a, c, g, or t
ccagagtacagtatcagctgagctgaccttactctgaggactaactcttttgctggaagcggtttctgatttacagctcttggtttctcccagacatgttggtgggagagatttggtttttaaggggttgttagatggagtaaattttctttttttttttttttttntnanctaaaagggggtcncanaatttcagcgnttctctgattttnatattttnattccntcttcctatccaatcccgtgccnttnggagntccagggggtaagtncatttctttaacgttttcccgnngctttcnntcccaaagtgtgtcttttncttggggctacggtacccnngcgttccaggtgcntgtccccggaataggtccatctctgcaggaagccatttcaggagtaccgggaggctcaacggcagaagnttcaccacaaaagcagaaaggggcacacccaggggagaaaacgggtggtccgggatgtggcgaaacagtgggccgtggatcagggggtgtaactcatccatatctatacatagctccagggcacaaagttttgccaaacgaatccacgcaggggttgaccctcagaggagaaaacctacataggtagagaaggttttacacggcagaaattgggaggtgggagtgggtactgacctaaatggcggggactccacagccgggagggaaatattccctttcacaacctggtatcactattttacacaacttttgttccgtgaaaggcaggttaattccaattcttggcactgaacattatttcccgtcgtggctaaggtaagggaaccaccttgaatgaacccaccggtttttcttcggggcgcgttgttgtccccgaatgtacaacctgcactgtggtattcaaggcccttgatattaaattccggcgaaaagtctagtataagtaagcttgcgcagaggtgctaataagtta

SEQ ID NO: 727258 - DNA, 204 bp, Homo sapiens
gacagcgtactacttaatgtgtaatactcaactcagtacaagacaatgcatttaacatgttataaataaaaggaacatcagactcaatcattaagggctccagaggtgaacagcatcttcataacttccatgtttatcatctgttactttctggcatgtaatttaataatgatcatcaattcgcaagaagggtgatttctaaaa

SEQ ID NO: 727259 - DNA, 336 bp, Homo sapiens
aaatggagtctccttacaagtcaacctctaggttctaatctacataatgtggttttgagtaggctacatatactatttacacttgtggtccagggtgttgcaacagcaggctgcacgagcttaagaagcctaagttttcccagcagtacactgagaatataccacctggttatcaggccgatgacagcttagttgaaagcagcagcctcaggtgcctcaccttaagcaggccgcaactcaccaggttccaactcattcctgtacctggctgccaaccgggtgcctcggcaacaagaggaatcagtcccctgggcagtcctcccaccacaaacgtgg

SEQ ID NO: 727260 - DNA, 114 bp, Homo sapiens
tcctcgagctcggccccgttgtgcacgcaccgtcatgaaagcaagtgatttatgttctagtatgattataccaggtattcgaaatctctctgtgcaataaaaaaattgaagtcc

SEQ ID NO: 727261 - DNA, 1005 bp, Homo sapiens
  misc_feature (1003)..(1003): n is a, c, g, or t
tgagaacacctggcctactgcggctatttactctacctaggacctgacgccgaggcgaactctaatcagcagacgcatggattcggaacctgtgacaaagactggcctggcctagagagtgcatcttgcttaactgcaatatgcacaaaggcccttatgctaggaagaataaaacttcagttacccagataatcatgtcaatcacagtatatccatgcaacagccggcgccaaactgcatcgcaataagacatgggtaagctagcatatccatcgggacaacatcttatagactccgaaacgtatgaatcattaactcaacatcactacacacattactggtcgtcattaaatcatcgtatatggacgacatggtcaattaaagccctagcgataggagaccccctttatcctcttagagtacccagacggttgcatgaaggtttgcaatctgccagtatggcctgcattctcgcatcacatggataaagatatgggactcgaatctccaatgcaacgtagcacaaatctctccatcactttcacgttaagactattcttactcaatcttctcatctgtatccattatagctagggccgtatgatcgtcgacctgatcaaaagatgactagactaaatcaaagaggttcggcatgatgtcttatggagtacatgatgcaagactgcgggccattactgacctagacatcttagtgtcccatttattatgctactttagcgatgactagaatgatgtgaaactgagcgcttgacctataattccgactgaaacatggcgggtgctagccctaatcttcacctcttgcctgggcgcccgtacaggttttggccatggagatcgggaatcaaggaagcctcaaccgggcagcccggaacttgattcggttgcccagggcctaacaaggagggaaacacccaccagccttataaaaaaagccaatcgttcggagcgatcgtctctctgtcccaccctttttcctcgntt

SEQ ID NO: 727262 - DNA, 105 bp, Homo sapiens
tttgcaactagatgcagacgaatgatcatgatcagaatgcatcttcctggttcttgtgatcgcacctatgtgcttgcaggaactccactgctgtccctccactct

SEQ ID NO: 727263 - DNA, 614 bp, Homo sapiens
caccaaaaatttaatggcctttaaacgaatatgtgtgatttggtttaataactagaattccaagaagctgtagccacagagtaagtcttcttgatcctgcaacctttccgtagagctcacgcatgtgctcagaccgagatcaggggtgcaagctcatagaaatctaaggcattgcacaccttcatgtaaaataagcaatatgcctttcaatgaatggggtcagagtatcacagtagacagagaatagggtatagtcaatgaattcgcccttaccttgctgtaaaataagctgccagtaattctaatccaatctagaatgcattgtttctggaccaaatataagcatgcatacttacaaaaatgcttggcaatgagcacttggcctatttgtccccatagccataaaaaataatgtgatcatgtcttttgcaggaacagggatgagtatcaaatagatgaggaaagactaggatttatttttaaattctgtgactgacttccaaaaatcccttatcactagaagtactggcaaaatatcagatattagagatcaaatttaattctttgatataagcacgaaatttttactgatagctttcagggctagcataagc

SEQ ID NO: 727264 - DNA, 176 bp, Homo sapiens
ctgctccagactgtacgaaggtgatccagacgcaagatggctgtccgctctaaggcaatatggttttcgtgcttctaactggtgctgccagctttataataggtggcccaactaagccatcaatgttaccaaggacccgcaaagaaagtacaaagaaggaagtatccataatcaat

SEQ ID NO: 727265 - DNA, 362 bp, Homo sapiens
  misc_feature (301)..(301): n is a, c, g, or t
aactcctgaggagattcgtaaaaccttcaatatcaaaaatgactttactgaagaggaagaggcccaggtacgcaaagagaaccaatggtgtgaagagaagtgaactgctgtgcctgtcactgtaacactagaagggttgttccaaatgctagttgcactgctctgtttataattgttaatattagagatcagtagacaaacatcgccttgtcttcactgcatgtgtagttccagtccagatcagacctgtggctgagtttcttctgtgagcagaagtttccttttccccccattactctgnataaaaccgaactatgggttctctgcggaaagtggcattttgggctttccctttctgtaaa

SEQ ID NO: 727266 - DNA, 120 bp, Homo sapiens
aattgccaaagaaatgtttcccccccgggggggggaaacccttttagcaggaaaaaaaagggggaaactttgccaattccccttttttttttttaaaaaaaaaattggttctaaagccca

SEQ ID NO: 727267 - DNA, 424 bp, Homo sapiens
ggcctcccaaagtgctgggattacagatgtgagccaccacgcccggcctgcagtgagctttgattgtaccactgcactcggggtgagaccctgtgtccaaaaaaaaaaaagttgaggcagttcccagataaacaaaacaacaggccaggcactgtggcccacgcctgcaatcccagcactttgggaggccgaggtgggcgaattgcctaagctcagaaattcgagaccagcctaagcaacatagccaaaccccatttctacaaaaaattttaaaagtagctgcttgtggtgtcgggcgcctgtggttcagctatgtggaaggctgaggtgggaggatcgtttgagccctggcggcggaggttgctgtgagctgagatcgcgccactgcactccagcctgggccactgagtgagcttccctctca

SEQ ID NO: 727268 - DNA, 334 bp, Homo sapiens
ttcccccccccccccctggggggggggggggggccctttttttttttggggggggggggggggccccaaaaggaaaagggattgggggcccccggggtaattcccccccccgggggttttaagggaattttcaaggggggggggatttttttgggggggggtccgggtttggggccctgttccaaagggccttccccccccccccaaaaaaatattttttttaccaaaaaatcccccggggggggaattttggggcgggttttttttgggccgggggggggggggcccaagggtggggggccccccctttttaaaaaaaatttttcccttggga

SEQ ID NO: 727269 - DNA, 1395 bp, Homo sapiens
ggcgctgtctgcagtatcagcatcccagtatcctgctcaagaagctggccccttacctgcaagtcggagctgctcccggttccagtgagctgatcttctgaggacttcgccaggttcatcctggtggaaaactactgctacgaggagcgtggtagctggagaccggtcactgaaggacatcctgcaaggctgctgaccggcaggcctgctggctgcacatagtgcaagcccaatcctctacctgggacagcactggtcatgcactaacagcgagccctaatctgcactctgcataggcctgacgggcgccacgccatcagaactgggagcgagggaagtacatgccaacacgcagagcgcggcgtgccgtgcacgcccacatgaccccacgctcaacaccagcgacgctcactgccagccttcgtctgggacacacagcgacacgtgcgcctgcccgtgcgcccagtgctggactcatcttgctgcggtccccagcgcactgcagcgcatggctgtcgtgtgcgtgccccttcctggagcgcctaggccccgtgttagctcgaccctgtgccgaccccctagcgctgtaccccctggggccctccgctgctctacccccggccgtagtcccctgtctgcggcctatgccttcgcgccccgccactgggtcactcgcagtcgccattggtgtgatgcccccgctcccttgcaccatccccgcgtcctagctctactagtctcctcccagactcagcgccgatacctctccattactgacctttcgcatcgaatcacattaactgattacacacatcaaactcccttatttttctgcccattacctgtccctctactaactactccctgtcacccctcctactaccaccactcatcgaccctctataaatacagaccagctttcccccatctgcaatacacattcacatacagcattctctcagtccaactatatcattaagcattcgatgcgccaaccacacaaatctttatatcgactcccttactcccacataattccctcccccctaccaccaatatcacactcaccacccaaatagacatcactctctacttcaactacccctcatgacaaatctcatcctctcacccccccaccacacacacaccatacttcatccacaatccctctcccactcttcacatcctcatatatcatctattacatcctctctccatcctctgcagccacccccgacctctactacacacgatatcccatctcttcccatccacccctcattaccttatctaatatcactctctcccaaacaccccctcatatctaactcccacaactaatcccatagactacatccacatcattcactccatacattatttcatctacttacc

SEQ ID NO: 727270 - DNA, 114 bp, Homo sapiens
ccaactcaggtgcgagctgcactatgtcttcagtcttacttgcgaggcttctggccagaaataggtatcgcaagatactccgtgagcacaaagcagtcatcattcagcagctcg

SEQ ID NO: 727271 - DNA, 307 bp, Homo sapiens
ctggcccgtttacggaagcacatagtctaatagaaaaaacgaaacaaataatacaagcactgctatatcacacattattactagggtctctatataaccctacctacaagcctcagagatacttcgagtctatccttcaccatttccgacggcatctacagctcaacattttaagtagccacaggcttccacggaacttcaccgtcattaattgagctcaaacttatcctcactactctgcattccgagtcgacacggaggaatccatctagacgtcagaccctgcacggcaatgcaaagccattgg

SEQ ID NO: 727272 - DNA, 111 bp, Homo sapiens
  misc_feature (103)..(103): n is a, c, g, or t
cgtgctgcggcggtacgtgctgcgggacggatacttcacgctgacggtgctgggccgctctggcgaggaggagggctgcgcctccatccccctgtcccccaanccgcccgc

SEQ ID NO: 727273 - DNA, 373 bp, Homo sapiens
  misc_feature (4)..(4): n is a, c, g, or t
  misc_feature (45)..(45): n is a, c, g, or t
  misc_feature (104)..(104): n is a, c, g, or t
  misc_feature (361)..(361): n is a, c, g, or t
  misc_feature (365)..(365): n is a, c, g, or t
ggcntaaggcctggccaggccccggcaagcactgctaacttgggnggagccaacttcacctttgtattagttattaaaaaatataatttgggctgggcgcaagntgtcacgcctgtaatcccagcaactttgggagtccgaggcatgcggatcacttgaggtcaggagttcgagaccaccctggccaatatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcacagatcatgccactgcactccagcctgggcaacaaanacgnttcgtctc

SEQ ID NO: 727274 - DNA, 307 bp, Homo sapiens
tgtgcagcctgctagacagctcctttatcagagacatagataccattcaaaaattccctgatatccttgaatttaacgtgttgtgttcttgctgaatcaaagccgctcacctttgaaacaagctcaatgtcatttccttcaaggattaattcatctttctgttcttgagatacttaacaagcaacacctgttttcatcctaacccttcggatatatttttcacccaagaaatttcgtatttcaacaagagacccattctcctgtataacaactttcattgttaatgttagcatacacagaccttatt

SEQ ID NO: 727275 - DNA, 152 bp, Homo sapiens
gagtctggacaacagaagactggactgaagatatctcactttgtcccctaggctggagtgcagtggtttgattcatgctcacggcagcctcaacctctggactgaagcgattctcctgcctcagcctcccttgtacgctgggacaggtgcac

SEQ ID NO: 727276 - DNA, 278 bp, Homo sapiens
ggaattttaaggccagtcctttataaaggcccaagccgggggaaacagggggcttttttaaaaaatgctggaaattaaatctttgaaaattttttttatgtgggaagaccccaaggatggggggaggccgccatccaaactaactttttgtagaaagccctttccttttttttaactggttccacgcccatatgttttttaccaaaaagaatgggtttaggcccccggggtaaacttttttttatatatatatataaaaattaacctttcgttgtgga

SEQ ID NO: 727277 - DNA, 338 bp, Homo sapiens
  misc_feature (1)..(1): n is a, c, g, or t
  misc_feature (77)..(77): n is a, c, g, or t
  misc_feature (110)..(110): n is a, c, g, or t
  misc_feature (120)..(120): n is a, c, g, or t
  misc_feature (153)..(153): n is a, c, g, or t
  misc_feature (193)..(193): n is a, c, g, or t
  misc_feature (195)..(195): n is a, c, g, or t
  misc_feature (205)..(205): n is a, c, g, or t
  misc_feature (207)..(207): n is a, c, g, or t
  misc_feature (211)..(211): n is a, c, g, or t
  misc_feature (213)..(213): n is a, c, g, or t
  misc_feature (222)..(222): n is a, c, g, or t
  misc_feature (227)..(228): n is a, c, g, or t
  misc_feature (260)..(261): n is a, c, g, or t
  misc_feature (329)..(329): n is a, c, g, or t
nggaggggccaggctccagcaggtacggacactgcaccctagaggtaggagcagtgggaatcagtatttccgctgcngagggaagagactactcccggaggatcggagtngggggttggnggggctggggtcctccgagtccaggctgaagangtccctcccggtacgaaggatttgctcctccagttttttntntttttttatntncganantaccttttncaggnnggcttcccgttttttgttccgggttgatcttnntggggtgtgtttccggttaattagggagtcctttggtgtcactggctcatcatcaaaatcaaattccntgggcatgt

SEQ ID NO: 727278 - DNA, 256 bp, Homo sapiens
ggatattgacatgcaacccggtttctcggatcagcatactgaccctgcgatatcgcagcgttttgttcctcagaatgaaatacagcttctcgcatttcttcaaggggccgcgccccatgcttcttagcgtcgcttgccaaactatcagctcatctagtctcagctgatggtactctggcaatcccgtatcatgtcactgtggtaatacccgtatcatactgcgtgtttccccgctaccgtccactccatgctaccg

SEQ ID NO: 727279 - DNA, 1000 bp, Homo sapiens
  misc_feature (161)..(161): n is a, c, g, or t
  misc_feature (193)..(193): n is a, c, g, or t
  misc_feature (195)..(195): n is a, c, g, or t
  misc_feature (205)..(205): n is a, c, g, or t
  misc_feature (212)..(212): n is a, c, g, or t
acgaagtgcgagctccggtaccctagcaacgtagggatttctcatggtgtaccccgggccttgtttctccaagtggccgtgatacacgtagtgagctatgttcagccctgcgttccacctgcagtagaatcttttcttctcagacagggacagtgcggccncaacatctcctggagtctagaagctgtttccntncccctccttnctcctcntgctctagccttaatactggccgttttccctccctgcccctagagtgaagacagggcactctgcgcccaccgacagtgcacagctgtgcaatggagacctgcaggtgcacggtgcttggaacacgtgtggttcccccctgggccagacctccgtctgctagtgcccctctccaccatgcccgtccttccccgacaggaagcgtgtgctgctcgactactaggtgtctccaggggtctgtgatggtgcccctgggggtcagcttctgtccctctgccttctcacctccttcgtccctttcttttcatgtatccattcagttgatgttgtattgagcaagctacggatgtcagcactgtgttaggtgctgggggccctgcgtggtgacgactcaatgttcctccctcaaggactccccatccagctgggagacagacaactaactacacgtgcaggcctgctggtttgcacgggaggcgtcctgcctggctcccgtgctccaaccgtcctctgtggctcaaggcttcctggatacctcaaccccatcccacccataattcttacccagagcatggggttggggcggaaacctggagagagggacatagcccctcgaccacgggtagagaatctggtggttgtccaacaatgtctgtccagcgtgttgctcagcgttgggcaggcaccaatggccctctggacctttcatagcagcagacaaggcagagcctggggcaaggcaggcctggaatgctttggggacaccgaggggacttgcccccacccaaca

SEQ ID NO: 727280 - DNA, 926 bp, Homo sapiens
cataaaatagaatgtgtatctgagactaaacactttgctatatagatgtgctgatttcctaatgaggtcattttcatattctacaaacccagaagattcagaaagactccttgtctgcttatgaggcagtgtccagaaatgcacagcacagtgttctggaacatagtcagaagcacagtaaacgattcgatcaaggagaacgtaagtgctctgattctggcctgctgcaagcatagatgccaggctcctgctggtgactctgtagcttggtcgaacagaacttgtccagaccatcagaggcaagaccagcagcagagctgatggagtttcagcccaagagatggttaactgccgttaagcaagttgggctgtacacaagtactgcgtagtggacaaccaacaatggggacaagctagaaaacccagagtttgcagcttgcacgtgtaaaaagtactacattgccagtgcgttagcaaaaagaaaggcccctcacagaataggcacaagtagtggatatttagatagcataacggacaatcgtactggcatttaatgaatttgctttgaccatcagcaaagatggcagtttcagatttcaagcacaaaacttgtgtgagtcatgtctggtctcattccatcatctgaacaaaaatgggctccgtgacaaattgatcaggcagttgtgccacaaggtatgtgaccttgggtaagtacagctataactcatctgagtcttgcatttcctcattggtaacaatgggtgtgaaaaatctataatatgtcagatgaccggactgagatgacgcatacccaccacatccagcagaacagcctggagacacagaataggaacggaaccaaaagcaaaatctgcagggacacaggcagcaaccgtggagaaagcaagagccaagccaaccgcatg

SEQ ID NO: 727281 - DNA, 217 bp, Homo sapiens
atgacgaggcttggatttgttggttatagtgtactcactttctcttctagaatattcattttctcaaagtcacaagatatacatttagtttagtagaacaaatatttacagatatcagacatgtatatgcactgggctaggtattatgtgagaaaaagagaacacagcccattccctcaagaaaagtagaccatcggtgacacttctaacatgacca

SEQ ID NO: 727282 - DNA, 162 bp, Homo sapiens
agtactactggaaagcacatcaccccaggagttacaggatgtacaacagtattaatttaagggatagtagcacacacacgatccttctatctagaaatcagtctcctagctaggagaaacctctttcacacacaaaatgaaatgtgtacagcttgccggtgg

SEQ ID NO: 727283 - DNA, 1195 bp, Homo sapiens
  misc_feature (42)..(42): n is a, c, g, or t
  misc_feature (479)..(479): n is a, c, g, or t
  misc_feature (492)..(493): n is a, c, g, or t
  misc_feature (518)..(518): n is a, c, g, or t
  misc_feature (534)..(534): n is a, c, g, or t
  misc_feature (735)..(735): n is a, c, g, or t
aaagctccccttgctttccgcggcattctttgggcgtgagtnatgcaggtttgcagccagccccaaagggggtgtgtgcgcgagcagagcgctataaatacggcgcctcccagtgcccacaacgcggcgtcgccaggaggagcgcgcgggcacagggtgccgctgaccgaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaatatgtagaccagggatatcagtagnacaaaagctgtanngagctcccaggagtgtgctaatgangaccatgatggccctnctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcangcaggaccacttcagccgcgcgtccagcatcatagacgagctcttccaggacaggttcttcacccgggagccccaggatacctaccactacctgcccttcagcctgccccaccgggaggcctcacttcttcttttcgcagtcccgcatcgtccgcaggcttgaatgcccttcttctccgtagcgagccccctgaagcttccacggccatgttccagcccttccttgagatgatacccgaggctccagcaggccatgcactccacttccagttgcccggcctttccagagccgcagagattctcgagaagggacgatacccgactggtttcggggagatcgccaactcccgggctgcctcgataaggcccgttgcagtccgggattttcgggcgtgtccccacccccggtaaggggggcggaccccgggtgggggaggataggggcccgaggccccctggc

SEQ ID NO: 727284 - DNA, 329 bp, Homo sapiens
tttttttttttgagatagagtcttgcccagggtggagtgcagtggcgccacctcggttcactgcagcctctgcctcccgggtttaagcgattctcctgcctcagcctcctgagtagccgagattacaggcgcatgcgccacacctggctaatttttgtatttttagtaaagatggggtttcaccatgttggtcaggctggtctcgaactcctgacctcacgatctgcccacctcggcctcccaaagtgctgggattaattacagatgtgagtcaccgcacccagcccagataaagaaaatttgttaaaaactagatccccaataataac

SEQ ID NO: 727285 - DNA, 694 bp, Homo sapiens
  misc_feature (694)..(694): n is a, c, g, or t
gggccacaggcgcacccacacgcgcggctaatttcgtattttagtagagacggggtttcaccctgttagccaggatggtctcgatttcctgagctcgtgatccgccgcctcggccttccaagagtgctgggattacaggcgtgagccgtcgctgccctcctacctctacttttttctatctctgggactaaacggcggccggcggcgtgcctgcggtgccaaatgccggcatgctgaaactcagagagggaagatgtcttgcaagtacatgcagccacagctccagagtttcgctcgttgattccctgggcgtgcagatgcagctggcaccatctcggtctcacgcggaacctccggactcccaaagttcaagcgaattctcctgcctcagactccccagatatctgggattacgagtaaaattataacaggcacatatgatatcctggcatgacaagagctggaggctgtcattctaagcaatgtagtgacgactggctgtcttgtctcagtgcccacccctggaagcatgcgcaggaactcaagagcagcatagcacagaggacagtgtctggtaggtcgaaaggaaaacacaacaagcagcgaaacgcagctccgtgctcgtgagcaccccatattgaccaaggtaaccacataaggcaacagcaaagatgaccttgggactgaggtggan

SEQ ID NO: 727286 - DNA, 405 bp, Homo sapiens
cttcacgatcatgtatattctatatcttttctttgaaaataagtggattcatatactccacagtattctgtgagtggacctctagtcacgtaacagtctacatatcgctgtatttatttaatggtaccacagttcctcttgaaaatatttctgagacatcgggatcagttggtaacaggtagtttagaatcacattctcaaggaggaacctgaagtggctcagaatggagttcgtgtctctcattgctggtgctcagttgtgacagccaggaatttgatcatgtagctgcatcctcaattgtcagggtttgagtgaccattagggaccacctgtgtagttgatcacacttctcatgggagaggagtttgttcactgcgtactgcggaaccagtcagcattaacca

SEQ ID NO: 727287 - DNA, 173 bp, Homo sapiens
agtgagacgacgtgttggatgagtgtggacgtggggtgggggaaaggtaggtgttatattttactccttttgactaaagggtagtctaaagattgggtctaaacaacactgttcccttccttagacagaaaatattactttttttttttgaccgagggtaacaccacagaacg

SEQ ID NO: 727288 - DNA, 163 bp, Homo sapiens
  misc_feature (25)..(25): n is a, c, g, or t
  misc_feature (33)..(33): n is a, c, g, or t
tatttacataatgtcaaacggatgnatatagcnatatagccaactacctttaattaattccacataaagatttaaaggtagttggctatatcgtatcatttcattcttttgacattatgtaatattttactgcggaaaataagactaataaattgttccaaaa

SEQ ID NO: 727289 - DNA, 719 bp, Homo sapiens
ggcagctatccggttcaatctaagagaataacaattttgggagacacttataaaaataatgtgatgttagcttaaacattacacggacattacaaccttacaacttaggtgagagaggctttggttatgctgagttgcctatgtgctagtgataacactacccctttcttctaagtaaaatatctcaggatacaagtgaaaaataatagtactgttatcgagttctctttggtggtcaccatgatgtgtgttgaggagcagagtgaacaaaggcaacctgatccctgtctctgtagagcttagtctttattcactgccagtattttatttttgcttcatagctaattgagacacattgatacctgatgattgggaggaactgttctaatgcgatttgtaaaaggagaattcaaattggaagtaccagctaggcacggtggctcacacatataattccagcactttgagaggctgaggtaggaggatcacacttgagcccaggagtttgagaccagcctgggaaacttagggaaacccgatctctattaaaaatttaaaaattagccacgcttggtggcaggcacatatagtcccaggtaacttgagagattgaggtgggatgatcacttgagtctgggaagtcaagactgcagtgagccatgatcatgggactacactgtagcctgggtgacacagcaagactctgtctcaaaaaaaaa

SEQ ID NO: 727290 - DNA, 944 bp, Homo sapiens
  misc_feature (294)..(294): n is a, c, g, or t
ggcgcgaaggtggctggtgcgtaccgtcccgaacccggtaggagccgagatcccacccgcaggaccccaaaacccaatgatcctgcagcagcccttgcagcgaggcccccaggaggggcccagcgcctcccgcgggccgccttgggggtgacttggggcctggacgccagctcccctctccgaggagctgtgcccatgagcaccaagcggctgcctggaggaggagcaggagcctctgcgcaagcagtttctgtctgaggagaacatggccacccacttctctcaactcagccntgcacaattgaccaacccgctaactggcagcctccgcccaattgaccttttctcgccgcaggccttgcccccctattcagtgagatcctttgctcttggagcttgcttctcttggcgcttatccctgggagcttcatcctgtaggccctccgtctgctgaggctgggggacacccccagtcccacctacctgtcaaacccgcagctggggacataatggagctctgagtgctggtggacagtgccacctcccacttcattgttcccaaaagaagagacagcgtattccgccaagggacaggttcctcactctcctgcaagtaggcatctgggcccaagacttccctcagagaggacatgaggcccaacggaggtactgggaatgggaaggcggtgggagccattggcaaggaggtctcgcacccccacgcagaactgccttccgatggctggcaccacaacataatcacagataccgaccacactgaaccacacagaaccaacaaaacaccaacaaaaagtggcgcatcatatatccaggcaaccactatcgcaaaaatacaaaaggagcaggacataacaaaccacgcgccagaggcgaacagacgctatgagcaaacaggggacgcgacaaaaccgggtagaactgtc

SEQ ID NO: 727291 - DNA, 249 bp, Homo sapiens
  misc_feature (237)..(237): n is a, c, g, or t
tgatataacgaatgtcgagctcggtacccatccggttcaatgtgtctcaattagctatgaagcaaaaataatagtactgttatcgagttctctttggtggtcaccatgatgtgtgttgaggagcagagtgaacaaaggcaacctgatccctgtctctgtagagcttagtctttattcactgccagtattttatttttgcttcatagctaattgagacacattgaaccgatagctgcngggtccttagac

SEQ ID NO: 727292 - DNA, 243 bp, Homo sapiens
  misc_feature (39)..(39): n is a, c, g, or t
  misc_feature (218)..(218): n is a, c, g, or t
ccgtactcgatcacacggagagcagcttgaaatcgcctncctcaatcaaataaatagcatcgaattcctctgagtgctgggtcatcatgatttccagcaatcttgcgatatcctcttcccccagactgtcgttaatgattggattggacaaaagcagcagcaagccttgaatattgttcataaatgttttcaaataattctcgacctgcacgactgantcctgaagcaccgcctcgttgtttt

SEQ ID NO: 727293 - DNA, 277 bp, Homo sapiens
actcccccttaacccccccccccgggggttttttttagggtggggattccccggggcccccccccccaacccaggggtgggggcaaagggggattttcccgggtccccccggggggggttcactcccgggagaggcccccccagtgggagccccccctttttaaggccccccgggccggggcaaaaagggccccggcccccaaggccaaatctcgggggggggtaaaaagggaaagtgggcgggggccaaggaaaaaacccccttttaaaccgttta

SEQ ID NO: 727294 - DNA, 584 bp, Homo sapiens
tgatataacgaatgtcgagctcggtacccatccggttcaatgtgtctcaattagctatgaagcaaaaataatagtactgttatcgagttctctttggtggtcaccatgatgtgtgttgaggagcagagtgaacaaaggcaacctgatccctgtctctgtagagcttagtctttattcactgccagtattttatttttgcttcatagctaattgagacacattgatacctgatgattgggaggaactgttctaatgcgatttgtaaaaggagaattcaaattggaagtaccagctaggcacggtggctcacacatataattccagcactttgagaggctgaggtaggaggatcacacttgagcccaggagtttgagaccagcctgggaaacttagggaaacccgatctctattaaaaatttaaaaattagccacgcttggtggcaggcacatatagtcccaggtaacttgagagattgaggtgggatgatcacttgagtctgggaagtcaagactgcagtgagccatgatcatgggactacactgtagcctgggtgacacagcaagactctgtctcaaaaaaaaa

SEQ ID NO: 727295 - DNA, 81 bp, Homo sapiens
gccgaggacacgggtgtgtattactgtgcgagagcaggctgcattagcaactgccctcattgggacaactggggccaggga

SEQ ID NO: 727296 - DNA, 258 bp, Homo sapiens
ctaatcattactctcatcatgttactcccccatttacatcacttctccttgcctcaggtattaagtccaaacccttcaacagcccctgctctgccctgccttgcaaggcagcgtcattgcttgcccctctccatttcatctgctatggagtccaactgagcctcatctgccctttgaacacacactctttctcctctgggagtctctgaagtgggtgatatcctctgcttataataagcttctgactcttacctccct

SEQ ID NO: 727297 - DNA, 537 bp, Homo sapiens
gggggtcagccccccacccggccagccgcacctgtccgggagggaggtgggggtgtcagccccctgcccggctagctgcctcgtccgggaggtgaggggcgcctctccctgtgccacccctactgggaagtgaggagcccctctgcccggccagccgccctgcctgggagggaggtgggggggtcagccccccgtctggccagccgccccgtccaggagggaggtggggggtcagcccccacgcggcaagctccccgtcctgggaggaggtggaggggtcagtccccacgaaccggacagtctgaccatgtccgggagggaggtgggggcgagagtcaggacacccgagccggccagccgaccggactagggagagtggaggggtgccatatgcccctgtggcgccacctaactgggaacgtgacggagccaccattcatgtgctggccaacatgcaaggtatgggagcgtgtagccataagctcatttgagaacgtgagcatgatgaccaatgcgcgggataggtggaactagaaa

SEQ ID NO: 727298 - DNA, 750 bp, Homo sapiens
agcggagtctgctcggaggtctgtcctcggagcaggcggaggtaaagggcacttgagctgagaccagattgccggcattattctattaacccctccctctctcccgaacccgaatctctgttacacccttcgtctcacccgtcgcatcgaagtaggacaatggcggtagccgccggatgccagtcagttcccagtatcgaatctgcgctcggttagtacctgcaggatgccgatgctagttccgggacacgggccgatgttacgaggagcgaaagtgagtcattgcgctgaacctgcgaggagctgagaaaaagcgatgaagagagaacggtcccatgtggccgcgttcgcaacgaattgcttgaactatattcctcggatacggatgcgttgaccgaagaaactgggtgtttagccctttgaggtgaatccaatagtttgcagtcaattagctgggcttagaaactcttgactaccctcatcttgaaggagttgcttgcacttcgatggagacttcagttagaacgtccaatttgttagggcatacattcccttcttcatggtccaagcccaatggtaggacgtaaacaaaggtagtccttaagccacaggtccattgacccctctcccagaaggcgcttcgaattcacgaaaagggtcactgaactagaaacttgggcacattgcccacttcagcagaggagctcacatacagcgttggggacctgtaaagatcgatacagtctactg

SEQ ID NO: 727299 - DNA, 391 bp, Homo sapiens
  misc_feature (14)..(14): n is a, c, g, or t
ggccataggatgtngggtgagccggacagatactgcgatttacagacgatttctctacttgaagagctattgttcacttgcgtgtaagaaaaaagaaaaacaaaaggaaagaaaaagaagaaaagaaaaaagagaaagaaaagaaaagatgcgattccagccccttttttgggtattttttatttttgccatgagtctcctttttatcagtgaacagaaaccagttaactttcccaaggagaagaaaactatacagacacaactgctttcgcaggagatgcattccacttcattctccgagtgcccttcccatggagaaaacctctaatttccttggctctaccagaagaagggtgaaagcaaagatacccaatcaccgggaaaaacaacc

SEQ ID NO: 727300 - DNA, 700 bp, Homo sapiens
ccggacgagactcaagatgggcgctgggaatataggagagagaaagaatgtattgctgcttccaaaaatacgaccaaataatacattttttatgaaaaaagttgctagcactcaaggggaggggtacttataggataggggtcgatacccattacaatgtgtaggatttcccgtgaaaggtaaaaagaaaaaagaggacattaaaaaaaaaaaaaaaagaaaaaaatagagccgtgtggggcggttgggggaaggggattgtagagtggagaaagtttatgaaggggggggaaattggaggtaaatggggcaattggccttatagggggtggtataaaaatgaatgggcggaggttttacaaaggggggaatggggaaaaccttggggttaccaaatttaagggctttgaagaaaatggacttttggcaaggtggggaaaaggggaagaggccgggacggatgggctttcaaaataatggggaagctggaagggggaagggaaattgggaggggtaaatatttgggaaaaattggggggtaaaagttggggaaaataaggtaagttttttaaaaaaaagggggaaatgggaaaaatccttaaaaaagaaaagaaaagaccggggatagggttgggggtggttgaagttgggaaaaaagatcgaaaaattaaaaaggggggaataaaaggtaaaagggggg

SEQ ID NO: 727301 - DNA, 213 bp, Homo sapiens
aggtgatctagaggatccctgccgttcactggaggacagcaggaccaggagacctggaatccgggggagcagcaggccttgttcactctctcgccagcgggaccagcagggccaggtggtccctgagctccagcctctccatctttgccagcaggaccgggattggcgagtgatgtggggagctctagttcgcaagtcatggtcgtagttgct

SEQ ID NO: 727302 - DNA, 682 bp, Homo sapiens
  misc_feature (56)..(56): n is a, c, g, or t
  misc_feature (85)..(85): n is a, c, g, or t
  misc_feature (339)..(339): n is a, c, g, or t
  misc_feature (355)..(355): n is a, c, g, or t
  misc_feature (552)..(553): n is a, c, g, or t
cgtcggtaccgtcagccattttccaaggtatagattagaagcagccacgggtctgnctacactccaagggagaggagattacacntggcattatccaggcaagaagctaaggggtcatctcagaattctgccttccaaatagatcctcggtggagctcaaatgcctgggcgagcaccagcctttgtttaaaggcaacagagaatgctgccctgtctcagatcttcagcaagcctccagaatgatggtccagtctctgagcccagggccaaggcagcaggagctttgggcgcacatggggactggcttcccccactttgaagtgaatcatcacatccgtnttagaccctagctgtngctcaggcaaaaatgatgatttagaagaagatggagagaagaggagagttaatttaaaagcacttatatttggccgggcacagtggttcacgtctgtaatcccagcactttgggaggccgaggcaggaagactgcttgagcccaggagttcaagaccagcctgggcaacataggaagactctgtctctacatagaanntttattataaaagtagctggggatggtggacacacctgtagtcccagctactcaggaggttgaggtgggaagactgcttgacgccaggagtatgaggtagcgtgagctgatatgcactgaatctaccta

SEQ ID NO: 727303 - DNA, 1104 bp, Homo sapiens
  misc_feature (113)..(113): n is a, c, g, or t
  misc_feature (118)..(118): n is a, c, g, or t
  misc_feature (123)..(123): n is a, c, g, or t
  misc_feature (157)..(157): n is a, c, g, or t
  misc_feature (216)..(216): n is a, c, g, or t
  misc_feature (242)..(242): n is a, c, g, or t
gagcgagcgtgccgggccaggtcaagcggagggctccgacggcgcggacggagcgaagcgccgagccatggcgcaccaaacgggcatccacgccacggaagagctgaaggaantcttngccanggcacgggctggctctgtgcggctcatcaaggtngtgattgaggacgagcagctcgtgctgggtgcctcgcaggagccagtaggccgctgggntcaggactatgacagggccgtgctgncactgctggacgcccagcagcccccgcctaccctgctctaccgcctcgactcacagaatgcatcagggcctctcgcaactggcctcttcctcgccctggctcgcctgactaacctccccccgtgcgcccccgcaagcactgcctgcaccgcccggcccacgccgcccgccccaccagctgcacaacaacgcactcccggcgcgctggccccacctacccccgcccgcagcctccaccgcgcgcaactcgccgacaccgcatcgcaccctcctcctccccgcccagcgcgcctacccacgacaccccccctctcccctcccctgctgccggccaccctgccccccgcccctgcaacaccctcaccgcctgccaccaagacgcaagccctcacagccacccactcccggccactccacccccacggcagacccgaccccgcacgcactcccccccgctcgcgcccaaccccacacacaccccagaaccccctggccaagccggcccatcgacccattcacccaccctgcccgcgccccgagcgcccccacacgcggcaaccccccacccacaaccctcccacagccacaccacaacgcggcccacacctaccccctcccacgactcgcacacgcctgccccccccagcaagcccgccaccaaaccccaccctgaaacccacggggcggaccaccacgccacaagccccacaagcgcaccgccagcgcccccaggcactgacgacatacccggacaggcggcccccgcacgaacgtgccggcccacagaccaccccccccccgccccccactgaacccagccccacaacccccatccacaggcggcgacacctcccctgtcggcc

SEQ ID NO: 727304 - DNA, 638 bp, Homo sapiens
  misc_feature (113)..(113): n is a, c, g, or t
  misc_feature (118)..(118): n is a, c, g, or t
  misc_feature (123)..(123): n is a, c, g, or t
  misc_feature (157)..(157): n is a, c, g, or t
  misc_feature (216)..(216): n is a, c, g, or t
  misc_feature (242)..(242): n is a, c, g, or t
  misc_feature (497)..(498): n is a, c, g, or t
  misc_feature (518)..(518): n is a, c, g, or t
  misc_feature (525)..(525): n is a, c, g, or t
gagcgagcgtgccgggccaggtcaagcggagggctccgacggcgcggacggagcgaagcgccgagccatggcgcaccaaacgggcatccacgccacggaagagctgaaggaantcttngccanggcacgggctggctctgtgcggctcatcaaggtngtgattgaggacgagcagctcgtgctgggtgcctcgcaggagccagtaggccgctgggntcaggactatgacagggccgtgctgncactgctggacgcccagcagccctggctacttggtctaacggcttggaattcaaaagaaattggcttcaggggctttcggaaattgggttctttccttcggcctggtcggccttgattaactttcccccggttggcgggcttggaaggatggctggtacggcgggcccacgctggggccacaggtgcaaaaaggagtttgcgaggtggccacatcacaggattgagctcttcggggactgtgaagggatgacctnnctcttttgctgggtaccagnaaacacnctgttcgtcctgtgcggcacctgccccgctgacctcggctgagagagagctccagcagatccgcattaacgaggtgaagacagagatcagtgtggaaagcaagcaccagaccc

SEQ ID NO: 727305 - DNA, 671 bp, Homo sapiens
aaggttgccagagatgatgttgattgtaccacttccagaaactggttcgacaacgacgtaggtactgccattctcaagatttatctcaccgttgttgacagaacctgattcagctctacgttgcaaaccagagacggaaccaccattgagaatagcatttgagaaagagaaagcaccagagttagagtaaggagagaatgtgacttggccctttgtggactctgatagactcaaagaaatatcaccactgttatcgaaagagcctggagtgaaggagtatgcagatgcggaagaagcagcaggctcttcagcgttaaaggtaccagatacatcaaagttttcaccagaaatgtcgaattcggtacctgggtaagttggcttagacttttctacgaaaacgccaccatgtattatgaaatcagcagaaaaaacgtatttgtcaccatcaagtagggtcaacttaccacctgcagcgacttcgacagcttcagttgcaatgactgaaccggtgagtgtaatgtcaccactgatggttgtagaaggcaaataaatagtaccatcgctggaagaaagagagttggaagcagttgcagttgcactagaagccgaagaggtaatagaacttaaggtaccggaggtgatagaaccggaggcagtggaagccgatgagg

SEQ ID NO: 727306 - DNA, 260 bp, Homo sapiens
ttgcacgtaacataacaacctactcatctagaagtaggaaaacaactaggatgactgaagtagagacctgaagtgtgacggggatctagccaaatgcagttcacaggtatagcatcaggtagacagcaccaagaaatacagcccctaaaatgtcgagatagtatacggaaaacttgccgtgtactatatataagtaatacctcaatgagataaagacaccatgaggtactaagataggatagagagagactatatcaaca

SEQ ID NO: 727307 - DNA, 218 bp, Homo sapiens
  misc_feature (3)..(3): n is a, c, g, or t
tgntgacctgggagttcatgaagtttctcggttggctgagtggaacttggtgaggttgaaggagcttcatcgcatcagcacgtcctcttgtgattcatcctctccagcttctgctcactagtaattgtagctgttcccagagtccgccagtccgctctcaaggcaagctcagtctagtcagggtcgctccaggactcaggttctcagagccatgcagt

SEQ ID NO: 727308 - DNA, 679 bp, Homo sapiens
ctgaggcttgagaatggcatatacccgggaggcagagcttgcagtgagccgagatcgcgccactgcactccagcctgggtgacagagagactctgtctaaaaaaaaaaaaaaaaaagatacattcagggtgatcagggtgcaccaagcagacatgaaggaggagctctgtcatacggaagtcctcgagtgctttgcacacctatagtaatgcaccatataacatttagatcgacaacagattgcatatatgtggtggtcccataagattataatgaagttgaaaaattcctctcacctagtgatgggttaaatgtcatagcccatcgcattagctggtgcaaacatatctgcgctgaattacatacaaagtataccactacagactgcttacctgcggaataagccattttttggtcctttaacttcttaattaaactggcttcaactaaagattatcacttccattatggaccagttatactaactggttaataaacacccaaggtacctggttctggaattaacttaatttcaattataaattaagaagggacttctacttaattttttaagagaagcaccggtattatacggaatgacaggtccagcattgtactggcccctgaaacacttcttggcaagatatgggggatgggagacggattctgatcatctcct

SEQ ID NO: 727309 - DNA, 109 bp, Homo sapiens
  misc_feature (40)..(40): n is a, c, g, or t
  misc_feature (56)..(56): n is a, c, g, or t
  misc_feature (74)..(74): n is a, c, g, or t
attttctaagaaagattggtatgatgtgaaagcacctgcnatgttcaatataaganatattggaagacgctcgnaccaggacccaaggaaccaaattgcatctgatgtc

SEQ ID NO: 727310 - DNA, 116 bp, Homo sapiens
  misc_feature (48)..(48): n is a, c, g, or t
atatccaaacagtgtccctcaatgactctgtcccatcctgatgatcgngaatatacgcacttttgaaggaccccaaaatcggtctctccaatcagcacacagcatgggaagggccc

SEQ ID NO: 727311 - DNA, 156 bp, Homo sapiens
agtatcacagctctgggggacaggttcttcacttccttcagaattctatatctagcctcaaatatcgccaggaggccagggaatacaagtgcaatggccagcattcagtccagcacgactggcaccgggaccgtgtagggatgagggactcttggc

SEQ ID NO: 727312 - DNA, 173 bp, Homo sapiens
tggctccagccggccggatcagtcggtgacacggagggttggctttggcattcgatgcgccatttgacacggatcaactccggagcaaaaaacaaccacgccttcgcgtaccaagccgatactgattcgaatccgttcatgacgtatcgggtctttgccgtggtacgcagatg

SEQ ID NO: 727313 - DNA, 673 bp, Homo sapiens
ggaaaagctatcacaggaatcagctatcacccggaagcatcctttcatgaggaacacgatttaactcagaattacatctttaaataggagctagctttgctagctatctacagatatgagccactaaatctcatgtccaaaatagaaggttttaatcgactcctatgaacacaggttaaatagcatattttgttgttgttgtttacgtgtatgctttttcagaaagttacttaggtccatacatttatccccctatatttgaaacaaaattctgctttcttacaagccccttttcagttaatctcaggtggctatcatacttaaaattgtggagaattattttcatccataaggcctgtaggaagatgcccctacctcaaaacttattgggataaagtcaaaaaagggtcatcctcttaaaggtaaaacaggaaaatattaatcaatcctagatttggaacaataatacactgtgcaatagagtctggacatgtgtggctggtgggtggagattctgcaaagccatgagtccctggaaggtaaccagcagactaattttacagtgtgacatagcttatcacaatagcggacaggaacctgggtttaaagaggactcacttgggcagtaatcctggcctgtcgtctcaggaatatgaccttgggcaaacatact

SEQ ID NO: 727314 - DNA, 372 bp, Homo sapiens
atgttacttgatggagttggtcacatgagggaacatctgggttatgcctctttttaaagtagttttctttaggaactgtgcagcatgtggtggtggaagtgtgggagtgtaactctgcgtggtactatggacagtcaacaatatgtacttaaaagttgcgctatagcgaaacggggtgtgattatccaggtgactcgctacactatattttttgtgactgcgtgggtcctgtgaccagaaacattttcttttatagtggacttgcgtttttaaactttgtgtagccacttaaaatctgcgttatggcaacaatttgcctcaaaatccattccaagtggtgatatttgtgttccaactataaaaattacaact

SEQ ID NO: 727315 - DNA, 851 bp, Homo sapiens
  misc_feature (48)..(48): n is a, c, g, or t
  misc_feature (63)..(63): n is a, c, g, or t
  misc_feature (71)..(71): n is a, c, g, or t
  misc_feature (73)..(73): n is a, c, g, or t
  misc_feature (81)..(82): n is a, c, g, or t
  misc_feature (96)..(96): n is a, c, g, or t
  misc_feature (111)..(111): n is a, c, g, or t
  misc_feature (113)..(113): n is a, c, g, or t
  misc_feature (118)..(118): n is a, c, g, or t
  misc_feature (121)..(122): n is a, c, g, or t
  misc_feature (126)..(127): n is a, c, g, or t
  misc_feature (135)..(135): n is a, c, g, or t
  misc_feature (139)..(139): n is a, c, g, or t
  misc_feature (141)..(141): n is a, c, g, or t
  misc_feature (152)..(152): n is a, c, g, or t
  misc_feature (163)..(163): n is a, c, g, or t
  misc_feature (166)..(166): n is a, c, g, or t
  misc_feature (180)..(180): n is a, c, g, or t
  misc_feature (187)..(187): n is a, c, g, or t
  misc_feature (195)..(195): n is a, c, g, or t
  misc_feature (199)..(199): n is a, c, g, or t
  misc_feature (207)..(207): n is a, c, g, or t
  misc_feature (219)..(219): n is a, c, g, or t
  misc_feature (224)..(224): n is a, c, g, or t
  misc_feature (226)..(227): n is a, c, g, or t
  misc_feature (238)..(238): n is a, c, g, or t
  misc_feature (248)..(248): n is a, c, g, or t
  misc_feature (267)..(267): n is a, c, g, or t
  misc_feature (273)..(273): n is a, c, g, or t
  misc_feature (279)..(279): n is a, c, g, or t
  misc_feature (281)..(281): n is a, c, g, or t
  misc_feature (285)..(285): n is a, c, g, or t
  misc_feature (289)..(289): n is a, c, g, or t
  misc_feature (296)..(296): n is a, c, g, or t
  misc_feature (307)..(307): n is a, c, g, or t
  misc_feature (309)..(309): n is a, c, g, or t
  misc_feature (313)..(313): n is a, c, g, or t
  misc_feature (324)..(324): n is a, c, g, or t
  misc_feature (327)..(327): n is a, c, g, or t
  misc_feature (329)..(329): n is a, c, g, or t
  misc_feature (331)..(332): n is a, c, g, or t
  misc_feature (334)..(334): n is a, c, g, or t
  misc_feature (344)..(345): n is a, c, g, or t
  misc_feature (349)..(349): n is a, c, g, or t
  misc_feature (351)..(351): n is a, c, g, or t
  misc_feature (354)..(354): n is a, c, g, or t
  misc_feature (368)..(368): n is a, c, g, or t
  misc_feature (375)..(375): n is a, c, g, or t
  misc_feature (382)..(382): n is a, c, g, or t
  misc_feature (386)..(386): n is a, c, g, or t
  misc_feature (396)..(397): n is a, c, g, or t
  misc_feature (408)..(408): n is a, c, g, or t
  misc_feature (420)..(420): n is a, c, g, or t
  misc_feature (422)..(422): n is a, c, g, or t
  misc_feature (430)..(430): n is a, c, g, or t
  misc_feature (436)..(436): n is a, c, g, or t
  misc_feature (454)..(454): n is a, c, g, or t
  misc_feature (466)..(466): n is a, c, g, or t
  misc_feature (479)..(479): n is a, c, g, or t
  misc_feature (483)..(483): n is a, c, g, or t
  misc_feature (506)..(506): n is a, c, g, or t
  misc_feature (527)..(527): n is a, c, g, or t
  misc_feature (536)..(536): n is a, c, g, or t
  misc_feature (539)..(539): n is a, c, g, or t
  misc_feature (543)..(543): n is a, c, g, or t
  misc_feature (614)..(614): n is a, c, g, or t
  misc_feature (622)..(623): n is a, c, g, or t
  misc_feature (626)..(627): n is a, c, g, or t
  misc_feature (631)..(631): n is a, c, g, or t
  misc_feature (634)..(634): n is a, c, g, or t
  misc_feature (641)..(641): n is a, c, g, or t
  misc_feature (645)..(645): n is a, c, g, or t
  misc_feature (647)..(647): n is a, c, g, or t
  misc_feature (662)..(662): n is a, c, g, or t
  misc_feature (664)..(664): n is a, c, g, or t
  misc_feature (690)..(690): n is a, c, g, or t
  misc_feature (791)..(791): n is a, c, g, or t
  misc_feature (818)..(818): n is a, c, g, or t
ttatatttctttacgaattccatttaaaaaagagaaatctctaaaatnatcaatacgcgggtntttaatcnanttttaagnntttccccaccagcnttgcagtcacgggangnatgcntgnnttgnnctcttggnaggntnggacagcttgntcatggggttngtncggggcggcggganccttgantaggggcngggnggccttcnttcttccttgtncggtngnngtctttggggncaggggggtngggtgctcccacttgggtngggtgnggggcngnggcngtcngggtggngtttgggggtngngggnggggttggggnggngngnntntggggttggnnttgngngcnccagtggggggggngccctcnggggggngtgngcgggggggnnattcaattggngggggggggggncnttcggggntgtggnattggatgggtttgaatnatcttctttggnggtggtccatctntggnttaggggaatacaggcgtttgtnggggtgatataataattgggntttatgggnggnagtncaggagagtagagccaggcattccaatcaacttgattgagaacatcaaccttatctttaaaataggaatanaggaaatnnttnnagtnatnagtagtnatgntnttataggaaaaattntnaaaataagcttttaagaatcctaggnaaatctctggtcctccaagcagttgttcaaggtaaaaaagtaaagcaaagcccttctcatagggaactgaagaataagctacatcagggtctatatctgtnagatcaaccacaagtttggtgaaaggntgtgtctccccaaatgtctttaccgaattctgt

SEQ ID NO: 727316 - DNA, 394 bp, Homo sapiens
ggcgatcgcagctgcggcgggtcacggatgacgcccctccccctgcaacaatttttgcatccaggttttaccgaacgcctgtgtaagatggccgtcacatcactcatattcaggcaaccagactatgaccgtggccttgacctccatcaagatcagcaccgacttcgacagcggcaacattcaggtcctggatgccagcgacgcttatcagttgttgctggcaatcaaacccgacacccgcagcgatcactaccaatggttccacttcaaggccgaaggcatgcacgtggggcacacccatacctttcgcttgagcaacgcagggcgctcgtcctacaagcatgcctggagcggctacaacgccgtggcgtcctacgaccttatggggcgctga

SEQ ID NO: 727317 - DNA, 364 bp, Homo sapiens
attgtatgttgcgtgtctatttgtaattgacgacttgctcgggggacatacggttactgtgacttacggacgtacgggttaggactgacgtgggacgacgaccagcgacggaagtaagtataattatgccttatatgggttagcggtgctgatggaggtggagatttggtgctgtgaaattgtttataagagtaatagcttttctagtcaggttaaggtctaggaggagtaggggccacccagaacttcccaaaaaaagccagaggaggctccatcagcacccccatgacccccaggactgatataatcgttcaaataaaatcaaaacctttgccttgcaaattgagactccacgtacggggta

SEQ ID NO: 727318 - DNA, 102 bp, Homo sapiens
atgttcttggatgcttcctctacgttagtggaatccaaggctgaggtctcgatgaaggacaagttgttcttttctgcgaaggcgcgggcctcatcagtgggg

SEQ ID NO: 727319 - DNA, 351 bp, Homo sapiens
atgcttctcatgcctagagagcaacgtagaccaaaccatgcatccgaaggctgtgcaactgacacaggagacttggcagcgcacatatacttcatgagcgtggctagacgaatagggagcatggaccatactgtcgttggtaccacactgtactgcatcatatatactgtacatcgaggaatctctgctgggagagccagacctgagtaccgattgcccagctgtgggaactactcacaggatatgacccctatacggataggtctctggggaatgctccaggatgtaagtaaccagactttgctgaaggctgagacttaagtcttacacttgtagacaagctctgtgagc

SEQ ID NO: 727320 - DNA, 805 bp, Homo sapiens
ggccctattccggcaggcgctgctcttctgtggtatccgcgatccacttaagtgatccaggcagacttgagtgacaagactggatttgagcagcgcttctcgagagccagaactgagcccagtgagagcgcacacctggggcagtctggattcctggggtgtccccggcagcctacacacagccatgcgactacccatctgacactcctctttcctcatcctggccaatggggcccaggccctttcagcagtctgcgcccttcacagtgcccagcggctgagcactggccaaggtggccagggatgcagcgtgcatggacggccttagttcggatactggctcgctgtgacatcatggctgctgcaggacggtggtggcactcttccggcagcgtccatcccgctcctgcttcgacgaatctcaatctgatttcgactggctctgggcacctactaggacccctgagacaggccccagctggggctgcagcacctacatggagacgtatgtgtacttctatcggtcaccacaaaacacaggtcctgatgttcctacgtagtacaacgattgaggatgagcgtctttgcccgggagccatttgtgggccagttctctttggccaggaatgtacttcccagcctggtgtaggtcccgatggacatcaatcgcttaaggccagaacagaaggatgctgaaacgcccctcttacgatgctagttctggagtgtctccccaggcgactggcgagagcaaggacgtgaatcctgcttggggacttcaatgcttgcttgcgcttcactgacc

SEQ ID NO: 727321 - DNA, 263 bp, Homo sapiens
accgacataatcaccgaccaacaatgactaatcaaactaaacgtcaaaacagatgatagacatacacaacactaaaaggacgaaccatgatctctatatactagtatccttactcatttttatcgccgacaactaacctcctcggactccgtgcctcactcatttacaccaaccagccaactatctataaacctagccatggccatccccttatgagcgggcgcagtgattataggctttcgctctaagattaaaaatgccct

SEQ ID NO: 727322 - DNA, 412 bp, Homo sapiens
  misc_feature (156)..(156): n is a, c, g, or t
tgatgtggagtcttggttgtgctctgtgtgagttctgtcaggctctgatctggcatcttcttcttagaagcaggcttattactggagccttagaaggcagtttagccctaggactagtaacggccctgtgaacaatggtctgctgcatctgatggncttcagggccccttcagtttccatttcctcccttctgttcctgcaggcttctttctgttcccgtccgtctttcccctcctgcttccagtctctagagagtcaaggcacagtgatgactttcctgggggttgtttctgggacctcctgttgaggtggcaacctaagactcctccagcaaagtcaccaggggaacttcctcacagacagagtcaccccggggagcttcctcacagacagagtcacccaggggagcttc

SEQ ID NO: 727323 - DNA, 193 bp, Homo sapiens
  misc_feature (53)..(53): n is a, c, g, or t
  misc_feature (164)..(165): n is a, c, g, or t
ctccttacgctggtcatttacatgtacactacatagcaagtgatactcatgtngcatgttctttaaattagtgatttgtgtcttaagtctttaacttccaataattcatcatgtatgtaaccttccatgtctgcttctgataaatgggagatgtaggttcactnngccacttcaggagatatactctgctcac

SEQ ID NO: 727324 - DNA, 127 bp, Homo sapiens
attaaaaaataggaatataatctgtccacatcaaagaatgggaagtcgaagtgtacacaaaaatgtggtcctgacattaatatttctacctgataactattaagagtagacaaacttttaaagtgca

SEQ ID NO: 727325 - DNA, 1359 bp, Homo sapiens
  misc_feature (1078)..(1078): n is a, c, g, or t
tctcaatgttaccatatacccgtggtgtttccctacatcaccccttcgttttttttaccacgttcctccgcacgctttttctgtggtcttgtttttttttgtgtctcaaagttttgatacctctttgttggtataaaaacagttttgcacccacccatttgttatttgctttttaaataagttgtgtttctctaagagtgtctccagggtctcctttttttaagtgggggtgatactccgtctccctcctctggtttattattatataattgtggtgtttcacacgggggaataataattgtatttcatggatagttcctcccacaggctgttgtgttcccggtgtaaatggaattgggagtaaatataaatcggggcccgtgtcgtttgcctcccccctgtgttttctcctctttatgttggaagggtggatataatttgtgaacattgtcaaacatttttgtgtgcgcccacagcggcctctcttgtgtgactttgtcttgtagtgtcctcctcacacaggtgtctcccaaaggtgataccccccctttttctgtctttcacaccctggtctccccatcggggtgtatcccctcttttgtttttttgtgcaatgtttattttattaagggcgcccgcacgttatgttctcccacttggatggtagcaccccaccactctcttctcttgtggggcacacgcgtgcccactaagtgtgtttctgttgggagcgcacctctttaaataaaaggacccggcttggggtgtccccccgttggtgaactctcacagatatttttccgctcttcccctctataagaatctcccatctctcaggagcctctctcatatgagagtctcgcccaatattttcactccacactggagaatgtgtttccacgccgcaccttgtgaccacacacctgagtaggataagaatatgtccttctgctcccagctgtgtcaatcccctttttgggagaacccaccacaacatatgccacgcgctccacttttctgtgagattcttgtggtttttccgaaggccacgcgagatctttcctctttcccctgagtnccacgaattggcccgcgtgtgacctatacgagttcaataacaccctggtccgagaaactggagattcctctgcactccgacggaggacacccacgaccctggtttcgaagagtacttttcctcgggagagggggccttccacgcaatgtgggccaaagccttccactcccgggccaagatctttccacacagtgaaacatcttcttgccactcaccctaagctgcctgcacctgccccttcagggagattggggtcatttaaggacaactgaacattgata

SEQ ID NO: 727326 - DNA, 938 bp, Homo sapiens
atacgattgttcccgctcaccgtacgtgcggcgggtggagactcttggaccagcggtcacctgttgtacccgtttccaggcctttgggggctgcgccccggggacggtttcatactacaagtgcgcgtgcgccccccctttctcccgggaaggtctgccagacttcagcgactcccccctttttggaagatgggcgccccccgttttacatgacggccagggcaagcaccatcttctccaaaggggcacacaacttctgggcccccacttttaaatgccggcgcctttgcgagcagcacgcgcagcgcctcgtctatctgctgcgccgcaaccacggtgtgcaggcacccagaaagggggcccgtccccctctaaagaaaccagattgggctgccgccacccggggcagccgtacaaaaggggcagaaagctccgtgccaacctgagccaaacccccggtgtgagtcccccgcgaagaacaaatacctgttccgccgggggacacgcctcaagaaataactcggggtggcctcgccactgatgccccccaactgagtaacaatagcacaagggaaaaaggacggccccccccgcataagcctgggggaggcagggacccacgcacacaaacggacacatcgcgcgcaaaaaaaacgagtagtcctgcagattcagcagcacaagaagggagcccctcgcccagcagacaatgcacacgggtgtccttgttctagaaaggcgcatacagaggaacggcgcggtccccatagtgcgcgcccacgcatacaccacgccacctctgggggagacggagggccccgaggagccaccttgcaaccccgggaggccaaaggtatcgcccacgagacgctcggagcggggctgcgcaacgagcacccgccgggggccccaaaggcgaaaccccgttctaaaaaaca

SEQ ID NO: 727327 - DNA, 378 bp, Homo sapiens
tcaggtcaggcgcacatacacgcaggcactgccacactcacacacacacactacatcacacagactccagcaacatccttgtaacattctggaagtcaagaaaaggcacagcgtcgtagtctgccccgatagaaggaattacagataaacagccacgaggttgggccagagaatttccaaagagagctatctacaaactgggggttgatttcccagttcctggatctcagcagtcaacacacgagaaggatttttttctgaagctgccacctccaattctgaaataatccatgtttcagactggggccgggacggtggcaaacctgcagaccctggcagcaagatgagggcaaggaagggaaaggtcagctgggcaca

SEQ ID NO: 727328 - DNA, 281 bp, Homo sapiens
  misc_feature (59)..(59): n is a, c, g, or t
  misc_feature (66)..(66): n is a, c, g, or t
aatctaaacaacgcggagcagctgtgcagataccaggtcctgtactgctgatccggagnaccaagnatgagatcatcaccaccacggttcctgaggacatcatgtccaacctgaggcaatgacctccttgctgaagctcctgcagcatcggtaatccccgggtgattggcagaggaggggtcttcggaggtgggtgagcggcaggtggttgggaggcctccttcaacagctgggaggaaagcctcaattttattagccgaatgggagggttgaaaaaggac

SEQ ID NO: 727329 - DNA, 203 bp, Homo sapiens
atcccccctctgtatgccttgtcggacctttcagtatgctcatatgtgctcacgagggaattcaagttctccatgggatgcagtaggcataatgttgtacatgatgctaattcttttctatctacacattccatatccaactgctttgtctgggcctggagtctgtttgatgaatgaggaaatcttgccatgacctgactgag

SEQ ID NO: 727330 - DNA, 218 bp, Homo sapiens
  misc_feature (130)..(130): n is a, c, g, or t
  misc_feature (218)..(218): n is a, c, g, or t
gatagactcgagctgagtaccctcgataaggccaactcatacacctcctatgaaaaaacttcctacccattctcctagtttcttgttgtcatcacaccttaatataggttgatttgtgtgttcagcacanaagggcctccaccaagcttgacatacatatggctcatcacacgttggatgcacagcacacaacagatgggcttggcccgttatcgagn

SEQ ID NO: 727331 - DNA, 139 bp, Homo sapiens
tattgtaaatttccttaagtatatctaggatactaacctatattgtaattctattctagtagtcactgtccccaaaacaatgttcataactttgttcttataaagatgagaaataaaaaacattgaattttaaaaaaaa

SEQ ID NO: 727332 - DNA, 214 bp, Homo sapiens
tcaagtcaaccaaatacatcctcttaaggaggttttaattagtaaaatggcttaacagacaagtctttatatatgttcttacggctactgtgcacagatggtgactttaaaagaacatggaatgaatggcaaacgtattgccagctgttacgttctgaaaattactgctgttataaaagaggtgggctgttttgttttgctatgttttgcttga

SEQ ID NO: 727333 - DNA, 224 bp, Homo sapiens
  misc_feature (37)..(37): n is a, c, g, or t
  misc_feature (42)..(42): n is a, c, g, or t
tcagctggtaccatttcagatctatctctgccttcangatantggtgatattccttagatggtccttcggcgtgtgcatgcacacgccgaggcaccaaacggtgacacatatcgcgatggacgaagttgtgcaggtcttgatggcgaagttgttgcaagtcccagtggacgaagttgttgcgcaacaacttcgtccatcgtgatttgcggcgtatggatgttcg

SEQ ID NO: 727334 - DNA, 131 bp, Homo sapiens
gctcgcagctgctgagcaacaccccctgcttcagaagttctacctggtttcctgtaggctgaaatgtcatagctctaaatatcccattttcatagttcaacaagtcagcagttggtaaatgaaaaaaatcc

SEQ ID NO: 727335 - DNA, 1381 bp, Homo sapiens
  misc_feature (766)..(766): n is a, c, g, or t
gcacaggcatccaggagatgcgagagggtctgcggagcgaaggcagaacagcaagagcacttgaagtcacaacaagtgcagaggagaagaggttccgggcctaaggatgggctagctagttgaggatcgacatatccacgaagacgtgccatgaatgccgttcttctagatctggtcgatgagcaaagtccaaagagcgtgacctatccactggaggaaccttggtagttgactgacgcgcgtgtacacggacgttcggtcgtagcacctgatctgacacgcgacgacggataggcgcgcggcatggactcgtggtctgggagtgacgcctactatggacttgtcctttgggcgcgtagttgcccccgctatgtgagccaagagttgcctcaccttgaggtggtgcctcgtacgccccactagtcgggactggaaatgtcgtccctagtgaacaagtccgcattgagttgggaaagcgcaaactcaacaccaactgcgggtactgctcacgaacacgcctagacataacctcacgcgtgggggcgttgtagaacttgcgaggcacactgctcgctttccacgaaggcttgggtatccccatttgagggttatccacgtggagcattgggatgggccgctgggtgtgcacagaggaccccacccccatggtttgtgcatgttgaccgtagcacctgcgtgcaacaagcggccggggatacctagctgcgcgtggaacacgggtaggttcatgggaataccccaggantgggcttgggaatgaataactgtgtcacctacccacaaaccgcacactggaatgcggacaccgagacagggtcggcaatttgggcactcctcggtgaacgacccccctttgtggggggggggaggaaaagcgtgtagtggaacaacgcaaattcctttgggaagttggaaaggggcaaaagttaccgctttaacagagagagcgcacatgccacgaggccaaaggacgggatcccgacaaaacggtcggagttggccaaggagtcggggaccaggcgacagaatttcgcaccaagcgcatggcggttggtaatataaagaacggcacattggcactaggaacaaccgtatggagaccactttaaatacacaatccttccccatttgtggcacagagcgccgttcttaggcactaccagagagcaggcccatttgagcttggggcaacttgtggcgaagaaaaccccccacttgaaagcatcaaattaggcagagccctcggacagaggaaaacgaaacagacaacgcaacttatcgcagcgcacaagtgcgtcgaactgggagcaccgacggagaccagcgttgaagaacacaacacgttcgagcggctccagta

SEQ ID NO: 727336 - DNA, 584 bp, Homo sapiens
  misc_feature (217)..(217): n is a, c, g, or t
  misc_feature (275)..(275): n is a, c, g, or t
  misc_feature (376)..(376): n is a, c, g, or t
  misc_feature (428)..(428): n is a, c, g, or t
  misc_feature (459)..(459): n is a, c, g, or t
gatctgtagggaactctagaaagaaattcttattttccctctttcccgcctatcttatgcccgtttctaatacaggtgcacaatgcctgcagtgtctttgcatagtaagagtgactttattccatttcccaacaaattcctcatctccctctgagaccacctccgcctggaccttgttgtccatatcactattaacattttggtcaaagccattcancaagtctctaggaagttccaaactttcccacattttcctatcctcttctgagccttcnaaaccgctccagcctctccctgttacccatttccgaagttgcttccacattttcgggtatctctacagcagcaccccactctactggtatcaacttattgnattagtctgttctcacaccgcaaataaagacatacctgagactgggtaattnataaaggaaagaggttgaattgactcacagntctgcatggctggggaggcctcacaatcgtggtggacggcaaggaggtgcaaaagcatgtctcacatagtggcaggcaggagagagcatgtgcaggggagctcccatttataaaaccatcagatc

SEQ ID NO: 727337 - DNA, 673 bp, Homo sapiens
  misc_feature (21)..(21): n is a, c, g, or t
  misc_feature (23)..(23): n is a, c, g, or t
  misc_feature (30)..(30): n is a, c, g, or t
  misc_feature (48)..(48): n is a, c, g, or t
caacgaggtgcctacaatgcntntgtcaanaacacaccacgtgttatnttaaatactgaacggcagacttacgtctagtcagctgtgcaatcgacagattctgggtctcagagtgggacaacctatgccactttcttttttgaatgattctctgtcaccggctgagtgatgtgcatcttggtcatgaactcacttctggttcagcgatctgctcgactctcaagtactggattacaacaccaccaccatgcctggctaattgtattagaagacgggttcccatgtggccaggtgtctcaatgttgacctcaggtgatcccccgccttggcctcccaaagtgctgggattacaggcgcgagccaccgcgcccagcctacaccacttttagtaccaacactcttgggtgatttcatggaccctaaagcagacctgacactgatccagatttgcagtccatttttaaggacacctgtctttatttcctcaaagtcaagcagctttctctggaaaatgaatgctaattagtgtgaaccaaaagagtaagtacgagtctgaagtttttaaaggagaaagcttattatggaaagtcctgttcctcccctccgcaaggaaaggtcccatataatgaaccaaataagtccctccctccagcaagaagtaaactctgggata

SEQ ID NO: 727338 - DNA, 624 bp, Homo sapiens
  misc_feature (6)..(6): n is a, c, g, or t
  misc_feature (91)..(91): n is a, c, g, or t
  misc_feature (299)..(299): n is a, c, g, or t
  misc_feature (538)..(538): n is a, c, g, or t
  misc_feature (559)..(560): n is a, c, g, or t
  misc_feature (620)..(620): n is a, c, g, or t
ggggtngaacccctgaccctgtgatctccccaccctggcctcccaaaaattagccgagtgtggtggtccgcacctataatcccaggtattngggaggccgaggtgggagaattgaccgagcccaggcatttgaggctgcagtgagctgtgatcgcaccactacactccagcctgagcaacagagtgagatcctgtctcaaaaataaataaataaaataaaataggcctggcacagtggctcatgcctgtaatcccagcactttgggaggcccaggcaggcagatcacttaaggtcaggngttcaagaccagcctggcaaacacggcgaagtcctgtctctgccaaaaatagaaaaactacccatgaatggtggcacaggcccataatcccagccactcgggaggctgaggcataagaatcgcttgagcctgggagtcggaggttgcagtgaaccgagattgcaccactgcactgcgcctgggtgacagagcaaagactctgtctcaaaaaataaataaatgaataaatgaataaatanataaaaacaggttcatggatnnatggatggaaaaacagatggtttagcacatcagtagatagaaggatagatggatggatantggg

SEQ ID NO: 727339 - DNA, 163 bp, Homo sapiens
gtgaggacgcagtccctgtaggaagagtggcgatgaggacgatggagagacctgtacaaggcgcatctcggatctgctcctctaacaaacgacattgcctgtgagggaagagttctccgagttctagaagaggcagggagagagggcggccgcaaggaaactc

SEQ ID NO: 727340 - DNA, 107 bp, Homo sapiens
gacaaatcaggctcccccacaactggggtgctggtgctggtctgcttcagcccatgaggactcaaatgatcaaaagcagtttgtggaaggccagaaccgtcaaggga

SEQ ID NO: 727341 - DNA, 519 bp, Homo sapiens
cgaatagctgtctgccttgggaacttggtgccaggtgagccgtgatgttcagtgccagtgcctgcacatgcgagcacagcgtcctagagatctatcttggaacacactccgcttgcgcagactccacaccgcagagccaggaggggagggacgagtatgtaacgctgaaggtagcaagtccaggggtccatatacacactgccccgcctcatccaaggcactaactagtgtgtgtgtgtgtgtgtgtgtgtgtgtgtgtgtgtgtgtgtgtgagagagagagagagagagagagagtgtgtgtgtataggtgtgtgtacagatgggaaggggaatattagacgtgtgtggattgacttggccaaagccaacattaaacagatgagaaagctgagggtcacacaaggaagggtcttacccaggctcacacaacagctgagtgagagccagggctagaactcaagcttgcgtccctaacccatccacaaccccagagctcttctctgctgaacactcatct

SEQ ID NO: 727342 - DNA, 207 bp, Homo sapiens
cccgacggaaacattgattgtctggacaggcatggcaccaacgagaaggcaaaacgaacttttacaacattggggtgagcaaggttataaagtcatctttcatgccccctaatttcacctttatcccgccccttagacagaatgttataatctgaacccacaacagcgtttgtaccggagctggtccgttgcaaaatgctcaccggg

SEQ ID NO: 727343 - DNA, 243 bp, Homo sapiens
cacatgtttgcaaacggctgcccgtccgtgctggtatacccgttggctcccccccctgtgcagtgtgcattctcttttcaccacatcctggaccctacggggtctctcgttaggttcagtgctatcctggaatgttgactttatatcctacagacaggtcaagaatatttgctttaagatgaggccacagatctagagtaattatatatcgagccggtatggctacatgatcgggtacccgag

SEQ ID NO: 727344 - DNA, 130 bp, Homo sapiens
  misc_feature (112)..(112): n is a, c, g, or t
cggtggaacgcagacagtgaggctccgattacgtggttcagacttggtactctggctacacagaggagagagggcccagcagtgttgtggacactgggcgtgcaggggatcnctctagtagtcgcacctg

SEQ ID NO: 727345 - DNA, 446 bp, Homo sapiens
aacagcctttgctcttgatacgtttgcttgcgacatgacccagttctaatgtccttaacttcccacacccggtctcatcaacctcctcttcttcactctcctcttggacggttggagtctgagtgttttcctgaatgtttgaaacagcttcaccttgaactttgaatttctcagcagctgctaactgtgcttgctgagacaaatcttcaatcttggcttccccaaacactatgtaggtgtctgaagctgggctcttgtagacatcgggttttgtgatgacaaagaggatatttttagattttcggatagtgactctcgtaacccctgtaacctgtcgaagacccagtttggacatagccttccttgccttcttctcacttcgactctgcttggctttactaacaggttcttcatcgatctctgctgcggctgccagctgggcttgc

SEQ ID NO: 727346 - DNA, 209 bp, Homo sapiens
tttatctattaggaggtgtttgtagaaccagcagattcctgagactatctccaagcagttcagcttgaaaagtaggtctagatgtccaaaagccaactgttctgtgtctcatgggagaaacgcttccattacagctgggaggacagaagtgagctgtaaggaactgctccaagcggggtgaggtgccaggcggcacctccttaatataa

SEQ ID NO: 727347 - DNA, 112 bp, Homo sapiens
tggtcggatccagtgtttcaaaattgacaccaaagaatttgtgcgcgagattaagcacccatcgtttggaagaaatgtgtttgcaatttcatacataccaggtttgctcttt

SEQ ID NO: 727348 - DNA, 362 bp, Homo sapiens
agatccctgtttagcacgctggagtaggcatgaccactgcggtagggccatcaccccaagaactgctaatccattcacctctcccagcgtccccacggccacctatgaagatattatccctgttttacacatgtataaactgaagctgagagatggggagtaacttgatcacaaagcttgtaagtgtccactgccttatgttgaaagagtaaacctcagagcctggggcagcccctggatccggtaaactctgtgcaaggaacagaggccggcatcccagtcagccctcatccatgggaccctgaggccttagacacggagctctccagggacttggggtgtgtgtgtccacatccaccctc

SEQ ID NO: 727349 - DNA, 819 bp, Homo sapiens
  misc_feature (512)..(512): n is a, c, g, or t
  misc_feature (519)..(519): n is a, c, g, or t
  misc_feature (526)..(527): n is a, c, g, or t
gtctccacgaggctgccggcttaggaccccagctccgacgagtgcccgccggcccttgcagctgctggaagacccatttatctcatgcttcttgtttctttggggacctgcaggggaaggaagcaggtgacgggttggtgatatcccacactataagactctcccctttcctccctgaggtccagccgtcagcccctggcaggggggtcttggaagccagaggtttggctcagggcaaggggaaagggctgccaaggatccccgggggctgccggaaggtcggtctcactgacatcatggcttgagcccagcatcgcctggtcccacagatgtcgccctcgtggtcgcctgtgtcttctcaccatcgtgtggcctgattctccccacccagaggacagacgtggcaaagataccacgtccagttcttcagcagactcaactatcatggacattcaggtcccgacacgagccccagatgcagtctacacagaactccagcccacctctccaancccaacntgcctgnngatgaaacaccacaagcccagacccagaacccagcaacttgaaagggaaccggattgggccctcctagttgacaggattccaagagacaacacaaagagcaccaaaagcaagttcatcccactgatggcaccagaggtctctgagagaccaatcccaagcacaagacgtcagacaagaaccccagacttaagcatctggttttccatgaggatggccttcttctttggtggaacaccctccggaaggggtgtggcgagcgggtgtataaaggtttagtccccaggggagggg

SEQ ID NO: 727350 - DNA, 113 bp, Homo sapiens
ttgtgtattttctttcagttcctctgatccacatagttattaggaggtggagatatgtttggctacatttttcaagggtttgatgacagggtttgatgacagggtttcgatga

SEQ ID NO: 727351 - DNA, 789 bp, Homo sapiens
ggggctaaatgatgatcttgaaaagggccctcactcgtgagccttcgccatgtgccagtcactatgctgagcaccttgcaggagcttcaggtccaggccttgggggtcagcagggcaagcctgagccctgtggtgctgtgggaagacttggttcaagtgacactgagcctgggacaaagtgcggttgatggctcttgttttccctggcccttcagattgcctttgggaaaccacccaacctcactcccctccacccacgtgcattgcatggggctaattctaccccaggccctgactccaagtatgatcacctgatccagacctggcaatcagcctgttctgtcccccaggccacagtgattgtttagggatgatcatgtgacctacagaaagcttcaggatagtggcttccttgggtaggggaggctgatggtcagacagggaagaagcccacagacagatgcaagtgctggttaatgttctgattcttgtgctggatgaccaggtcttgggtgtttatttatataaataaacagaggagaaccgttttatgaacctatggcaagaggatggcgtgaataaagggatccatgattaatagaattcagagacaaagggagagaaaaacaaagaaaaaaaaccttctggaaacttgttggagctcttggaaaagaaaagctgtgagtggatgttcagagggttacctagggctcatgcatgggggattcaaaggtttcgaactggatcaaagagagaatggagcctgcgtgcagagaaaccttgtgcatt

SEQ ID NO: 727352 - DNA, 485 bp, Homo sapiens
  misc_feature (63)..(63): n is a, c, g, or t
cgcggctcttgagccggctgccacaagggggcgcgccagcggtgtccgggagcctagcggcgngtgtgcagcggccagtgcacctgctccggccctcgccgcggtctctgccaggaccccgacgcccagcctgaccctgccattcagcggggctgcggctccaaggcctgcgacagcagccccacctggcattcagcgcgctcccgggggcagaggtcgcggtgtcctcacgctgtggtgccggcctacaacccccacgccgggctcgggcccggcggaggagggcgatgctccccgggtaggacaaaccggtcacctgggctgcgagggcggcttaggggcagaagcggcggtccagggccgcctggcgcagcagcctgtcccagccgcggtccctgcagtccctccctggcggctgcgcagccgtcccacgacaggggccataaactctccagagcggaaagccgcaccctggtggcccggcc

SEQ ID NO: 727353 - DNA, 172 bp, Homo sapiens
agaaagtcacgtgtcaggaaattgtatcagatgcatcacatcttacaagagactctcaaatcatacgatctcatttagtctcttatattaaatttcctctactgacatactagctaaattgcattttttcctataacaattttttctcttatttttgtttatattttttgag

SEQ ID NO: 727354 - DNA, 338 bp, Homo sapiens
gatgcgtccgataataactaatatggcggataaagggtgtaagtgtgccttgtggtacgaagtgggctaaggcatttctcaatcttagagcgataagcctataatcactgcacccgctcataagtgggatgatcatggctaggtatatatatccttgggtggctagtgtaacatgagtaaggcaggcagtccgcaggcaggttcagttgtggccaataaaaaatgattcaaggatactagatataagcagcatcaggttcgtccgtttagtgtctgtgtcatggttaatcatttgtatttatgggtccgagacgagaccgggataccggaagctcgaa

SEQ ID NO: 727355 - DNA, 743 bp, Homo sapiens
  misc_feature (102)..(102): n is a, c, g, or t
  misc_feature (104)..(104): n is a, c, g, or t
  misc_feature (106)..(107): n is a, c, g, or t
  misc_feature (113)..(113): n is a, c, g, or t
  misc_feature (117)..(117): n is a, c, g, or t
  misc_feature (125)..(125): n is a, c, g, or t
  misc_feature (127)..(127): n is a, c, g, or t
  misc_feature (204)..(204): n is a, c, g, or t
  misc_feature (212)..(212): n is a, c, g, or t
gggacatcaacgtcacggatcaggccattgcggggctgaacggcatgcagctgggggataagaagctgctggtccagagggcgagtgtggagcaagaatgcncncnntgagcnccancaatcatnancgcctgtaccctgcaagtgcgggcttgatgagctcccaggtgcagatggcggcacccgactgaggtcctgtgcctcntgaacatngtgctgcctgaggagctgctggacgacgaggagtatgaggagatcgtggaggatgtgcgggacgagtgcggcagtccgggcttgtcacgtccatcagagatcccccggacttgtgtgacggcagtcgatgtgcccggttgcggaaagatcttggtggacgttcacctctgtgtaatgacgtgcagaaagccatgcaggggctgatcgggccgaaagttcgcaagagagtggttgtcactgaagtactgtgaccccgagctcttatcaccgccgggacttctggtagacggcggctggcgggacgggtgggggccgaggttggctggtgggcttctccccagtcccggggctcccggtatatccctcatctgaaggacagatgcgtccaggggaagtgagaagcacgagagacccgacgacgggcggtgaataaagtgccatgggccagcagttaaggctgaggggcgggagagggcgggtggggggtttgaggcgtggacaggacatggcgaagtggacccaggcccacag

SEQ ID NO: 727356 - DNA, 126 bp, Homo sapiens
cctacatctcgcgagggtcagtgcgccattcgcgtcgctggcgcgggaggcgctttcggacatgttgtgtgatagcgatcacatgaacgatggaagccaaacgaaacggaatgatgtcgacaggca

SEQ ID NO: 727357 - DNA, 1046 bp, Homo sapiens
gcaacagcgagcgtgccggtcgctagtcgcgggctccctgagtgcagcactgccagtggcagcatgtgagacctaaactgactgtgtgtggtctgtgagtcagatgtcgcagtgggatgtccctgtgacctggagcactgatgcctgagctgggagagcgcctgtctgcacgcccgtcgccaccctgctgtacccggcgcagccagagccaccagcgcagcgctgccatggatgcccatgcagacaagacagctgacgggtcgcctcatgctggccgtgggacggcgcagtgcttggctccctgcagttttggctacaacactggagtcatcaatgccccccagaaggtgatcgacggagttctacaaccagacatgggtccaccgctatggggagagcatcctgcccaccactgctcacacacgctctggtccctctcagtggccatcttttctgttgggggcatgattggctccttctctgtgggccttttcgttaaccgctttggccggcggaattcaatgctgctgctgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaacgtgtacccacagccctacgtgggagccatgggaaccatgcacagcatggcatagcacgtcggatcatcatcgccaggatgtcggctggatcataatgggcaacatggactggtggccctgatggtgacatcatttccatccggcccgctgcagtgatgtgatgccctctgccgaagagtccgatctgatcatcacctggaagagggtgaaccgggccacatgttgataaaacatggcagtacatgcgctacctcctagcaataagacaccgccaaaaagcaaacgcataggagccgcccgacgaccactcccagcatcaacacacctctacgaaaccaccaacaggacctcccccgcaaacacaacaacgt

SEQ ID NO: 727358 - DNA, 331 bp, Homo sapiens
ctgcggaagatccatctcaaatcaaacaaacatacaaaacaaagagcccactacgtattcacattatggaagactccagagaggatcaaaagaatggattcgatctccttgtagcaaaaagatctgcttgtagcaaaaagaacagatgtcaaaactaaaatctggagtgaaaagagcaagcaacattatgtctgaatacatttctatacagtgtattgagaaagcctgacaggaaaaataattcatttcttccctgagacatttattcactgtctttttcttttcttgttttaaggcaaatcattgactacactgttgttaatttcagctg

SEQ ID NO: 727359 - DNA, 198 bp, Homo sapiens
aagctccaacaagatagctgcagccccccagagagagctctgcacgtcaccaagtaccaggcccagcctcaggcctcaactccgccagctctcccggtctggatctgcactctaacactcgactctgctgctcatgggaagaacagaattgctcctgcatgcaacttatttcaataaaactgtcttgttcgggagctt

SEQ ID NO: 727360 - DNA, 1386 bp, Homo sapiens
gctgctgctggctggccttcatcatggagccctcaggatcgccgttcccacccgcccatgaccgagggacccatgaacacaccagatcatgacacagagcctggagctcctacacaggacagcgggttgcttcacccacagccgatcatgatactacggccacatacagtaacgccacgctgcaaccagccgtgatggcagccccctggatggcagccagtgcacacccagggtggcgctggcctgccctacaacatgcccctggacctacctctccacatgtgaggcgtgagacttcatttatcacactgcatcacccatagagatgtacagcatggctacactcatttcaggggagagctaccggagatgggcacgccacctctggcatccacgaccatcaccgtcttctgctccatgggactacaaggtgacgcagaacgcggagactcccgactccagccaggacaatattcgcacccggctgaaggaagctagaatggaccagagatggacacgcatgacgagaacagcacacaaggagcgtgatgcagcggacggacatgcgagcagcgcggcatagatgacataggaggctagatagctagcgcatccatagaagctacatggggaacccgccacatgcggacttgcacatgccctggatgagaccgcacacaaggatccatttcctacggcacgcatcaaaatgaaaaccaaacaagataccaggaaggaattgatagaaacaacgcggaaggagacatgcatgcctgtcctagagatcccatgtcaccacactcagctgacgattgaggaacagcatacattcaaaacactagtcgcggagacacagcctaaccaattggtgtcaccggagaataccaagaggacagacccactgaagaagaccccgcacatgacgtcaccaaggaataaataggaagggataataacagagagatgaacaaatcattcaagcgataaacagaataattcctaaagcaaggacaatacatgaggagaacatgaggcaaaccgacgtgatgcgcagcaacagagacaagcacatctatacaggaccagtactacacagcactcaacacgaacaaaacgcgcaaaccgacaccagaatacagaatacacactccatatgccagaacacacaccactcagaacccagctcacacactcctccaaaaaaacaccaaccaagcacacccccaaccacacccacaacagagccaacaccaccacactcacaaccacactcatacactcccaccccgcacaactctcaacttatctaacccctccccaccaccatacaacaaacaaacaacctctccacctacaccagacgtaaatccaacaccaccaacacag

SEQ ID NO: 727361 - DNA, 1212 bp, Homo sapiens
  misc_feature (649)..(649): n is a, c, g, or t
  misc_feature (830)..(830): n is a, c, g, or t
  misc_feature (871)..(871): n is a, c, g, or t
caagttttcaccgcgagagttatctttttgccgggtgtcccctgtgatctttggattaaccttcgttcctgggggaaaaaaatggggctgtcaaaatttccaaggaaagtcttgtctgttccaaggggtgtttttcgttctgcgggcataacatgtctctgggggcccacgcccacttaattggcccccctcctcatttgggaatcctctcctggtggttcaaacattgcttcacgggggcgatttttctccgggggaacgccatccctactggcgcctctaatttttaggccccccctcggcgttttggccccccgctggtaaatttggtgattttcccccacaacaggcgttctccccaatggcccatgccgccaagtgttttgtcttggaggccttgtatagagggacacaagtagttggatttccccccgtttctcgcgttaaaaaaagccttgggtatagatcggggcccctcctagatgttctctggatagttcctcggtgcgatattctctccccactgtgcgtgtggcataaatagggtttgttcctcgggtcacagactcccactagtgtgtttttcgggaggagtctttcctcccccgagcgctaatcccacacctcttttggggttctccctctttgncttgcttttcgctgagatatatgaggagcacgcagccacgctttgtacgcgctggggtgctacacatccaaaagctcactctggacacacacgagaaggtctgtgctgtgagacactgtgccccaagagattcacacacaagagttctgggctccacgacacaaggctccacgagaagcgnctataaaatggagactattgtagtgcccccttatgtatacnctcgcgcacacccacacctctctctaaatccacactggtgggagacagaaccggtgtcttcacgagaactcgtttgttcttcacactatggccactcttaagttcttatagtatgttaaaagaactggttataatgagttaccgacatgcactcgtgaaacctctcacgaaaggaaataggagaaatgttttcgtggagccacctcttgcgtttttttttttgccctgtggcaccttttaaagttatattagttttttaaacccgtactttttaatgggaaccacttgaccccaaatttgtcccccgaattttgagaccccctttaaaaagtttaatgaga

SEQ ID NO: 727362 - DNA, 269 bp, Homo sapiens
aaataagggtagagtagagaggagccagtaaatgagggcgtgggggtgctggctagggaggggcagctgggaagtgcaggtggaggtcatgcccccaggacctcactgtcacctgcctcactcccctcctgcccgcagccccgatacttttgggaggacgggagcccacagccagtgggggccagcgagggtcctgagggggggtcagacacgcaggctgaccccagatccttcacttgacccgggatttcagcatactcagctagctc

SEQ ID NO: 727363 - DNA, 123 bp, Homo sapiens
ctcatctattaactggaagattggcactgaagcatataatctactgtcatcgcccatcctccctttctgtgcattatgcggtacaaggccggccgcctggctggggcctggatacgctaggag

SEQ ID NO: 727364 - DNA, 1472 bp, Homo sapiens
  misc_feature (1366)..(1366): n is a, c, g, or t
  misc_feature (1472)..(1472): n is a, c, g, or t
agagagagagagagagagagagagagagagaaagatggaggagaagaacttggatctcccctggggtagatggaaactgcaaaaacccaaagcctccaaaactaaacgagggtccactcataacacccctctcctctccctataagaagatgggagtgtctctcaaagatgagaagggaacaaactctctccttgggaatccactatttttgtggggggaagtggaaagagctcgtgtctcctctaatctacaatgctggctgttggcggaggggagaaatcaacgtgctggagagcaactcttcttctgctggcaccacgctggtaggtggtgagggttgatcaagacaccaaagcagagcacgcagccggggagtacactcaaggtggaaagaaacgttgtgttgctgttgaagaagatcatctcaagaacacacgagagggcactctcagaggagtcttcttgttggggtgctgctcgtcacaatcatatattggtccgctgggtggtggatgtgttgatgatgcgaccactactatctctcacactattagtagtcagtcagtagtcgtgctcgttttactcacacgtcgaatatttatacaacagtctcgagatgttgctcccgttgctcccctgatggtgtgttggtagacactaactatgctactagctgtccaagcaggtattaggggtatgggtgtggtgggacagtgccagccagggggaggggacaacacaacaccaacgctcatgtggtgacgagagtgctctactcgtgggtgtcgtggcaccgttgcactctgagtgaccctggggtgccggacagaccccttctcttctacaagagaccccagcagggagtgggcagggtctgcaaggggcattcggcccctggtcctggacttgtgccagaaaggcctggagccttggggtaagagggcaggtaagagaatatgctggtctccacatcatggcgaaggacacatctgcacaaacaccggaccaggtgtcatcgacctccgtggtgctcttcccccaagggttgtgtgtacaagaacaacagggccagctgtaccccgagggaggcgaccggagaccacttacaattagaccccacacttaacgcgtcattgagggggaatacagctcaggataccagcaattctacaaaaaccgggagacactgatataacgcatgtgtggagagcaggggaagaaagctggcatggacgacacgcaagcagaacctaggagccaccgagaggagtccgcgtgacgcacactctaagatgctagcgagcagagacgatccatcaggagagagtatggacgtagacagacgcgtcgtgaagcagaagacgnagctttcgtcacttcccacgtctcttgtactctctctgctctcttcgcctaagacgatgctacagtgaggagacagagcaacagacaagaacagcaaacagaaggn

SEQ ID NO: 727365 - DNA, 253 bp, Homo sapiens
tcggaacgaggtaggactataagcaggctcttggtgcattacatggaagggctgaaggtggccgactacgctgcctctgaccgatgtgtggccctgccccggggagctgctgtgcaagcttgaatgtcaagtagggccgccttgtatacttcacgcagtgggcttgtattgagaatggcgcgtggagtgacagcagagaatggctgcttgggccgtggacatgtgaaactgtatccggggctgttgtaccggc

SEQ ID NO: 727366 - DNA, 150 bp, Homo sapiens
cagaatattggtgcactgtttgaagtaaagaaactggagggttgccaatactatgtagcaacgttgaaccctgagcaactagttctttctagggtaggcattattcttagcaacagcatagggcaaggggccacagacagacacccacca

SEQ ID NO: 727367 - DNA, 991 bp, Homo sapiens
  misc_feature (257)..(257): n is a, c, g, or t
gcgggaagggcctgcagtcccgggtggtgcagtgcatgcacaaggtcacagtgcgcctacggagagcgagtgccccgccctctcgaagcctgccccctacagacagtgctaccaggaggtctgcaacgacaaggatcaacgccaactaccatctacctccccccgaccgttgctgctctgcacctatcaatatgcgacacgagtaccatgtggacgcgtatattgtccgggtctattccgagaagatagaacctctngccaggcacatgcgcgtggctagccagcagctgcttggcatgaccctgacagggtagcattcatactgtgcaaacagagagtgtcgccagtcgcatccgccgaagctcgctgacacagcagctcccagagggctcagctcataagtctcagtacttcgaggttcttgaatagccgacccgatgcgcgctaatgcactcaccaggcgcttgtggaccatcgccccacagcccggtcggtgcccacaaggaatccaactgccatagagacatgaggcgtggacttggcgttcgccattagtgcgttccgtagccttaatatattgttcaacagccacgtggctcactttcgtagcagatggaggagaagagtgaggcagtgacgtcacgaagtaacttcaattctctaggattgcggggtacctcgaagggaagcacctctggcagagaacgcgtcaagagagagacatcatttagtgttcctgtcgttgacgtcgcttttcgacatttgaatttccagtgcttggtatatcatgggaggaaacatgcccaaaacgagacatgctagaaaccggcttcattctaaaggcttaattctgaaagccggcgacaccctggagggacgggcaggtgtggtgagcctctgcccgggttctctgggtgagggccaggctgcttagcccacgttgctcttcatctaccttcttgaccaccttgaaaccaggactttgctccag

SEQ ID NO: 727368 - DNA, 640 bp, Homo sapiens
  misc_feature (118)..(118): n is a, c, g, or t
  misc_feature (131)..(131): n is a, c, g, or t
  misc_feature (143)..(143): n is a, c, g, or t
  misc_feature (157)..(157): n is a, c, g, or t
  misc_feature (173)..(173): n is a, c, g, or t
  misc_feature (176)..(176): n is a, c, g, or t
  misc_feature (186)..(186): n is a, c, g, or t
  misc_feature (211)..(211): n is a, c, g, or t
  misc_feature (217)..(218): n is a, c, g, or t
  misc_feature (225)..(226): n is a, c, g, or t
  misc_feature (228)..(228): n is a, c, g, or t
  misc_feature (234)..(234): n is a, c, g, or t
  misc_feature (240)..(240): n is a, c, g, or t
  misc_feature (248)..(248): n is a, c, g, or t
  misc_feature (252)..(252): n is a, c, g, or t
  misc_feature (263)..(263): n is a, c, g, or t
  misc_feature (265)..(265): n is a, c, g, or t
  misc_feature (271)..(271): n is a, c, g, or t
  misc_feature (274)..(274): n is a, c, g, or t
  misc_feature (279)..(279): n is a, c, g, or t
  misc_feature (281)..(281): n is a, c, g, or t
  misc_feature (284)..(284): n is a, c, g, or t
  misc_feature (290)..(290): n is a, c, g, or t
  misc_feature (295)..(296): n is a, c, g, or t
  misc_feature (298)..(298): n is a, c, g, or t
  misc_feature (315)..(315): n is a, c, g, or t
  misc_feature (318)..(318): n is a, c, g, or t
  misc_feature (334)..(334): n is a, c, g, or t
  misc_feature (340)..(340): n is a, c, g, or t
  misc_feature (350)..(350): n is a, c, g, or t
  misc_feature (354)..(354): n is a, c, g, or t
  misc_feature (521)..(521): n is a, c, g, or t
  misc_feature (564)..(564): n is a, c, g, or t
  misc_feature (573)..(573): n is a, c, g, or t
  misc_feature (604)..(604): n is a, c, g, or t
  misc_feature (618)..(618): n is a, c, g, or t
ctgaagggctattccgcttccgtgtctgtcccgtctcttttgggccctcgtcgatcgtcatgtaccacatgtttaagaaggggtcctatcccgttacacccgagggaggctggtccgntctctcgctgagnacatccgccccnacgacatgcccatntacgaagctgccgacnaangccctgaaanccttccaggaggagtttcaagccangtgganncctttcnnanagttcnctcgantgtggccnggtnttttaatcagnantcaccngantccananagnttcctnaaggnncntgttgaactcagtcccntgnccacccccacagcagntgcggnggcgaagagnaagntggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtntgtaacccaagccatcaaagggcctgtacatacctaggagccntgagttgtnccggccagcttcatacttgagtgtgcacatnttgagaaataaacnagtgacttaacacaccattgga

SEQ ID NO: 727369 - DNA, 380 bp, Homo sapiens
ctctagaggaccccagtcccacacctgctcggatcggctgacgaaagtgttgtgggacgaaagttagatttacgccgataaatatgctcgtgacctggattcttggcgtaggtatggtctagggtgtagcctgagaatcggggacatcagtgaatgaagcctcctctgatggcaaatacagctcctattgctaggaccatagtggacgtgagctacacacgtattacgtgtcgtgtagtaggatgtctagtgcatgcgttggctaatacaatgccagtcaggccacctacggtgaaaagaaagatgaatcctagggctcagagccctgcagcagatcatagcatatagctaccgtgcagtgtggcgagtcagctaaatac

SEQ ID NO: 727370 - DNA, 995 bp, Homo sapiens
caccctggtcgctcctggctggctcaacccgagtgcctcgaccccctcctcaggcctcccccaccacaggcccagctcctcggtctcctgttcgttgtgttctgctgtgctgtgggggagagaggcgagcaggctctgtgccttttgtgccccccaggttctattccccgtacacccgaggctagtaggagggagcggagcagccatatctccaggccccgtggtatgcccctggacgtgtgccgtctgctgctccggggtggagcctgggctgtgggatgcacggcatcgctggagggccaggagcgtacatcacaaaaccagatgattcacaagaaacagaccacacatatgtcgacatgatccagacccgatctaaccatgatgccttaacatgtggagatgtaccgagaaggctcactagctctaactcccaagagtcttgcatgagcaatgatggcctccccagtcccattccccggatggcgaacacaggagaacccaagggacacgtagagtagtgaagctggtgattccgcacagaaccaccaagtgacctggacaggcagtagaccccatatcccatggacagggctgatggagatgggcttcagagaggacaggcgggaaaagcaaagagacaacaaatcacaataaccaaaggaacaagcactgaaggcttggactagaacagccattgcataaatgaccaggggaagtgccaaagcaaacccagaaggcaagaaagaacagacgcacaaacgcagaaggacagacagaacacgacggccaaaagagaacccagacaaccgagaggagcgcagagagaaaacaaaggacgaaaacaccaaggaagccaacaacgcaaacaagacgagaccaacagagagacagaagcgaacgagccacgcgtagtaaaacaccgaacagagaaccacaaaaacacaaaccgacgcgacggcacgacacaccacaggcgtgccacattctaactg

SEQ ID NO: 727371 - DNA, 221 bp, Homo sapiens
gcatgaaggacaaataggtgttagccaaggaaggatgctcttccagacacagaggagaaatgtcctggccaaagtgtgtggataccatttgctgatgcataacctgcaaggtgaggctgaggtcacatagggatcttataggccctactaaggagcttggatgttatcccaatggcactggggggtcatttacagttttcatttttcatcagggatggatt

SEQ ID NO: 727372 - DNA, 493 bp, Homo sapiens
  misc_feature (43)..(43): n is a, c, g, or t
  misc_feature (91)..(91): n is a, c, g, or t
  misc_feature (126)..(126): n is a, c, g, or t
attcaagcagaacattcagaatcaggtcagcttgtgggtgtgnacctgaacacaggtgagccaatggtggcagcagaagtaggcgtatggnataactattgtgtaaagaaacagcttcttcactcntgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaatttttcccataatgaaaaaaagcagagaacagctggcctcctgttgaaatttggaaagttctgaaattaatagtatttttaaaaaattgcccctgaagtggtatacacaataaaagcaggctctttttatccaagtgaacaaggaatgttttggcttttagccagcaagggaacaataaaaatttcccaatg

SEQ ID NO: 727373 - DNA, 413 bp, Homo sapiens
atctgtgcatttcttctactgcagccaatattctactactatactgtctatgaatgccacataagctactgacatcttgttttgtagtcacactggatattacaataagagaaaacaatcctgaaagccacacagtgtgcagtaactattacttttctgaaaaacacacagctctatttaatgctcagtgctcagctgcatctatatggtaatccattatagtacactcgaaatcgaaattaggtattactactgatcagcacatcagggaatctgtcattctttaaactgattatccatagttcttttttcttcagaacctactgcatgaccaggaataatgtgaaatgtaagctggagtctacacaagatgctatagtctactttataactgctggtcttctgatttgtgt

SEQ ID NO: 727374 - DNA, 1045 bp, Homo sapiens
  misc_feature (606)..(606): n is a, c, g, or t
  misc_feature (608)..(608): n is a, c, g, or t
gctttttgaagagattagacaaagttcctcagttccttcagccatggaggcagaaaccagcaatagagatgggattatctggaaaagatctgtggaggagccacttccctaatggggtgaatcactgagacatacatgagagaaccactagtttcttgagaatgttttatcagcagaaatactgccatcttgtactggacagagagaggaaaatatagaagaaggctgttggactccccaaattctacaggcaggaaacaggtggttaaatctacttagctacaaacatgtgttacccttcttgtaaaagaagagatgatttagggcagagttgttagtcaagaatgtggaattgggagcccagagggtggagctgagcaactagaaagcaaagccacaatcacagatgattaagggctttgaaacctaatagagttttctcagttggattcagagttgcttgggattggtgactcattgttttccttttattttaattcattgtttgaatggatatgtctctgactattatggtatccctacttcatcattgtattttaagagcagataacttaatactcaatactcgagtaaggagcaataaanantgaagttaagaaatgatttcatttactaatagcgtcaaaagaacgaaattcattattcctaaattttaacccaagaagtatcacgggtgtacctggcaaacattgaccaacacatttactgacattaaactggaactgcgactgtcaacccaattgacattacgcccaagggtcaatgggctttaaaaggaattacttctttggtgcagattgagaaaatgtcccccaaattgtagctgtcacattttaatgcgcaacttgtgtcaaaatccctagggaaacgtggttcaccggaaaattaacccacccgtgattcatgacattccgttgctgaaatgtctatgtgtccccacggagaccaaacacggctgtaacaaatacagcaagacacaaataaacaatattctcacccaacaccgtccaaacaagattaaaca

SEQ ID NO: 727375 - DNA, 304 bp, Homo sapiens
agagatccgagattgcaccactgcactcctgcgtggtgacagagcaagactccatctcaaaaaaaaaaaaaaaaagagtacacacctacacacacagcacacacagagatgtttatttctaaccacaatgtctattacattactatcaacccattttccagatgagaaatgagtcagagtttaagtaactcgccccaggctgtcctgtctagagttgcaggcaggctggagctacacaaagcctgtgttctttctcctgagcacatgccttctgtatggactccatggagcacagacctatgga

SEQ ID NO: 727376 - DNA, 321 bp, Homo sapiens
  misc_feature (86)..(86): n is a, c, g, or t
  misc_feature (300)..(300): n is a, c, g, or t
  misc_feature (302)..(302): n is a, c, g, or t
cctctccagctgctccttcaaaagatacatcaacagatagaaactctgggctgggcacagtggctcacacactttgggaggccaanagggggtgcagatcacctgaggtcaggagtttgagaccagcctggccaatgtggtgaaaccccatctctactaaaaatacaaaaattagctgggcgtggtggtgcatgcctgtaatcccagctactcgggaggctgaggcaggagaatcgcttgaacccaggaggcggaggttgcagtgagccaagatggcgccattgcactccagcctgggcnanaagagcaaaactccgtctc

SEQ ID NO: 727377 - DNA, 163 bp, Homo sapiens
acaactaagtgacatctgtgaaattttccaattcagaattgagaaaatttcttgagtgtgcgtggtagacatttatctctatgggagagaggagtatctaaggatgtgtagcaattgctagccactatggaaaatagctcaattttcccctgaagaatttcta

SEQ ID NO: 727378 - DNA, 371 bp, Homo sapiens
attcgcggtatcataaacccaaccccgtatccttcctcaaaatagccaccatacctacctattatggtatttccatagccattccgagatatatttccatgcaactttccaccgttccgtttattatgacacgctccatcattgcaatattgctttgcatgatcatgtagttgacatcgtatttgtggcaaagccaccgttcatcattttctatacatgtcgctcttgattcattgcacatcctgctacaacgccggaggcattcacatagagtcatatttttgttctagtattatgataccgcgaaaccgtgcattttctaaaagtatgttctctacagagaatcttatcagctatacaacaatctgtac

SEQ ID NO: 727379 - DNA, 524 bp, Homo sapiens
  misc_feature (347)..(347): n is a, c, g, or t
  misc_feature (428)..(428): n is a, c, g, or t
ggagaggcggggctgatgcatcgcagctagtcctggaccctgacttcggacttggagtaagaaacgccgaggcaggaacgggagtaagggggttagcagcttggcgcgctgggagccggtccacccctggtctccggacttcacttcccaggaggcctctgcgctgcgacatggaagtgctgctgagcctatcagaaggcgaggctggcaccctgccgcgtctgctctggtggcggcattgctcagccaggctgtaggcattcagggcagtgtcttctgcatctcctaggaacctcgggagcgtgcagctccgtgcgcctggtagacgagacggcggtgttccggangatcccaggtcatcactatcgtacccacttgtggttcaggggtgacgtcctgcaagatgttcaatgtgatttgcatcaagngtgcccatgttcgcaggcaattggagcccagtgccagttctcgtgagcctatcattatgggctaaaggagtgcgtgatcagcaatggtgtctggga

SEQ ID NO: 727380 - DNA, 256 bp, Homo sapiens
ctgctccctcttcatctataaaatggtggcctgcacaagatcatctttcagttctcttttgctctaacgttctgtacttgtatagggaggttcctttttcttcctttttttttttttggttggcagccaattttgggtaccccaattaaaatttcccaaaggtggttgtcaaaagttaagtgccttgtaaaccccaggtcgcccaaaagttcccatgagctattccctgaaaaggaaggcagcagggatcccgagc

SEQ ID NO: 727381 - DNA, 191 bp, Homo sapiens
caaaaacccaattttcccccccccctggggcttttattctagccaggggagatggatatgatagatttccccgttttttggggggccataaaagttttggccaaaagccaaaggaaccccgggttaaggggataggggccctttggtggtgagaatgctggcttaaaaataaaatgggccattttatttta

SEQ ID NO: 727382 - DNA, 204 bp, Homo sapiens
ggacctgcgagttagggggaggcgcttgtgagtaggcttatttctcttgtcctccgtacagggaggcatttgaagtagatagaaaccggactggattactccggtctgaactcagatccacggtaggactttaattcgttgaacaaacgaacctttaaatagcggctggaccattgggcatgtcttggatccaaacatcggagg

SEQ ID NO: 727383 - DNA, 167 bp, Homo sapiens
  misc_feature (151)..(151): n is a, c, g, or t
gagccggggtatacgtgtcaggttcacaagagttgatcctcctcctcatctttggcctcttcttcaggaggcagtggagacttggagcggctgtggtaagcctcctctcggaattcatgagtaagctccggccatgttcagtccttctcantcccgcgtgtctcttt

SEQ ID NO: 727384 - DNA, 91 bp, Homo sapiens
cggcttagcgcgcgcggcacctggtccgaggaggagcagtcccggggcccgccggaggtggggtggctcagccatggctcctcggggcgca

SEQ ID NO: 727385 - DNA, 297 bp, Homo sapiens
gctcaaacaaggtaatgaccacacagtattttttggaggttaatagtttaggatggcaatgagtatatagtaaggtgcaatatatggtagctatttttagttgcgtggctagtcccaataaatttcatcagcatggtagtaaaaattagctgggcacagtggggcacacctgtagtcccagctacctgggaggctgaggtgggaggacctcttgagcccaggagtttgaggttgcaatgagccggtattacgttactccactctagcctggataacaaaaccagacctcttctgaaa

SEQ ID NO: 727386 - DNA, 1397 bp, Homo sapiens
gagattgtgtgctggcggtctacacactgatccagaatgccgtttatacacagtggtaatgtctgtactagagctgacttttatcgcttggtactccgtgattcgactcgattggttccgttctgatttgccaggtgtacagaatttgtgcgaaagtcgtgactcgtcgtcagggcttttagaagctgattgctcaagtcctcgcgatacagttagagtctagtcaccagaattcccggactatgtcacgcctgcgcaaaaaggaaagcatatggcatcttgtgactcccttgtgcagttatggatttctctgaaagaaaaactgttaggaaagacttggacaccatagtacaaaggatagccaagggtgccccagtctaaatgcgtaaattgtcctcttgatgttccattgctggagcgtagaagaagaagctgtagaagcaacagtcaaacgaagaagtgccgtctcaaacctggccaattttagttaataggaaaccaagatttgattcaaggttaattacttgggagctaacgaagaaaaaggttggcagcgcatcattcaattgggaaaggtctaaagtcaaaggaccattaccgtactataagtcccgaaacttcgcccttgtttcgacagggggccgaaagcgggtatagaccaggagttagggaacagggcacttaacggactggcgattagcagagaagatgttgcccgaagcacagggaaatcgatggggaacatttgcgcaaagcgaacttgccttgccctttaacagaaagatccttcatgtttcatgcccaactttaacctttgggtaatggtgtgaacaatttcgtggacacatatttgcttcccctactttgtggcacctaccttttcgcggtaaaacattagttctacaaaagtttaaactttgcttaactcttggcgccccaaggcctgtttatcaacatggtccaactttttagacatctttcgaccatcaccgttgggacctctaaacatacgtggatccaatggcataatggcgctcatagggtcgatttatgggccaccgttcgcttaattcagttgagaagcagatttccccagcaagtaattttcccagcgagcactctggttaaacaggaaattgttggcagacttctatcacaagggggggcttctaacacatctgcgtgtcgacgccatcgcacttggaaatacggtcggctctgtacaacgcctacactatcttccagccccgaacaaccagttgcttagcgcgtacgttaaccacctaaataggaaaagcgctccaacatttatggaccagcccatctctccaccagagctggtggtccatacgcctttccctagcggcccactcaatcagcggcggcacatactgggg

SEQ ID NO: 727387 - DNA, 279 bp, Homo sapiens
  misc_feature (46)..(46): n is a, c, g, or t
  misc_feature (203)..(203): n is a, c, g, or t
  misc_feature (209)..(209): n is a, c, g, or t
  misc_feature (211)..(211): n is a, c, g, or t
  misc_feature (229)..(229): n is a, c, g, or t
tctgggtgtagcacctgaagatgtccggaatgatgagcagtctggnttcatctgcaatccagcacaccacggccgcagaaatgtatgctccgaccaggcctttcctatctccctcattagaccctgggttctgcaggtgatatttgtgtcttcaccatccctggtctacatgggccatgcattgcaccgcctgagagttcttnagcaananacgcaaagcactgaaagntcagttaagagtagaactggagcaggtagagtctgaaatgcctagggatc

SEQ ID NO: 727388 - DNA, 437 bp, Homo sapiens
  misc_feature (278)..(278): n is a, c, g, or t
gacctgtgagggagtggaaagcatttccgaccccatgggaaaggtgctctcatcctaacagctgccaacaccctatcttctcacccgctccccataacttgcctggtgagtggacctgcttagaccttactgaaccgtgagagctgtgaccttcctggggccatttccagaccagggaagccaatctgagcacgcgggttggttgccagcctggggaagccgcccgctgagagggaattctaaacataactgcgagcgcacagccaggtagcagagtncgccgcccgttggcgggagaagaaagcctggggaaggagaacatcccttaggccacccaccccaggacgagggggctcggacgagacacagtctgtgccccaaagcgcgggggtccccctggcacctccaagcccatcccattgacgaagtaaccgccc

SEQ ID NO: 727389 - DNA, 178 bp, Homo sapiens
ctggcacggctgactgactgactcattcccagatttcctcagcatagcggttgaagactgacgctgcccgatcacctcgcgaagaccccctagaccatcacggacgccgcagcttcgcgctaacatctcacagctggcaaggtaagccctgtccccattcttaactcaactacgtgag

SEQ ID NO: 727390 - DNA, 324 bp, Homo sapiens
ggtttttttttgagtgaactgaggaaggggcttagatggtgaggggtttaaaaaccaagccccatgagcaacagtggaagacctcgggccattcggcctggggaggacttggtggcgatccccaacctggaccccagttaaaggcggtggggtgactgggaaggaaagggcccccacctcctcaggatttggacgtgtgaaataggctgcctgtggggggccccttagggttggagagcccccgattggagggagacagactgcccccccccttccccccctggatttcaagaataaaacaaactgcctttggacttggtttga

SEQ ID NO: 727391 - DNA, 1477 bp, Homo sapiens
gccggcgcatcacggaaatggcaaacggcataggcggctcgggaagatgcagccgtgtaagcacaagtgcagagtagactggccttgtggtattaaagatatatcaagacattaatcaacgcaacgaatggacgaacgggaacctgaaggtatgtacaagggaggtgcgtcatggggatctgagtagtagaaagatcggtgttgaagattaccaagctgggtttcctattccctacagtcatcgacaggaggatgatggctgagcttggaatgaagatccagagtatccagatggagaactgatgcggaagccttacgtgcatgtagaacattgatgcatcttcacgtgggtctggtatcgagtccacaatacgatgggctcattcgtgcacccgggtcgagttcctgcgaattgctcagctattagttacgcagctatgccagttgaaagaactctagtcgatgtctcgattgtatgatccgcattggacactggagccaaaggatctcgtctcactcacatggccatacaggacagagtcctaagaggtgagtgcggaaggttttcgtcaaggaaccctggagtgcctccccttgaagctattgaacaagagctgaattatcacccttgggagttacagttgtgtgaacgacatgtagccgatttgttgttgtcactaggatcccaggatcctggactccaaggggtccctgaatggtggggacacgtgggacagacacgagagttcctgtctcgtttgccatgattaacatggattggaagtttggcctatcaagccatttgtgcgcagctagggcatagtacatttctggggggagaggcgactccgtaacacacccatggcttgacttggggacccatgaaggtgcggttttgcaaaagcgcaatgggcagaggaccacccccgtggacatctccccgaagaggcaataccaatggagcgagactaacccgaggagaagcaccaccagagggaggacagcaagataataacagggcataacacacaagggtcctggccacgcccggaggaacatgtgggggagcacagcatggcgcaggaagcaaccctcggtggtccggttgggaagagacccggttcacactccctcacagaccacgaggggagggagccccggaaggagtacacacgagtggaggccacctaatcctgttgtcaccactcttgagtaaggtgtccaccacagaggctattaagacgaggctaaaaaagacaaaagggttgctcgaagaagatcatacgatcacgcggtgctgtaatattgtttatacagcagatctagccagcgggcagatgccatctcaaacaaaaagaactggaggagtagcagttcctcacgtgtatgtctatctcgtgtgccgatccacagcttctccttccctcctgttagagtacggagcagagaagcgaaggagaagcagagaggggggtca

SEQ ID NO: 727392 - DNA, 561 bp, Homo sapiens
cgtgtgggtcatccggtaatcccagcactctggaaggccgaggtgtgctgattacttaaggtcaggagatcgagaccagcccggccaacatggtgaaacgctgtctccaccaaatacacaaaaagtagccgggcctggtaagtgtctgcaatctctgctattcaggagaccgaggcaggagaattgcctgaacccgggaggtggaggtcgcagtgagccgagatggcgccactacactccagtcttggtgacagacagactcaaaaataatataaaatggaagttaaaatacaaaattagctaggagtggtagtgcatgcctctaatcccaggtacttgggaggctaaggaaggagaatcacttgaacccgggagacggaggttgcagtgagccgagatcgtgccactgcactcaagcctgggggacaagagcgaaactccgtctccaaaaaaacaaaagaacagaacaaaaagcaacaaacttctttggaaaggttctgaggccttgactcctgacagactgtactaccttacaagacattcaccagtaacattaataca

SEQ ID NO: 727393 - DNA, 91 bp, Homo sapiens
  misc_feature (9)..(9): n is a, c, g, or t
agcgttttnaaattcattccaactgtagctgatgactgaaggtggaagactgccgaagtccaaagcttcagcattccttagtgtcaggatc

SEQ ID NO: 727394 - DNA, 1024 bp, Homo sapiens
agccctagaagtatagatgtagtatgcgatagaacattcgaaatctggggcgatagatatagtaccggagagggagagatgacgaatcacttaatgcagaagcttaatatacgtcacaagggactaagtcgctataccttctgcttaatgaataaactagaaataactttggaacgaagagcggagagacgtaagcaccccgcgaaaacgcaggaagcaaactaccttatgttagaacaaacgtaaccgcagacatacccgtgtgctattgtacacaggaatagctgggaaggattggttatgggtagcagtggcggaactatgatctactcgcgtccgtggctgtatacaccatgcgattccgctgcatacgcatgaggaagtcttactttgataggtttctaatcttgtgcctgcaactaaaaaggcactgcataagaaatctgcgctgcctaaagttgaacgttgtgataatgctatgtgaagagataaacggtacgtatggggaacagtgacgtgaaaaaatacatttggtaatgacgaagatggtatatcgatttccacgaacacgattagtaaggtggcttaagaaggcaagacctcgaaactatgatatgaatagcgtggagggtctacaaaaagcaagctgactttaaaacaaaatccctagacatgattaatttggactttctttatacacgaagatatggacactatatctgagggcgccctatgtgcatagaactaagtgttaagttataaaagtacaccattgaaaacgatttctcctcccgcataaagccttgcgtcagaattaaaaccacttgaacttgacaattaaacaagcccaaatatctacaatcgagccaacaaagtcaattattaccctcggtgtgcaacccaacacaggccatggctcattagagaaggtgccacaccacgttacaggaactcgggaatttaccggcctgtggtgcaaaaaatccctctaagatcaccagttttaaggccgcgtgccaggaaa

SEQ ID NO: 727395 - DNA, 507 bp, Homo sapiens
gcgtctgtggggcaggaaaggagtgggcatgagggtgttccccgtgcatggcgagcagctgggctgagactgctcccgggtgtgatggggctgctgtgtccagatatgggtttctgagtctctgggaagggacctcaccccacagccccgagccccaacttgagggtcacagagctcggcaggcaggcttttcccaccccctgactctcagccccatggggcctggggcagccgtcaactgcgccttctcccctcctccgcccccaaccttagagccccccaccccactgcttcctgctctagcggcccccggggaagagggagcagggagctggcagccgccccagcccactccttacaaggcctgagcccggccccaggcccgcccccggcccgcccgcaggaggccccaggccctccccctgtcaagagctgccgccagcccggggccggaccagtccgggggcatcgcgatgctgctgcgcctgttgctggcctgggcggccg

SEQ ID NO: 727396 - DNA, 484 bp, Homo sapiens
cttcccagcaaagacaataatataagtggtgaaaaagcataagaaaagatgctccacgtcatatgtcatcagggaagtgcaaattaaaacaacaatcagaaaccactacacaactattagaatggccaaaattcagaatactgacgacaacaaatgttaggatgtggaagggcaagaacttttattcattgctggtgggaatgcaaaatgatacagctactttgaaggacagtttgtcttacaaaattaaacatactcttaccatatgatctagcagttttctccttgattaacccaagttaattgaaaactaatgtctacacagaaacctgcatatggatgattatagcagctttattcataattgccaaaacatgggagcaaccaagatatccttcagtaggagagtagatcacagtggcatatcctgacaatggaaaatcattcagttctaaaaagaaatatgctgtcatgtcaccgaaga

SEQ ID NO: 727397 - DNA, 112 bp, Homo sapiens
cagccattggactggagtgctaccaggacaacttctccaagattgccctctgtcccttcagtgatgtggctcagctcagtctagtaagacctgcctgccctgggtttcaccc

SEQ ID NO: 727398 - DNA, 415 bp, Homo sapiens
ggagcgtcatcagggagaggcagacccgagggatcaaagatgacggtctcggctcccattagggtcaggatgcgcgcggcctcttgggtcagcagcctgctgaaagagcgctcacgggttgagccatacagcaacaagatgcgtggtttgtgagtcggttgctcgttgccttgcaggcgatccagtgtgacgaagtcgattagcgactgatccagattaggtagatccaggctgctttccgagaaaaattcgtccattacagttcacctatttgatctagctcgcgcttcagttcctgcggtgtgtgcgccgaatgatccaagctgaagaatgcctcgaaacgctttttaatctggacgacggtcgcgtcaaatgcggcttggatgtcgctgtctgtgccttctacatcggaaga

SEQ ID NO: 727399 - DNA, 274 bp, Homo sapiens
atggtcctgctctcaggttttctgagtcacgaacacaacctacacctatctcatgtcccctgcaagaaataaaaaggatgctggcactgtgcaaatccagcagagtagaagtgggtctgcacccacatggtctcaagagccaccgtgccactgctctcatttctccacactgtcccctgcacttgcccccgtcccaccttctcaccaaccgtccagaaggtgtgagaccagtctccgtcctccttgccctttcaagtaagccaggaacatggga

SEQ ID NO: 727400 - DNA, 116 bp, Homo sapiens
gtctgaacaatattcacaggtataacttgtatcatacagcaaagcagctattacaaagagcgaatactcatgaattcaagtagaatctgacataaattattgttgaaaatgttata

SEQ ID NO: 727401 - DNA, 286 bp, Homo sapiens
gctgggaaagaggcagctagacttgcgccaggaggtccaccatggtctcagtgagggctgtaaggagacagagaagtttggccagggggtccaccatactgctggtcagcctggtaaggagacagataactatgtccaggtggcccaccatgctgcagctcaggcctgtgatgagtcaggatgatttgcccaggaggcccaccatgtgcggggcaggccggaaatgaggctggtaggcttgcccaggtggtccaccatggtcttagtgaggactgtaaggagacag

SEQ ID NO: 727402 - DNA, 110 bp, Homo sapiens
atccccatctatatgacttcctggagactcacatcctagatgaggaagtgaagcttatcaaggagatggctgaccacctgaccaacctccacagactggatgtgccggag

SEQ ID NO: 727403 - DNA, 920 bp, Homo sapiens
tgagcggagtgggatccgtgcgggcccccgcctgccggagcgctgagccgcgggagcggagccggggttagcggcgctgctggaagatggcgagccggccggtgacgagctggccgccttgtgtgtgctagggcggctcctgtttgctcatgtgcctgctgctgctggggagctcggcccgggcggctcacatcaagaaggcggagggcgactaccacaactacgagcgcggtgcgccgaggccgggctgagggccagttcagaccggctactaccacgagcgcaggcgtcgggagtcggcgctgagggagtgctggcggccgcggggcccttcccccgggcgcttggcccgcctctttagcatcggccgctcggtgcgaaggcggggcgcttgtgggtgcttcgcctcaccggcgggctgggggtcgctaatccctgaggggctgagcgggggcctgaaccgctgcctgtgtccccgacgcctgcgggggccggttgttgccccgtgccgggccccagcgtgaaccgctggttgggcaacattgcattgggacagagaccgtgtcgacgccaaggtgtagatctacacttgagcccggcgaagcttgggcgtgccaggctaacctgtccgcggggggaccccggcgccttgggacccgcactggcttcaaacacaaccgaaaccggtagttaccccatttgcttggccaaagaccttcaaaaccccccgaagtgggctttccgaagcctgttggccctgctgaacggggcacaacctgtgtggcctatccggcgagaacgttggcagcccaccgtcgggagcccccagcgcgcgcttggaaacaacacgacgcgcaggcacacagacgctgagtagcggacggctctccagaccacagcttaacacccgggggaagccc

SEQ ID NO: 727404 - DNA, 170 bp, Homo sapiens
ctgtaccacaacaaggtccagctcacccctactgggggccttggtctgaacttggccctgaatccgttcgagtattacatattgttctttgccttgagcctcatcactcagaagccacttcctagcggcctgcacgtccgtactggagactgtgcctactgcatcctggc

SEQ ID NO: 727405 - DNA, 93 bp, Homo sapiens
tcagtcctgcgataactattgcctacgggcagtcaggccccttaatgattgactatttggtttttgccgttacccggaggacttttaacctga

SEQ ID NO: 727406 - DNA, 1682 bp, Homo sapiens
atctgacagtcaggcgcatcttcttttgcgtcgccagccgaggccacatcgctgagacatcatggggaaggtgaaggtcggagtcaactggatttggtcgatattgggcgcctggtcaccagggctgcttttaactcatggtaacagtgagatattgtaagccatccaatgcacgccctatcatatgcaccgtcgaacatcacaatggtatacttattgtccaatcatgatatccaccctatgagcaaatccccatggcaaccgtccacaggctagagaacagggcaagcttgtccatcaaatggtcaaatccacatccacacatcttcccaggcagcgcagatcccgtccacacaatcctaagtgggtgccgatcgctggcggccatgacgttaactgtatcgcatgcagaccgatcacaaccatggagcacgcatcatatccacacccaacacccatagggaataaacacgatgaccatatgacagtgaccatccactatatcggcaacaatcatgtacaaatactcaagaaactcgaataccatccccactcaatcatggaacaccaccaatcctttgcctcgtaccagcaccatcaccaacttgattatcaagaaatccacctgtggtatagatcttcaaacacaacactgtaaagcaatacacgtgatcacttgcacaatcaaacaatgtaacacttcaacgaagacactccaacttcatatcaacaataatacgagaccactatccatcagtggcatctacaaatctacacctatcacattatcacaatttcaaacataacatacaacaaccaaaattaataatcctcactataattattttatacacaccaaaagtgactatatcaacaccatactacaaatatagaaaatacactaaacaccactaacaagcaacacatctacataataacaatccacacaaatcaaattactactatttatccctcctatccataaataatgacaatacctatatttctctcattataactacaaaccatcgtctcaactccactcatatagctaccacctcctatctcttatatgaaccaaatcaacatacctatcctactaatatctcaatattctacatatataccatctccaatcaatcattacatagacaatacaatccaactcaaaatacaaacataaaaactaacactctatatcacatcatagacacatctaatcatatcaactattataatacactattactaacaacctcactccaacatcaaacatataaacatataactaacccactcaagtattaacaccacattcacacaactcatatcatatattatatacactattatagataattaagataatacagaccatacagaacgatgttgatacactaagactagcaccatgagagttattcagacataccatgataggattgaagcatacgagtcggtgatacagaacaacagagaaacacataaggtccgtcatgatataactaacactagatagacaatattcattataatgaccatcacagtaaatacataacatgtgtcgcggtaatcaacaaagtgtcgtcataacagatcagatactacccacaggcgatacaagacaacgacaactaagtagtaattcaactaacggccgtagtcttgtttaatcagtaaga

SEQ ID NO: 727407 - DNA, 1182 bp, Homo sapiens
  misc_feature (59)..(60): n is a, c, g, or t
  misc_feature (75)..(75): n is a, c, g, or t
  misc_feature (101)..(101): n is a, c, g, or t
  misc_feature (104)..(104): n is a, c, g, or t
  misc_feature (119)..(120): n is a, c, g, or t
  misc_feature (137)..(137): n is a, c, g, or t
  misc_feature (142)..(143): n is a, c, g, or t
  misc_feature (212)..(212): n is a, c, g, or t
  misc_feature (246)..(246): n is a, c, g, or t
  misc_feature (271)..(271): n is a, c, g, or t
  misc_feature (273)..(273): n is a, c, g, or t
  misc_feature (295)..(295): n is a, c, g, or t
  misc_feature (321)..(322): n is a, c, g, or t
  misc_feature (341)..(341): n is a, c, g, or t
  misc_feature (348)..(348): n is a, c, g, or t
  misc_feature (368)..(369): n is a, c, g, or t
  misc_feature (372)..(373): n is a, c, g, or t
  misc_feature (378)..(379): n is a, c, g, or t
  misc_feature (389)..(389): n is a, c, g, or t
  misc_feature (399)..(400): n is a, c, g, or t
  misc_feature (405)..(405): n is a, c, g, or t
  misc_feature (422)..(423): n is a, c, g, or t
  misc_feature (428)..(428): n is a, c, g, or t
  misc_feature (430)..(430): n is a, c, g, or t
  misc_feature (455)..(455): n is a, c, g, or t
  misc_feature (629)..(629): n is a, c, g, or t
  misc_feature (644)..(644): n is a, c, g, or t
  misc_feature (673)..(674): n is a, c, g, or t
  misc_feature (681)..(681): n is a, c, g, or t
tgggctgagggggccgtacggaggtggcagctggtgggaggaggcggcgtggaaggccnnaggagctcaagcccnggaccaatccccacgttccgggccgngancctgaccctgcagcnntaccgggaagcgaaacnggctnngatgggccgctgagcccgaatcgggcactgtgtggagccccctggagctgagatcaggatgttccgctncatgagggactgtggagcctgaggatcccatgtncctgatggatccctttgctattcancngtcagcatatgagccgtatgtngtcaggtggctttggatatagcaccnntcctcagcatcacagatgngcaacantgccagggaccagggcctgnncannccgcnnggatgcagcnaggctggagnntgtcntccccactttgggatgnntgggnantgtcgggtggtttcatggacatgtntgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggaccaggcgggatccgggagaccggnggactgttcgggatncagacagtggactggagcagatgtccatnnggcatcncatccgggacagggctcacatcttccagcgctcccgaaaccatcgcaccgggggaaccaggaggagcggcaggactaattatcaagctggatgagagtgaggccgcagcgtagatgacgagtggcggcggaaggggcctcaccgccgggccatccagggacctgaggactcctcttcccgaacagtcccgccgctaatgactggtgaggggccgggccttaagctctctggtaccaggctgagaggctgagaaatcaatccctgagataatttttacctctcgaattcccaatcccccaatttacgtattacaacttaaccagcgcaagcgggccccatctctcccctggggatctcagagaagaaacctttccagggcaccctttcctaaacatatcctttctttaatctcctgttacccatggatgaatttcggctctgcatcttatggacttgattttcattctggccatcattttaaacccctcactatccatctaa

SEQ ID NO: 727408 - DNA, 156 bp, Homo sapiens
tgctcgatcactagcgatctcatacattctggttttgctgtactactttccataagtctgcaataatttttaaaacagccaataaattggtagggcttaccagcatgatatttttatcgtaagcatacttccacaggttcgtgtctttctttactg

SEQ ID NO: 727409 - DNA, 183 bp, Homo sapiens
tggaaaaaaaaaaaaaaaaaaagggggggttttccccctctaaaaaaaaaaaaaaaaaaaaccccccggggggggccgaaaaaaacgggggggcgggggggggcccccccccccccccccccccccccgggggggggggcaaagggaaaaaaaaaaccccccccccgggaattttttaagagg

SEQ ID NO: 727410 - DNA, 316 bp, Homo sapiens
tttttggcaaatgtttatctctgcaccattgtccaaggtcaagtggctccaccctcaaggttaagatataatgtaatatctcatgacagtatacagatttcatggaaggctccaagagggaaatttggtggttgcaaacttcttgtgactccaacttcaggtggaaaaactaaccagctgaatctgcagaacactgcaactaaagcaattattcaaggccttatgccagaccaaaaattcccaggttcaattattggcttccattaagataaagaaagccagccagctcaagggccattcagaatttaaggtttag

SEQ ID NO: 727411 - DNA, 244 bp, Homo sapiens
tcgcagtacctcgatggtacaggcaccagttcagacttccatgtgtatgtagaatgagtaatgccaccaaatgatcaccactgctgccacatctggtcatctgtgctgctgatgtgtagacatgatgaagaggtcctgagaaaccatgtgccctggttccatgatgtttgtcaaatgacgggtgtggccccgtgagggaggaaatgctggggtaggccccagatgtggagatgaggggtgatcc

SEQ ID NO: 727412 - DNA, 209 bp, Homo sapiens
  misc_feature (92)..(92): n is a, c, g, or t
  misc_feature (94)..(94): n is a, c, g, or t
  misc_feature (151)..(151): n is a, c, g, or t
  misc_feature (202)..(202): n is a, c, g, or t
tctagagtgatccccccgcggtccatgtctgagcatagtggcttatagcaataggaactaggaatagccccctttcacttctgagctcccanangttaccctagcacccctctgacatccggcctgcttcttctcacattacacacactancccccatctcaatcatataccatatctctccctcactaaacgtcagacatnaccgcgg

SEQ ID NO: 727413 - DNA, 133 bp, Homo sapiens
tcccactactgatcagacacgggggtatggaccaagctctgtttcctgaccatgggccggttcaccgcctcctaaaggcaacctggtggtccccctgctccctgggaggtcaccgatatatgatgcctgaact

SEQ ID NO: 727414 - DNA, 114 bp, Homo sapiens
ctgccgaacctgtcttatctcagctcaggtaccgctcctccaggaccctatatgtcccctgccctcctcctccttccacagacaccagctctggttacaaggggaaaactagaa

SEQ ID NO: 727415 - DNA, 171 bp, Homo sapiens
cggtcccaagttatgtttatattgggttaaaatagaggagaagggagttcccctatggctcagtgggttaaatgatctgatgtcactgctgtggctctggtcactcctgtggcatgggttcaatccctggccggagaacttccacgtgccatgggtgaccacggccacccc

SEQ ID NO: 727416 - DNA, 335 bp, Homo sapiens
  misc_feature (101)..(101): n is a, c, g, or t
  misc_feature (310)..(310): n is a, c, g, or t
agatcttctatattccgactactgattcaaatgctaatcctggacgggcatggtggctcacacctgtaatcccagcactttgggaggctgaggctggtggntcgcctgaggtccggagtttgagatcagcctggccaacatggtgaaaccctgtctctactaaaaatacaaaaatttgctgggcgtggtgacatgcgcctgtaatcccagctactcgggaggctgaggcaggacaatcacttgaacccgggaggcagaggttgcagtgagttattgcaccattacactccagcctgggtgacaagagcgnaattccatccccccaccaaaaagcg

SEQ ID NO: 727417 - DNA, 338 bp, Homo sapiens
cctcctaccgacgcatcaggcataatctttcctacatatcatttattcatagaagatctctcttatggagaattaactgaagcttagaggaagagacttttttttgagacggagtttcactcttgttgcccaagctggagtgcaatggcgcgatctcggctcactgcaacctctgcctcccgggttcaagtgattctcctgcctcagcctcccgagtagttgggattacaggcgcgcgccccccacgcccagctaatttttcgtatttttagtagagacggggtttcaccatgttggtcaggctggtcttgaactcctgacctcaggtgatccgccca

SEQ ID NO: 727418 - DNA, 1175 bp, Homo sapiens
ggaagacgcatgtacctcgtgcctggggaggaggatgatctacttctcagggggcgtcgtgtgctgatccgtggccctgtggccggactgggctggacgctggcggacgggagctggcgtgtgggcgctgctacgttcgccggctgtgcctgtgtggcgtgctggctgtggcatccagtggtctgctgatctcgagtgagctgatgaacgtgctcggaccgtgcatgcgggttccctctatactgtataccaggcggaaggcgtgtgcgtgcttgcgagctccgatggagcttctgtgaggatacagggtggggagctacatggtgcgtggcaggtcaataggctccctccgaagagtccctcggctagcccctttggcccctccttcgagaagtcgtcgtggcatgggcacgggcgccggccgggtgcacgtcgtgtctgtgaacgcagcgttggtgacgagtagggtagggcattgtgggagcggtgggctgggcgatgggggaccgttggcgtcgcggaaaggcctcgatgggtggatcctgcgtgcatacgggcgctgcgctgggctgcagggcaaacgacctgccgcgggcaagggaggatggtagcgggcggacgcgcggtgcatgtgacgcgacgagcccctggacggtgcctgaagcagggcccttgcgtgggcactacgtttgtagtccagatgggtggacagctgggtggggcgtggatctgaccatgggaaagggaaatgattgcctggcaaaagaattagggttcgagtcaggatagacacgcaataagctagactagcggaaacctacacaaatccgtcttccctaactagtggacgcccggggaggccaagtgagcgaatggcgggcccacccaccaacgcgtggaaccgtccacgggaaggagtggtataagaggaagatggcaaggagccctgggacaggtgctgggtcccaccgtcccgggggccaaattggaccaaggtggggaccttaaccactggggaccataacgagcccgccgtggaaggatccccccagaaccagggcgttggcgagtggagcacaacgacgggagagcccaacgcacgccatttcgggaccgcccgcgataacccctataggggaagaagcggagaaaaagggggcaaggatacgggagga

SEQ ID NO: 727419 - DNA, 1343 bp, Homo sapiens
  misc_feature (243)..(243): n is a, c, g, or t
  misc_feature (393)..(393): n is a, c, g, or t
gccgctctgcgttctgtacctgtgcgctgacgtggggccaccatggatggcattgtgatgctggtggattcttggcgcgctgggaacagcggtcatagggttcaggagagtcctcacgtgctgtgatcccacgccatagggcattgacgctgcttgccagatcagtgctacacctcgtctgtagttgcgtgaaagcagtttcaaggctacgcaccatgatagattcgatctgtggccttctangtcgatctgggactggtaccatatttggcgatttacccatgagaaacccgacatacgttgcttgaagactgtcatcgacggtgcgaccgaaacgagaacgaaccatgagctagcgtctgggtctttgctcatatgacgtgagcatctacnacacattcccaacaatctctacgtatccagagctcgtgtggtaacgaacgactaacgacatacattatacttgcttgacacttggaagtcgtccaagtcatctagcataaagtaagtggacacgctaatagtgtactcgatggaacgtagtacttccggcgatctgtttgtgtgagcttgtggcttacctggaaggtacagagaccagtgactggagaacagtgtggactcatggctgtgagaactaactcgagtgaatgaaggagagattcgactgcattcctgagtcctgaagaggctccatggagtgaatttcgtcgaaaccaggccgactcgtcggtaacgctccaggagacaaacggagatgatttcgtgtctgcaacggaggatcgcgaacattgcgtgcctagaggtcgcgcctttgtcatggaaacgctgagaagggattcgcgcgatagatagggcgaggccccagataggaatttgggacaagaatgtcctagggttcctaggaacctgtgaatgataatcgttcaaatggtttccccgttcgcggttccccattcataacttatcacccttgatattggcacaccaacagaacgtcttgggtcatttaaaaccaccgtaaaaatcctcgtttaagttgtgttttacccatagaagcctacctaagggggacgtgggacctagccttttacttacgacgttcaaactagaaacacgttgatggcagtttatggcaatatttgtacaaaaacaagaggcgccctatttgtaaaaatatattttacccacaaagaaggtgcttatagacagtgtgtccacaattgccccatagggagatttacacaccttttgtaagtgggggccatagcacatatttcaggcagttcgtccggttaaagggagttaaagcacgatgtgttgtgcaccgataagggaacgta

SEQ ID NO: 727420 - DNA, 525 bp, Homo sapiens
cgctgatagggtatttaaaaatgcccataacacacaactagactccttaaggtgataatatatattactgcaatatattataggctacttatgataagtatatccgtggattcaatatctacaaacaaaggaggactcaagggaagcagacgacccaatatctatcaataccattccatcatattagaatacatcaaggcgcgatatatcatgggcccattggtttatgggtgaggcttggcaacggccttagctacttgcttttggaaggtgaatagagcaccacgattccccctcaggagaggttgccgttaccaagagacactggaacctcaggtgtataacagatttgcgcacggaagaggttgctgcgagggctcataggctacattaaatatgttacaccttttcgtgccccgacccctaggacactctatgcgacagcatattgaatactgtgctcgcacacattgggacctgtcctagagtgtggcttgtggagaggggtaatgctctggatggggg

SEQ ID NO: 727421 - DNA, 819 bp, Homo sapiens
tgggtttggagaagtagatcggtgagcagtgggagcagcgtattgatcccccctgcctatcagcttcttactgtggagcctgttcctacactgtgaaacttggcgccgtctagtgttgttagtgtagtagtagtagtagtagtagtagtagtagtgtataatgtacaatgtacacctatgcgctagtccaacgctcctgcatgctgcccatgccctatcctacacacacacacggaccgaccactctacctcactacccaccactcacccccccgcactccgacagacaagcccagacccccccaccctaagccgcacccccgcttcacccccaaccccccacccaccacacacccgcaccgcgagcacaccacaccacaccacacgcccacccatcgacacgcgcgcccgcgcatgccggcccctcttcttcttcatactatcatcacatctccccactctcagaatcattccactccactaactactatccaacagacactctacaccacaaatacataacactaacactctaacaccacacccatcaactcacccccctcctttatctctcacccccaagaacaccccccgataacaacctcccacacaaccactagtcacaagactcacacaaaatacaccacctcaccactccccacacacacaacaccaccacccagcaccatacgccccctccggacacctcagtcgtagcggccccaccacccctagccacgggtacaacaacaaccacctcacacgcccaacagccgcagcactcacacacacacacaccgacaccccacacagccgcgc

SEQ ID NO: 727422 - DNA, 113 bp, Homo sapiens
gggctagttctagatcgcgagcggcgccttttttttttttccctgagtaaaagcaagaaatttcttcctttggaaaaatttttatttattaaaaaaccacttttagatggttt

SEQ ID NO: 727423 - DNA, 305 bp, Homo sapiens
  misc_feature (22)..(22): n is a, c, g, or t
  misc_feature (46)..(46): n is a, c, g, or t
  misc_feature (139)..(139): n is a, c, g, or t
  misc_feature (247)..(247): n is a, c, g, or t
  misc_feature (282)..(282): n is a, c, g, or t
tctgtcgcccaggttggagtgnagtggcgcaatctcggttcactgnaacctctgcctcccaggttcaagcaattctcctgcctcagtctcccaagtagctgggattataggcatccaccaaaacactcagttaatttgngtttttttagtaaagaggggggtttcaccatgttggccaggctggcctcaaactcctgacctcaagtgattcacccacctcgggctacaaagtgttgggattacaggnatgagccactacgctcagcctaatttttttatttncagtatagacctgatttcaccat

SEQ ID NO: 727424 - DNA, 383 bp, Homo sapiens
  misc_feature (38)..(38): n is a, c, g, or t
  misc_feature (62)..(62): n is a, c, g, or t
  misc_feature (146)..(147): n is a, c, g, or t
  misc_feature (150)..(150): n is a, c, g, or t
  misc_feature (230)..(230): n is a, c, g, or t
  misc_feature (241)..(241): n is a, c, g, or t
  misc_feature (251)..(251): n is a, c, g, or t
  misc_feature (365)..(365): n is a, c, g, or t
aggaccatcctccaggacaggtgacctctatgaggcanaaccggctgtggccgacaggctgncttccagcccagagtggcccagtagagcaaggcagacagtgacctccacccccgcagccctcttaaaaggccagtactcttggnnttngggggagggtttagaaagcatttgcccatctgcctttctttcccccagcccccacccgctttgaatgtagagacccgtgnggacttttaanttttgtggtngggggtgcggaggaggtacccccacccctgggcacagccgcctgggaatgcaggactgtcactgctgttcgggtgatgacctcgttgccaagctcctcctgttcccttgttctngggggcaggcgctgtgtt

SEQ ID NO: 727425 - DNA, 486 bp, Homo sapiens
  misc_feature (3)..(3): n is a, c, g, or t
  misc_feature (95)..(95): n is a, c, g, or t
  misc_feature (118)..(119): n is a, c, g, or t
  misc_feature (478)..(478): n is a, c, g, or t
  misc_feature (483)..(483): n is a, c, g, or t
tcngaccgggagaatcaggcagggaggctgcagtgagccgagatggcagcagtacagtccagcttcggctcggcatcagagggagaccgtggaangagagagagaggaagaccgtggnntgagggagaagagagggagagggagagggctatttttaaaattttttaaaattgctgaacaggggtacctctgggcagtgtgtcagaataccactttttaaatattttatgatttatttatttttctatttgaggttttaactgatgtgtatctgtatgtctatttgtgtatattttgtcatgatcatgtaacagagtctgaaaagtgtccgaagagacagttttcaggaacaacaagcaattattcctactttccaagttatttttgatgccatggtggctcatacctataatctgagctacttgggaaggctgaggcaggagatcccccttgaacccaggaaggcggaaggtttccnaaaanccg

SEQ ID NO: 727426 - DNA, 230 bp, Homo sapiens
acgtcatatccggacctcgagtttgtaacttcttactgctcattatatattacggttcgaaatgggatcacacataggtatgcttatgaccttaactgtaacagcgatgaaatacataaagtggttgagctcgtaatactaatgcggtaagagtgtcagtaccagtagcttcatgtgcagttctacaagcccaataataattatgctgaaccgtgtaaacaggctccctc

SEQ ID NO: 727427 - DNA, 729 bp, Homo sapiens
cctatcatatagtaaaacccagcaccatgacccctaaaagggagccctctcagccctcctaatgacctccggcctagccatgtgatgtacagttccactcctagtaagcgctgcctcgatactgagggcctcacgtaaactcaatgacactaaaccataataccaaatgcatggcgcgaatgatagcacgagcaaagctacgattaccgataggccaccagaaccaccacctgttcgcaaataaggcctgcgagacgggataatcctatatattgacctcagaagtcttcctgcttcgctaggatgtgtcctggagcctgtatggccattccattcgtagctcgccattacccgcccaggggaccgatggcgtggttccttaccctcagttagccctgtctaatcctgtagcaagtcccggtcgcgtgaagcaggagtcagcattatctcgagattctaggagtaatccctgctgggcgtgagcatcaccaatagtacttaataggatagacttcgcgaaaccaaataaattcaagcactgcttattaccaattttgagcctggtctctcatttaaacctcctacaaggcctcagagtagctttcgagctctcccttcacatttccgacggatctacggctcaacattgagtagccgcaggccttacaaggacttccacgtcactcatggatcaacctccctccaaatctgctttctccgcactatatt

SEQ ID NO: 727428 - DNA, 153 bp, Homo sapiens
agtagagacggggtttcaccgtgttagccaggatggtctcgatctcctgacctcatgatccgtccgccttagcctccaaaactgctgggattacaggcgtgaacttgcgcctagccgagaaaagctatttctgacggaggcatgtcaaccaat

SEQ ID NO: 727429 - DNA, 376 bp, Homo sapiens
ttaaaattcggataaaaatctcataaataggcagtattgttatccaactgtgggataacagattatctatgggatatcagataacaaaggggatatgtcacacgaagacttatagcaaaaagtacaaatggcaatcaggatcaggctgtgagaatgtatccacataaatgggtacattaaaaagaatgataaatagggcaggcacagtcaatattttaggaaaaatatttgtttaatgcaaacagaaattaccccaagaaaaacatgccccatccataatcattagcttcaccatgacacagaaccccttcatagaatatagacgcatgccttatacacaaaccaaatcaggaggctctatgtatcccagaaccaa

SEQ ID NO: 727430 - DNA, 331 bp, Homo sapiens
cgactggcgtgttggtggagtgtcatcctgaggaaaatgggctacgacgaattacctggaactggtccagagaggccctctgagtgctgggaaggacactggggaaaatgagggggcgaatgagtgagagaagggccctgtcccggtggtggtctgaaccccactggggcagagatggcttaccttgccggtgtgtaggcacacacagcaggcttcccagcacctggcacaccctgtgggcagcaaagaagcaggtggcaattgcaggcagaagggtcagcaaatcacccatcaatacttgtccaacgccatcagtgcccctggtccccag

SEQ ID NO: 727431 - DNA, 304 bp, Homo sapiens
ccctgggggctttgaaaattaaaggcctgggccaaaggggccctattttttttcccccccttttggggcggaatccctccggggggttaaaaggccacccccccccttcctttaattttccccttgggtattttttttcccccgggtaattttggcctgggggggttccccccttttttccttttccccctggggttttatttggggttttgggggccttttggttttttccgggccccccatttttttttggggtttttttttttgggggggccccaccctatttaaaatttccccccttgga

SEQ ID NO: 727432 - DNA, 500 bp, Homo sapiens
  misc_feature (241)..(241): n is a, c, g, or t
  misc_feature (267)..(267): n is a, c, g, or t
  misc_feature (269)..(269): n is a, c, g, or t
  misc_feature (279)..(279): n is a, c, g, or t
  misc_feature (285)..(285): n is a, c, g, or t
  misc_feature (300)..(300): n is a, c, g, or t
  misc_feature (306)..(306): n is a, c, g, or t
  misc_feature (343)..(343): n is a, c, g, or t
  misc_feature (368)..(369): n is a, c, g, or t
  misc_feature (411)..(412): n is a, c, g, or t
ctgggttgtcgagaactgcgcgaggttacgcagggacggggttcgcaatgccccagactcggcctgggctgttgttttggagcctcagcaggtgggggtgcgtccctgtcagccattccctgcctctatccctggccacctgcagagcctccctccgggtgtgtgttttgagaccagcctgccaggccctccagcaggaggacagagtgccctggggcatccaccttcctgcccaggggangtggcgctgtcggtgtttggaggttncngccccctggntttggngccccatgggccctnagggtntccccatgttgggctcaatacatgggccagcccttgntttacctggccggtaggctgctggnncctaggttgtgttaaaagggggatgcccctggccctgcctcnntgtgacctgttcctgcccacgtgcagcccctgtccccttttttaaaaataaaatccccctgactgtggggggcatcggtttccggaga

SEQ ID NO: 727433 - DNA, 318 bp, Homo sapiens
atgatttttaccctggtagctagaaataaacatgctagcttttattccagtctaaccaaaaaaataacctcgtttccacaagaagctgccatcaagtatttcctcacgcaagcaaccgcattcataatccttctaatagctatcctctttcaaaccaaattatacctcctcccgggaccaatggaacccataatccaaattactacccaaatccaaaaaattttaactcatcattaataatcataatggctatagcaataaaactaggaatagccccctttcacttctgagtcccagaggttacccaaggcacccctc

SEQ ID NO: 727434 - DNA, 131 bp, Homo sapiens
acgcaacgccacacagcaggcctgagcagctcagcaacgagctggcacagagcgcagacggccagaagactgagagtgcccggagcagttcgagtggcagaacaaggagctcgggagcaagctccaggaga

SEQ ID NO: 727435 - DNA, 159 bp, Homo sapiens
gtcccagtttattagaaaaaaaagggccacactttaaaaataatctctttcttatatatgagaagacagctataggaaataggtgttatccaaaaaagacggaactgtgtatttttgtgttgttttttatttgtttttctttttttatctaataacttg

SEQ ID NO: 727436 - DNA, 1524 bp, Homo sapiens
ggtggaaacaatggagagggggcgtgttgagctggaggtctccaactgcctcgtgggtcgagagggagctcacgtacccaccagcaggcagttgctgtgatgactacgtggcgcagagcatcggccgccaggtggagtgtgcgcggagctgcagactggttggggtccttctacgcttgtgtggtcgagcggcccggtgtctgcgacatgggctcaaacagcaatgggagcaactggatagccaacgatccgtggggcctgacgacgggacgtgccctacaagcatgcgtcgggtcccccaagtacggagcatcgcgtgccgcatgtgtggcatccaagccggtgccgcccagggggaaaacgatgtaaggcgtgacgtacgtttagctattagccgaccgaagattcactaacggatcgtacgggctgtcctgcccattccgcgttgaccacatgaaacccgaggggtgattccatatcggcgaacaccacatggacgtctagtggaatccaccccgagggcacaggggaacgtatcgtggtcgccccctagtcacacactcggtgaacccgattcgtcagaggtttcgacaacaactgcgctacaaggcaaacccattcgcgcacccgtatgtacgtgttgtgcccttgcaacgtctgtacccaggcgtaacgcaaggatccccgtggaaggggcgcgttgtggtcaaccggggccctctgctgtgtgatcgaccgtatataccacgaacctaaactagccggtggttgtggggcacacagcgtgggtgcctgtctgttggcggcagaaatttcaaggcccctggagcccattgacaatccccaatggggagtccagggtactttcctccgatggggtcccaatttactggttcccaaaggatactgctaggccagaagctggacaaacggccgcgtgaacaatggtgttgtcgctaggccacacgcgatatgggacgggtgcggacttggccccatgggaaaagcaaaccgtacggcaccggcaaagaaattggaacgggggcggacacccaggggattaccaaaggactggggccccatgggaatgggagggatcttggcggggaacggggcagccgataagcaaggaagtacggaatgccacaaggcccggcgggcagtggaaccaatgtgcgacccgccgggaaaattcctacgataacaaagctcacgcgtgtagaaccacacctccggagttgtacatccctgtgggacaaccggtccagttggtggagggcccacgatagggttcgtcacgtaccaagaaattcgaagattacccccgttggaggacgtttcgacaggggaattcgccccactgggaattggagcgcgaccgggtgcattaagaatcttgggcataagtcgatgagtcgtgacaggcatcgtacagacagcagagggatatcggaggtttgcgcatctgtaaccacatgtcatagtcacaggtcgagccaacgtccagtttttaggaaacgagcg

SEQ ID NO: 727437 - DNA, 598 bp, Homo sapiens
tagcgcacgaggcgccttgagaagtaggtggggttgtggaaggtgcggaagatgctggctgatgctgcgcattggagacagggccttgtgtgattgcacctcagcgtcctgctcggctctttcatccaggcagccagtcacctgcctcgactccgcgtgctgataggtctgcatgcgctccagcagccccgatgagcgcctgttgccacgtcagcgagctgcatgtactgctccgtgttgaatatgcggatctcacgctccagctcggggatgatggcgcctgtgcgcgagccgtgccgcagcatgagatccgccagatcactatagaggtggtccccgaagtagagcacgcgggggccacgccattccgtcaagcgtaagaagtcaaacaggtttccctgccgatagatcttgcccttttccaagcgggtgatccggtcccactgaagtgagcccttctcatcgagttttctgaaaggcttgcgccggtcagtgaagaagctgggcttgtctgcctggacaatgaccacatcgaagagctgcgccaatcgggaccaccatgtgccgatcccttgttacgaagctaaggacgtggtga

SEQ ID NO: 727438 - DNA, 159 bp, Homo sapiens
acgtgcgatgagtaggggaagggagctactagggtgtagaataggaagtatgtgcctgcgtcaggcgtctggctggttgctcatcgggtgatgatagcggggggagggggggtttggtggaaaatttttttgttatgatgttctgtgtgaacagcggct

SEQ ID NO: 727439 - DNA, 134 bp, Homo sapiens
actctaccaggatccccggtgggcgttgaatggcccggaggcgcatgtccacttgtgtattaacacaccatccacatcagtacatggctagagtgcagctggcaagatcatagctcactacagcctttaactcc

SEQ ID NO: 727440 - DNA, 486 bp, Homo sapiens
gcactgttttccaagaagcacttagtgttacctataagtaaatgttgagcatttattttttagatatcgctttaaaaaatgccaaattagtactctgcctagggacccacatatttaaccctggagttatattccccagattcatatctgctatgggcagtaatctttccaacatacttctgaacttttgattgttttattttgttcatttatttatttaattagaaaaaatacaactctccttactatgcttgatgctgtgggaatatagaaacatggaaaaaacatggtctctgtctttaaataatttacaatcacttttcttatgtgacatcataataggagagacaggtctgaagaaaggctacttccactgtgcaagaaccagaaatgcagctgtacggagctccgttactcactatacaaagtaacattttatcacacaataaaaggaactcaaaagtttctcagtggttctgaaataaa

SEQ ID NO: 727441 - DNA, 797 bp, Homo sapiens
  misc_feature (797)..(797): n is a, c, g, or t
tggcttgtaacagtgttaattggatgatgagctccagtgctcctgctgaacccctgtgtggggaggtggcacagagcgaaatggggcgtaagggaatgcttgaaggtgcttgctcctgtgattcgtcgggctcagagagcttccagactatgtgcagatggtgcatgggtgatgtgccttctggtgcacacatgcctggccgcccatgtcaccctgtgcccatgatttgtgatgtgtgctgtgcctgtggccccttgcgcatgtgcactttgccaggttgtgtgctctcacacctcacgcgcacacttccgcaccagaggactctcaagggcgcggtcctccacaaactctccaacccatggtgcaaattttgacttatatggtgcaaatttaaatttcaagaaagggggactgggggtgaggaaccaagattggtcggggagagtgtgctttttgagaatctctctctctcaaagaaaaacacagtgggaaaacagacctgtgagaaaaaatcgccctccatagaaaaaccacaatagagatagaaccaagaaaagtggggttggagaacacaaatcgaacatagaaaaagaatggggagaaggtgtgtgcggggtgggggggggacgtgggcgtggctcaaatcccccctcgcttttgggagggagagcgtcctcaaaagctctcttgtgggggaaattagcaaattgtttgtgtgtgggccgtgtggggggggtgtccacaccgcgtggttcccgtggccctgcaatggtgtggtgtgttgggccctggatgan

SEQ ID NO: 727442 - DNA, 904 bp, Homo sapiens
ttggacggctgttaacagcaggtggggaggaacagacttgggtgagagttggagggggataatgggggagacaacacatagaagaagggttgtgtctgtagtgttcgcaaggaaagggggtgggtgcacaacggcccagcagtatgatagagcagaagactggtgctaaataaatgtcctatgtgttccctacaaatagtgtgtgtgtcgccccagcacgcgccccacatatatttataagccgttaccgcaaataacatagagctcttatataagaggtgcttcacaacaaatatttttggccctctgttaactgatagagaaaaaggggtgaagtctggctgtctgcctattggtcacacttgtggaggagaaggggcggctctagttccagcccttatatgttatttagttggcgcagagatttccacattgttttgtttcccccctgtggtagcatataaagggctataaagacatgctgtagaggactttagaaaagttatacatctttgggcccgctctgtcagataagaggttttcttgctctgtctttgtagaaaagaggagagtaataatatgagggccacgagtgtggtgtgcgtctacgctctgtgagtcctcaagcagctttgggagggccacatgacgggcgggagttactgaggtcacagaggactcacatgagtcatcctggcgccacaatggtggaaccctgtttttatctctaaaaaatacccaaatgaggctgggcattggtggggccggtgccctgtagtcccatgtacttgggaggctgaggcagggaaatttttgttaacccacggagacggaagattccaatgagctgagatcgacacccctgcactccagcctggtgacagggcaaaaatccgggttttta

SEQ ID NO: 727443 - DNA, 1162 bp, Homo sapiens
cctctctgctttctgttatttgttctgtatctcggtcgtcttgttctttcttcgtgctctcctgctttgtgggatctgtcgccttgttctctctctttccccgaggggcgcctggttatagtccctttggtggtgtcttcatacagtagctgtgctgcttctgtgagctgacatccacattctctttgcttcgctctctatgtgtttctctcgttcttcttttatgtttcgcatatgtggtagactcgtgaccttctttcctattcgctatggtgttgtctgtataccttctctttgtctggtttcgcttcgggtcttgcccgtcattgtggttctgggaccccttgcctctggtacagtttgatccgtgacatggtaagtgccccaggtccttgttttccgcgccgtacgttgtatcaccgtgtaacggccttggctgcactgcggcaccctggtatatttcggcttgagctgcacggctacatgcacagggcaattgctcaaggacatcagtccaacgacgtgggtccgcggcgcgcccctcgcacaaggtggtcttccgggatccgtactcggtttaagaatctggatcggatgcatgttcattgccagccgagggcattcacacgggccagtttgtgtattgcggcaatgaaggcccagctcaacattgtgctaatgtgctccctgtgggcaccatgcctgtagggtacaatcgtgtgctgcctggtaggagctagcctggtagacacgtggcaagctggactccgggcatcagggaatctatgtcctaccgttatctcccatcaagccctgtagacacaagaagacccgtgtgaatgctgccctccggctccaagaaggttatctcctcagaccatacagagcctgtggattggatgctggctggtctggaggtgcgccgaatttgacagaacccatccttgatagagctggccgggcgtagccaccataatataagagcaaagaggaacctgctggccacgagtacggggtgtggccatgaatcctgtggagcattccttttggacggtggcaaccacccagcatcatcgggcatagcccagtcacaccactctcgcagagatgacccctgctggcacagcaaagtgggtctcatttgctgcccgccaggactgaa

SEQ ID NO: 727444 - DNA, 217 bp, Homo sapiens
tcgccagcatccggaccctcgaattacaacaacgttgctcctgcctgggtcggcagctccacaaccctcaagctaaaacaagacctctcctccctgtgatcaccagcttcctgaccctcgaattacaacaaaattgctcctccctgggtcggcagctccacgaacgtcaacactagaacgagatctcgtccgccgcttctcgacagtttccggtgcc

SEQ ID NO: 727445 - DNA, 167 bp, Homo sapiens
agccagagacattcagaaagcttttagctctatattcgcttggtgctgtgtgagcgaaggacccctctgaatcctgaaacccctcttgcctctcttccacgtaagagggcctgtgccccgtggagcctcagtgcccgtttggcctgctgctctcgctgacaataaag

SEQ ID NO: 727446 - DNA, 487 bp, Homo sapiens
actctgtctctacaaagaataaatttaaaaaaattagctgggcatggtagcatgcccctgtagtcccagctacttgggaggctgagatggaaggagcacttgaactcaggaggtcaaggctgcagtgagctctgtttgcatcactccactccatcctgggcaatacagtgagaccctatctcaaaaaaaacaaaaggaagtatagttcctatagtttctattgactgcatatggcttttgcaccatcataaagttgaaaaattttatgctgaaccattgtaagttggggaccatctgtacattatgtaaatattaattctaaaaatgagtttggagtttattcatttgccttttttgttacccttttaattatctatccaaatattacctgtgtacatataatttctgtgccagatcagggcaaggatgtgaagagcatttattgttctagaagctataaatttttaataaactttttttcactgga

SEQ ID NO: 727447 - DNA, 282 bp, Homo sapiens
  misc_feature (24)..(24): n is a, c, g, or t
  misc_feature (34)..(34): n is a, c, g, or t
  misc_feature (37)..(39): n is a, c, g, or t
  misc_feature (64)..(64): n is a, c, g, or t
  misc_feature (72)..(72): n is a, c, g, or t
  misc_feature (100)..(100): n is a, c, g, or t
  misc_feature (105)..(105): n is a, c, g, or t
  misc_feature (139)..(139): n is a, c, g, or t
  misc_feature (144)..(144): n is a, c, g, or t
  misc_feature (163)..(163): n is a, c, g, or t
  misc_feature (189)..(189): n is a, c, g, or t
  misc_feature (192)..(192): n is a, c, g, or t
  misc_feature (196)..(196): n is a, c, g, or t
  misc_feature (201)..(201): n is a, c, g, or t
  misc_feature (204)..(204): n is a, c, g, or t
  misc_feature (207)..(207): n is a, c, g, or t
  misc_feature (271)..(271): n is a, c, g, or t
taaaatgcaaacaaaaaaaaaaanaaataaaaanaannntttcatggattattcaaggaaattntaaaattngcttctgcctagtacttatacatctggnttgtntgtcttgatcttcagataaatacattctcaaggnatgcnagcgaaactgagcattttnctcatgcttaagacatatggtccaangcnaaanacttnccngcntaaccatttccctcaattttcacagataacaacaacacaaaaacccacattcaaagtacgggtntttgacagtca

SEQ ID NO: 727448 - DNA, 211 bp, Homo sapiens
gtctctcccatgccatggggggctggttgaggtgatatctattatacttgctactctgttctggggttcttggcttggggcctcctggtctgttctggtccccttgctttcccccttcttccctgtctgctgctcgtactgtttgggctcattgtcatccctctcggcctggtttctcgtgcctgcctccggggccctgtgctcattcttt

SEQ ID NO: 727449 - DNA, 189 bp, Homo sapiens
aggcaaagctcctacggagctcaggtgtatttatggggttgcagagcaagctgttaagggcgaatttggtatgactgagctcagagacctggtgggagggcaaggactgccgggcacagcaggaggagattagaggagggtccacccgtgaatctttgcagcaggcacagagctttctggcttgcatct

SEQ ID NO: 727450 - DNA, 500 bp, Homo sapiens
  misc_feature (32)..(32): n is a, c, g, or t
  misc_feature (146)..(146): n is a, c, g, or t
  misc_feature (331)..(332): n is a, c, g, or t
  misc_feature (407)..(407): n is a, c, g, or t
  misc_feature (412)..(412): n is a, c, g, or t
  misc_feature (435)..(435): n is a, c, g, or t
gggatggttaatgggtacaaaaaaaacaaaangaattaaaaagacctactatttgatcacacaacagattgactatagttaataattacttaactgtacctttcaaaataacttaaaaaagcgtaattggccaggcacagtgcctnacacctgtaatcccaacactttgggaggtgaaggcaggaggatcacttgaggccaagagttcaagaccaggctgggcaacatagcaagaccttgtctttacaaaacaaaggtcaggcgtggtgactcatgcctgtaatcccagcatttgggaggctgaggtgagtggatcacctgccaacacggnnaaaccccatctctactgaaatacattagccgggcatcaagggtgcatgcctataagccactcgggaggctgaggnagganaattgcttgaacctggcaagcanaggttgaagtgagcccgagatcgtgccattgcactccagcttttggtaacagagcgacgccatct

SEQ ID NO: 727451 - DNA, 961 bp, Homo sapiens
acagatactgctgtgtgtcttgcttgtcttatttaggtacacatcagcatgttcctgttcatatttatacctggatattgttattcttttttttattttttattggggaagctcagagaggcttcacaccgggcacccgaggcgggagggcaagggcaaaatccgggaatcacgcggatcccgcgggtcaagccggcctcaccggccaccaggagcaagcggggattccgggccattgtggtccaccagcgccggggcaaatagagggaataataagagtagcagaacggggtaatcacaaagtcggagggcacccaaaacccgcgaacatcgagggtgaccccaacacaccacgggcactcccaaaagggcgcgggaactcacacagcggtggtggagacacaccgggccccgaaaccacgaaacctatatacactaccgcgcaaacactctacacactgagctcactcacacactgggcaaacccgggaggaaataatgggcgtgacctaaccactaaaaccccaacgcaggagacactgtgaacaaataaaaccacaggatgaagggaggtccaagagaatagagccataccaacgatacgtgaaaacacaaaaaatacatagcacagaaacaaaaggacacacacgggggatcacacaaactgtacacttacccataagggcgcaaatggtgaaaaccaattatagcccaagggctaagaatacagcatcatcgatagcaccgtcaagacgaaagaggggcaaaaaactccacgcgaacaacgcgtacaacaacccacaacaagtgagggaaccaccacccagtgggagcagatataaaatcacacatcccaagcgcacccaagacatacaagagagagcaagacgaccggggataaccacggagggcaacattgcgggcaacgcccgtacgacggacggacaactaacacaaaagg

SEQ ID NO: 727452 - DNA, 1197 bp, Homo sapiens
  misc_feature (32)..(32): n is a, c, g, or t
  misc_feature (161)..(161): n is a, c, g, or t
  misc_feature (167)..(167): n is a, c, g, or t
  misc_feature (974)..(974): n is a, c, g, or t
  misc_feature (981)..(981): n is a, c, g, or t
  misc_feature (1018)..(1018): n is a, c, g, or t
  misc_feature (1060)..(1060): n is a, c, g, or t
  misc_feature (1083)..(1083): n is a, c, g, or t
  misc_feature (1197)..(1197): n is a, c, g, or t
atctttgtgtttgggtgtagatgtccacagcncccgagagccgctgctcgagagaacacaacacacaaccaagacaaaccgctcctccttctccaatgggcggacgcgatgtgcgggcacgcggaccgagcgtggacatccgaacacacagctgcgtcctntcgtcnatctacacctgtcttatgtagttatttgcgagtgatggcactctctgaacattcttgaccactactatatatgtagcgcacgcttcacttgtgacacacccacgcatctccactccttactctagacatgaagtatacactgcaagagaaggcaccacgactgtgtcctcccacactcccaccccacactccctctctccgccccccaccccgcggtaaccgcgcgccgacgagcctacgcaaaataagaaagataacaagcttttgtttatcagttttgagggagcagactgacgattgagcgggcgcgacgcgggatatcgaggactctgccaccactctccccgcccgccaccacaacccgacgaaacgagtggggtgacgacagactcgccaacccgtatccgttcactataataatcagactcgtgtatattgtgagaaggaaggggggtgtagatgatccgtgcagtcacctcagactcaactaattcacccaatttatatattgcgcagacatttgcgcgtagacacgatgtccctgtgccatgtgtacataattctcataactaagacagaccacacatctgcctaattcccaaacaccgcacatgacgactgcactatgtccgccgcgccaggacgtagtacacatgtatgtcacgtgtgttcgcgtagaccgtcgccacgtgatagagacgagcggaatgcaagacgaacagcaaagagagaattaaatacgaataacgacagagtgataatagatgactatgaacaaacagcactatagagaaacgatataacagnagaatanataggagtaatcgtcgagcgagtgttgagagtagcgncgtagatatctacttcgtagcgtattatactatacaatgccntgtgaagtgaatacaaagtctanattatgtactacattcactatacctatgtacactcagctatattaacacacgtgacagagagccgcacggcagggcgcggaggtcgtaagacgcgatagtcgcagcacagcagn

SEQ ID NO: 727453 - DNA, 713 bp, Homo sapiens
ccttgcggtctcaactcttgtatagccaacggttaaaaatggtcgacataaaaaaaaagacattttgattaattaatactgctctttgggctgtaataaataaaacagtatattaactaaggaatgcacgtttaccacgccacaatgtatcttcaaagaattaatcgaagaaaacattatatactggccactagttcacagtgtacgcagaccaataagctaggtccaagttacagaccttgtaaacaacatgtggagctgccgtccctgtctccgctccccgttcacggaagatatagtatcacagttccaagagtcctcttggctgaacatgctctcaaccagagaggaatttaacgaatcaatgcaccgtttctgcaaagattgtctagaaaaaccttttaaaacaggtatctcaaggaaaactgcattctggttcactcttggattgtccagagtcaagaactgtatgccttagcctgttctggttccaccccagtccagcaggccacaggggaattgtttgcgtaccaccacatgtccatctgcttcaacatactctagatcattcttttggcttccctgtagatctcacagtggacaagaggagcccatagggtcattcgaaaagtcttcagtaacatcttgaagagcatgtcaggctatccattcgattttgatctgatgacgcagaatagagagtgtagctgaat

SEQ ID NO: 727454 - DNA, 123 bp, Homo sapiens
taccattgcacgctcggtatgtgcaaataaaaaaaagtagtggtgtacttcagaagctggatacatgctatatgatgaccttggcatttctggccatttcaccatcatttacaaccaaggctt

SEQ ID NO: 727455 - DNA, 356 bp, Homo sapiens
aatagcggggattactgggagtgtagcagcatacctggctaatcagaaccgtattgcgggaagagagggggttgcagcatgtgggccaggcgtggtcttgaactcctggactcaggtgatcttgcttgctcaagctcccaaagttgcttggcatcatagtgtgtgagccactgtgcttggcctccctcacccatttttcatacctccaagcttggtgtagacttgtccccataaccggtggctgtcgggagtgaattctgccccccggttctgatgttggagagccagtgattcctgccagggcttcaccttgatgctgagtctctcaggctgtgccataagttggcacggggatc

SEQ ID NO: 727456 - DNA, 162 bp, Homo sapiens
  misc_feature (20)..(20): n is a, c, g, or t
catttcattttttaatcttngaagcttatttaggctttgaacaaagttattcttaaaaattcaagatcatattttcaatgtaatgacatctgtttattggcattgaaaaaatagcatttttttaaacttttattttaagttcaggggtacatgggcaggatc

SEQ ID NO: 727457 - DNA, 396 bp, Homo sapiens
tcggtagaattctaattgggggcgcctgggccactatgaagaagttcctcatcacaggcgctggggtgtggataatttcagaggcccttcttgggatgtcacccttcaggtcctcttgagccattcttgtgtttctcctccactttctgaaatgtctctaaaaacctctccggcatcttgacataaagtccactctgttttatgcggttgatgagttcccgagctttgtcctacagtgtgttaccaacctctttcagcttatccaagacactgaattcgtctgggtgtcccgtggcctggggctggacctttcaaccgtatcgacaataccccccacaggagcgagatctacagagagagcctcatggagagaccggaggggcactttgactctct

SEQ ID NO: 727458 - DNA, 415 bp, Homo sapiens
  misc_feature (392)..(392): n is a, c, g, or t
  misc_feature (399)..(401): n is a, c, g, or t
taattattttgcttatgagagcaaatgaatgcccaaatagggaaaatgttggctagacaacagagtggtaaattaaagagaaaaccatgttttaaattatctttcaaattttattaattttctaattgttattttctttaagtggtctacccattatctttctttttttttcagcataaatgtgagcctccctttctgcaaatttgttaggattggaaatgggggtggggcgtgaggggggaagttgtactttggtggcaaggactgcttagcacttttttaggaccaaagcccacagtcaggcttcacatttctcagtttccaggtgtgtgaatttctaatactgtgttgtcaaatgagcactaatttgtatgcatttctaaaaataaaanaaaattnnntttaaaaaattaaa

SEQ ID NO: 727459 - DNA, 414 bp, Homo sapiens
  misc_feature (13)..(13): n is a, c, g, or t
  misc_feature (26)..(26): n is a, c, g, or t
  misc_feature (101)..(101): n is a, c, g, or t
  misc_feature (403)..(404): n is a, c, g, or t
  misc_feature (407)..(408): n is a, c, g, or t
aagcaatatacgnccctcccttcctnctcctaaagtgctgtggcctggtggcccttaaaaatatagattttctttcttttcccaataaagaaaaattaagncccaggcgcagtggctcacacctgtaatccccagcactttgggagatcaaggtgggtggatcacaaggtcaggagttcgagaccagcctggccaaaatggtgaaaccccgtctctactaaaatacgaaaattagctggacatggtggtgtgcgcctataatcccagctactcaggaggctgaggcaggagaattgcttgaacccaggaggtggaggttgcagtgagctgagatcacgccactgcactccagcctgggtgacagagtgagactctgtctcaaaaaaaagaaaaagtaaaattnngtnntttaaa

SEQ ID NO: 727460 - DNA, 102 bp, Homo sapiens
gaagatggtgcttaaccattggtgaatgagccaccccacaacacacctccaccacctattgtttccagacagaagcctgctgcatgatagagaggtgttggg

SEQ ID NO: 727461 - DNA, 132 bp, Homo sapiens
tgataaagcacaagatgctcttcaccgactaccaaaaatccgagcagcagaggcaaccccagagtactgactgatgacaaactaattccgtgatcggattcctttgctttaagtatattgacggcgagagca

SEQ ID NO: 727462 - DNA, 80 bp, Homo sapiens
tgtgtgctctcctggccctgaatggtgcactccagtgcccaccagccttgtcctaaataaaattaatgttgtatcatttg

SEQ ID NO: 727463 - DNA, 108 bp, Homo sapiens
caaaaaaaccccccccctgttttttcaaaaaaaaaggggggggatatgggtttccaaaaaggctgattccggggtcgaggggggggataataaaaaatttccttttta

SEQ ID NO: 727464 - DNA, 177 bp, Homo sapiens
caacggttttgtccacatatcagaggctaacgggcactgagggctactgttctctctttcattacctaagaccctcagttaagaagggacaggcaggcttggagttcccattgcagcccagtgtaaatgaatccaactagaatccatgaggatgctggttctatccatgatgagagt

SEQ ID NO: 727465 - DNA, 1171 bp, Homo sapiens
caggaccgggtctggacttgtgtcttcccccgtaaggaaatggccggggagctccagtggacccagtgcgccgtcgcttcgtgctgtgagcctggtgctgaccagccaggacagctggtggtaaaccctgaacaattctgctgctgagtgtatgggagtgccatgtgctgtcctgtgcagtcaactgtgcatctcctggggtgaatgtctgtgcttggtgatggcctacgtggagcctggtgtttgtacttgctatttatttattgtgaagatggcaaatcatgcgctttgcaatgaaatctcgaaggggacctcatgtccctgtgggacacaattgcccccaaggacttgaaagaggagattgatattcgactctccagggttcaggatatcaagtatgagccccagcatccttgcagatgatgatgctagactactacaactggaaagccagggaaatcaaagttgctacaactatctgtataggatgaaagctctggatgccattcgtaacctcatgagatcccatttcattctgaaggccggatccccgtaccttaatgggcaagaatatactgctcctaccttgctggatctgcgaaacactagtacgccttacaagggtgtacgcaaagcacctcattgatacccttttggatggatctgaaaccagccgctatgggacaggcgtccaagggaccacaatgaagtacctaacgcaatcaggcaggccatgagtgagcatggcaaagcgggtaacagcagaaatagggagacaaacagaaatcacagaacagaagccaaagacaagcaaaacccctgaggacccacaagagacgacaggtacatacatctccctcacacagaaagcagttaaggtgcaggccaatcttgaattgaaagcacaggtcattataacatatgaaagaaagtgagagtaatgaatgaaattgaagtaaataaaacacaaagataaagtgtgaaagaatggtatgagacgacaaggaattgtgagggtgtcaaggatgaataaggagttagtagcaatagatgatatgaacatcagcataagagtagaggaaataaggcaaataaaaaagaaataggtaaagtcagtgtatctgtgataagtaggttagcttgttggtgtttcttgaataagagtgagtga

SEQ ID NO: 727466 - DNA, 439 bp, Homo sapiens
gataaaaggacagcgacagtaagacagagcgtagggtacaacaaagggcaaataatcgtaggcacgagcccctaaagagaccgataggagacacaagtggtgatcagtgacagcattagcgacgtaacagagacaatgtatgcggcagcatagctcacagcggagaagatagctatggggccacagggggcgcatgtacatgtagatcgaatcgaccatcgggaggcggcacgcacacaggtaggagaacaggcgaacggagacaaaagaacacagctccagagaacaaccgcgcaggacggaatctctgtatctctctctctctctctctctctctctctctctctctctctctctctctctctctctctctctctctctctctctctctctctctctctctctctctctctctctctctctctctctctctctctct

SEQ ID NO: 727467 - DNA, 862 bp, Homo sapiens
gaaattggtgcacagaagaatgtgggcgcgaccacggtggcatgggggggccaattagagcgggcgtccgacagataagtgtgcccacacccccaaagaggggcgggaattgccaggaaaggtgtgccaccgagaggagttacaaaaggtcatggggcgaaccataaaaccaacaaggaagggttggcgcaccaacaggtcaaaccccgatagggcctgcaccccacggggcggataaagggcagccaagatggagccgcgtgcacctgataagtggtagggcgcccactccgggtgccgctgcttgacggccccagcgcgtttcaaggaccccgccgtttttttttccggagagatgtaaggccctgccccggagacgagttacacagatgtgggagggcgcggaagagacatgggttgtaatgtatgctcaaaataggaagcccccccggcgagatcttctgcgcgcggtggaaatagaacgaggcgacgatgagctcccgtgcgcggttggcaactcacggggtccacactctaacatcgcccccgagtaattggagggtgctggctaattctttttgcgcgccctctgtgtttaatcggcgaaaacaggcggggcccgagccctctgggctcgcagccctcgtcttatgagtactacaggtccccttcacaggcggaactaaggggcagggcaggtcgtattgatctcccccccttctatgccatgagtggatatttcttctaggcggatagagcccccgatcagttcgagaaccccgcaacatctttggtgtcccccacattgtctcgtcaaagcgacagaggggccccaaacaaagttgaatttctggcacaacag

SEQ ID NO: 727468 - DNA, 631 bp, Homo sapiens
  misc_feature (519)..(519): n is a, c, g, or t
gaaacttcgttgtgatgtgtgcattcaactcccagagttgaacctctcttttgatagagcagttctgaaacaatcattttgtggtatctggaagtggacgtttggagcgattcggggccgatggtgaaaaaggcaatatcttcacctaaaaactagacagaagaattctcagaaactgctttttgatatgtgtagtcaactcacggagttgaaactttgttttgatgcagcagttttgaaacactctttttgttagaatcttcaagtggatatttggatagctttgaggctttcattggaaacgggaatatctacacataagaactagacagaagcattctcagaaagttctttatgaagttcgcattcaactcacagagttgtaccttccttttcacactgtagttttgaggcattctttttgaagaatctgcaagtggacatttggagtgatttgagacatagggtgaaaaaggaatatcttccgatagtagacagaagcattctcagatacgactntctgatttggtactcaactcacagagttaaacctttcctttgatacagcagttaggcactcttcttgtagaatttacaagcggatattaggacagcagtgaggatttctcgg

SEQ ID NO: 727469 - DNA, 279 bp, Homo sapiens
  misc_feature (271)..(271): n is a, c, g, or t
ttctcgtacatgttagattattggatcaatttgacgtatagtagttcgctttgactggatcgaagtcttaacaatgatactcgctctgtgagagttgggttctgctccgaggtcgccccaaccgaaattcttaatgcacgtttggtcacttaaggacctgtgggtttgttatggtactcgtctgcattaactaaattaaagctccatacggtcttctcgtctagctgtgtcttgcccgcctcttcacgtggccggtcaattccactggttnacacgttt

SEQ ID NO: 727470 - DNA, 1012 bp, Homo sapiens
gtgaaaccccggtctctactaaaatacaaaaatttagccgggcgtagtggcatgcacctgtagtcccagctacttgggaagctgaggaaggagaattgcttgaacccggcgggcagaggttgcagtaagcagagatcgtgccactgcactccagcttgggcaacaaagtgagactccatcacagaataaaaaaaagaaacatgttataccttaacctatagcctggaaatcccgtgctctgagtgtgctccatctttctgaaccaaaccaatgttatttcttacacgtatttcacttgatgtctcatgcctccctaaaatgtataaaaccaagctgtgccccgaacaccttgggcacatgtactcaggacctcctgagggccagagtcacagggtcaataatcactcactatccggctcagaataaatctcttcaaacacattttacagagttgactcttagtcaaccatgtccatacctgatgagatgcttcatcacaaattctagtggactggctagttccagaacaatggacacagccaggtttgcttaaattgacacccctgacacaaggtatctcactcctgcattggaggccggataggatcaggagaccctgtcccataaactaatgtactccatgtcataaacgcctctcaacgcacaagttcacgatatagacataagacaacacgtctcaagacctgacaaccacagaggcaggagatgcaaaaggcgggaaaccatgggcacagacgaaaaacgaccgacatccccagcggcaaacgaacgatgcacgggcccacagcagaccacaaagacccagtgcggaacaacacaggagagcagaacccacaagatgcccctggcaaagatagagcgggcgcacaaggtcaaagacgcaggcacccaccgcgaatagcgccaacacaggacccaaaaccgcgaaacccacccgagccaaagcaagcccaccgcacagagcgagaatacacggacaggaaaaaccaca

SEQ ID NO: 727471 - DNA, 407 bp, Homo sapiens
tccataatgtgtgcccagactggagggcagtggcgtggtctcggctcactgcaacctccacctcccaggctcaagcgattttcctgcctcagcctcccaagtagctaggattacaggcatgtgccaccacacccagccaatttttgtatttttagtagagagagggtttcactatgttggcctgacctcgaactcctgacctcgtgatccgcccgcctcggcctcccaaagtgctgggattacaggcgtgagccactgcacccaggctttttttttttttttttacaaatgggtttcaccagtgtagtcaggctggtctcaccctcctgacctttggtgatcagcctgcctccgtttcccatagtgctgggattggggcacactttatggaggggtcaccgagctcg

SEQ ID NO: 727472 - DNA, 242 bp, Homo sapiens
atgctgaggtgatctagaggatccgcagggtggtgaatataggatctataatttacatagtaggaaagtgttactttagccccgcttttttaaaaaaaagcaagattacaatttctgtatatatttcaagatgaatcattgtaatgtgacgtgaggctcagattagtgtgttaccgataatgtattaactagaagacaaaagaggacagcacataacattttccactctaccagcaaaaggg

SEQ ID NO: 727473 - DNA, 134 bp, Homo sapiens
tgggcatatgcagggcttctggaacaattaggggcagctgaaaccatttgggagtctcaggcattggcttgctcttcccatgatggctcgtactctccactaggaacagattcttgcgtgggtatggctcagca

SEQ ID NO: 727474 - DNA, 634 bp, Homo sapiens
agagtgacaacctgtctttaaaaaaaaagaaaagaaaaaaaagttattgtgtaagaatagccaaaaggggaaaaaatagatgttagtgaaaaaggtactagatattaaagcacattttgaagcttcaataatttgttctacagaagaagcaaatcagtagataaaatacagaatccaaaaatagacctaagcatgggaatttagctgtagtagcattgcacatcacaaagggaaagcatgtttgggaagatatcacttagatctctgcctagcaaaaaacatttagattgatgaagaattgttaaaaaaaaaaaaacccagaaccctaaaaacaaaagaaaacgtcaataagaaagcatgaattaatttatgtttttgttgtgatactttctttttaaacagataaaaaatccagatgccatagaggaaaaaagtgggtacatatatttaaaattctgagtggaaaaatgttattgtaatcaaagtcaaaagacagatgacaaaccgaggacaaaatatttttaccacaaatggaaaattttcttgattgacaaagacctttgtaattgagaatgaaacctactaatagtctaattctaacaagacaaaggatttgaataggcattttgcaaaa

SEQ ID NO: 727475 - DNA, 312 bp, Homo sapiens
acagggagactttcacaatgtccggagcccttgatgtcctgcgacaataaggaggaggatgtccttaagttccgttgctgtaggaacccacttaggtgcaccaatcttgacttccagatggaacagtacatctataaaaggaaaagtgatggcatctatatcataaatctcaagaggacctgggagaagcttctggtggcagctcgtgcaattgttgccattgaaaaccctgtctgatgtcagtgttatatcctccaggaatactggccagagggctgtgctgaagtttgctgctgccactggagccactcc

SEQ ID NO: 727476 - DNA, 112 bp, Homo sapiens
ctgacttcgaaaggctgctgttgtgatggccgatccctattgtgtggctttgtcgagttattgcagatgcccagaatctacgtgaactgaccctactggagtaggaataggt

SEQ ID NO: 727477 - DNA, 1197 bp, Homo sapiens
ttcaacatcttgataaaaggagtttgcctgagaatggagactataatcccagatccctgagggctaggagagctgggtgggggcgctgacacttctgtgtgccctggtagagtagccaccctgagaaaaaactgataataaagtgacgagctgtaaatgatggctatggggaaaacaactatttcagagatttttctcattgctttgcaaagcgacctaccctgagcagtatgggactcctccggatcatttttgacatttgaatgttctttcctgacccttggaaaggatatatgtatgtctttcaaatttatagtatcgaacatacaatttgggggctggtaccaagggttagatattaagtttattaagtgcttgatgcaaaagtcaaaggatggcatgggaggtacctggttggctgtgataagtaaactcgtggattttgaagggggagcagtttctggtttgggtcgcagtggccaagtaagacccaccctcctcagacactatcaagaccaagtccactggcttttcatccgtgttttcatccagtaaccaaataaccctgtccttgctgacccccacccagctccattcccactcacccactcccaagggccctctggtgaaccttccaggctagctctctgctccctccttgccttcatggaaaaccagctatcctctgagagccacttctgcagcccctccaagtggtggcttttcttctcaaacctcaacctcacatatctcatcttccccaggctggggagtcggggtcctcgtaccactgccagactgttcacccagttcaaagaaaaccctgcccgttgcaggctcatgccattctactacatccctttcatccaattctttgtgttctactgacttccccagcgcttcctttgggagaaggtgccattcttcaatagttgattcctctctagaaatacaatgttcctgccaggtgcggtggttcatgcctgtgattccagcactttgggaggccaaggctggtagatcacctgagtttgagaccagcctggccaacatggtgaaccccgtctcttactaggttccagattgtgggtggggggttgcctttccccgtttcggggctggggaaaatcttacccgggggggtttagccgtacgcctgtagcggggttgccaaaaagggggcaatatcgggggtga

SEQ ID NO: 727478 - DNA, 462 bp, Homo sapiens
cagttgattcatctgttgatgacacagcacacaggagccaggagtgagtcacatcatagacttcacctacatctcattggaatgttcatatgtatagctggcaggacagactagacaggaaggccagtccatggttagcctcatataatcaggatcgggtacagcgaccgcaccctccaagggatggccacggggactgttatgcgcgagctgagcatctgtactggttagcggtaagcatggttaaccacatctctgaccgttcagcaggtgtgagtgggcacttatataagcatcccaggtacagcagcactgtttagtagtcgactctagtcgacgggaggtataaaatagtacaagggcaggcagcactttctcctccaccccgcagcaatcagctacaagatgtctgccttgtcgcaataaaggatttgcactagccctgcatctcgggcctcctag

SEQ ID NO: 727479 - DNA, 204 bp, Homo sapiens
ataataccatttttcaaaattaacaatagagctcaatatgtaaaatgactcgttactcatgttagggtaaaaagacagaccagtggaaatgagtagaaagtccaaaatcagacctatacgtatacattcaccagatttgtgacaagcgtgccactatagtgcagcaaagaataaatggcctaatagccttatgaaaaaaaaaaa

SEQ ID NO: 727480 - DNA, 834 bp, Homo sapiens
gcgcagacgcagagcttcgctcgtactcggtgcgccgtcgcttggcttgttcctccgcaaccatgtctggacaaacccgatatggctgagatcgagaagattcgagtaagatcgaaactgaagataggacagagacgcaagagaaaaatccactgccttccaacagaaacgagtggaggcaggagaagcagagacaggcgaagtcgtaatgaggcgtgcgcgcgtcaagtagtgcactgtgacatgtccacaagcagttgccttctgtattttacttctgttagctgtttaacttggtaggatgcaaagaggttggatgaagtttaaatgacttgtgctgccgcttgcacgatcaagagaacttactgacaaacgaaggccgtgcctgactttcccatctgtctatcgtatctggctggcgagggaaggaaagaacttgcatgttggtgaaggaagaagtggggtggaagaaggggggtgggacgagagtgaaatctagagtaaaatgaagctggaccaaggtgttcatgcaggctgttattgcagttttaatcagaggtgccatttctatgttatgattgttcaaagtgatgataagttactggaatggcccaattttttttactatggctacagtgggaagatattcacagacataggtagaaatattgtggggccacgcattgggtcagaaaaagtattggaaaacagatttggttagggggcgggcgcccagaggatagggataaaggggaattggcggcacctgagagaacctgggcttgaaaaggggggggtttgcacaaaaaaaaacagcggggggtaaagagggta

SEQ ID NO: 727481 - DNA, 669 bp, Homo sapiens
ggcagaaagccgcggcgggggggcaaaaagcagcggaggcaaaaaacccgcggcggcgggccagcaaaaagttggcatccgcgggaagcccaaaatagtggaactggggtagaagaccagcacatgtctgtgggcattccctgtggagtgtgattgtcggccaccgggacaccccgttgcaggcgggcaaggaccaaacccacaagattgagcatacattttagggggcaaaccccgaaagaaggctttaaaacccaaaaggttacgaactactcctaactcgtaggaattcggacttagaattacaattctccatttatcatttggaccggggattacccttttcgtggccaaatgttgtgtgagttaccaacccttagtgggttgttggttgggcagaagacacctttgttggtccccaccttgaaatgggcaggattcacaggaattattcccttttctcaattttgctggcaaaagtggcctcaaagttgtgggttcacacggcgaacagggacgcggaagcacaggcaagggaacttggcattccattccaggttcattacgaggaccagaagtggagtgctttgttgggcccaggcccttcttacctttgacatataaacccaaggttcaattgtcttcaagtggataccttctactacttaa

SEQ ID NO: 727482 - DNA, 387 bp, Homo sapiens
caggaattcggcacgaggcaagacagaggcttcagaacccaaaaagtggacgggaacccagtttggccagtgggatactgccggctttgaaaatgaagaacagaagctaaaattcctgaagcttatgggtggctttaagcatctgtccccgtcattcagccgccctcccagcatgactatcaggtccaacatggccctggacaaaaagtcttcagaaatgctccagcagagtctgcagcaggactatgaccgggccatgagctggaagtacagccacggggctggcctgggctttaactctgaggcccgaaaggtcttctacattgaccggaatgcctccaagtctatcaagttgcaagattaaatattattgtcttgttcttcaaa

SEQ ID NO: 727483 - DNA, 319 bp, Homo sapiens
ttggagtggttctggtcagagggctctaagctggtgcagccttgtggttgggctggtgtcctggaggctggccctggccatgcccagagggttgtaccagggccacggagagccagtattcacagccctctacctagtaggccacctgggggatcccatctcactgccaggagcagcacccttgggcctctcagagtgggcttcgccctagccagatgcccctcctcgatatctgccagacaaagggggctgggccacttgctgagaaagggagctgggagagccactggtcctcggccacctgaggggcttggccaga

SEQ ID NO: 727484 - DNA, 134 bp, Homo sapiens
ctactggtggtgatagcatagcttcgtgtaattatgtagatgcaagatttttttaatcttcgccttaatacttttttatgttgttttattttgaatgatgagccttcgtgcccccccttccatcaccaccaggt

SEQ ID NO: 727485 - DNA, 147 bp, Homo sapiens
tattaatctgagcgaggagctgtggtagttggtgatcccaagaacgaaccaacagaccagtgcatcagcacaacagaccggggttttccacgagcccgctacctgcgcccggaccaccaactacaacagctcctcgctcgatcttac

SEQ ID NO: 727486 - DNA, 988 bp, Homo sapiens
ggagaggcccggtcgcggtgcgggggatggtgcgatcccgggcccgagggcatcagacggcggctgattagctccggtttgcatcacccggaccgggggattagctccggtttgcatcacccggaccgggggattagctccggtttgcatcacccggaccgggggattagctccggtttgcatcacccggaccgggggattagctccggtttgcatcacccggaccgggggccgggcgcgcacagagactcgcagcggaagtggaggcggctccggcgcgtcgctgctaggacccgggcagggctggagctgggctgggatcccgagctcggcagcagccgcagcgggccggcccacctgctggtgccctggaggctctgagccccggggcgcccgggcccacgcggaacgacggggcgagatgcgagccacccctcatggctgctcctgcgggttccctgtccaggaagaagcggttggagttggatgacaacttagataccgagcgtcccgtccagaaacgagctcgaagtgggcccagcccagagtgaccccctgctgttgccctgagcccacctatgctccagatcgtgcaactgctgtggcactgctcccgtcttgggcctatgtctcctggagccgaaggagggcgggtgggctaccaggcctggactgccttaaaagggactggagtataccttgcaaggtgtaccccgtccagggaagcctgacacggctggaagcatattggcggggtggccccgacaagcatgttggtcggccaattgaagtctggtgggaccagtcctctaaggcttatcatcggccctggggaattggcagcttgtgggagcgaccgatacctgagcagaggtggagggctcgatagccgctgacagctaaaacagtccggctcgagcacacgatgttcacacaaagtgggcacagactacagcgccggcgagggaggaacacaaaggaggagccc

SEQ ID NO: 727487 - DNA, 278 bp, Homo sapiens
aatcgagctcggacccctcataatgtgtgcccatggataccactaaccggatcaatgtttatcttaatacacgtattgtcccttgcgccatacagcatgtaatgccacagggctgccgcaaggcactcacaccagctgtctacccatgcacccaggtaaggcgagctgcaatgcctccgtcctctagacggcaggaatgaagccgatctgcatgtaacacagtctgtttaagcatgcacccaggtacggatatctgtggtgcaatagctaagaagcca

SEQ ID NO: 727488 - DNA, 456 bp, Homo sapiens
tgcggggctgagtgcgacagcaccaaaaagccagtgggcgcatgttgtgctggccaagtcagaggctgatgcacacagtgccctcttctccccagtgaccagtgctcctgtaccaacctggtgcactgcccatgagtgatggcattggtcctggatgctgttcttgtctactgcttgtgacaaccttcgcaacagatttctttcagtgacagtctcacaaggctagctcaacatatggtagagtccagggctgaggtctccaggaagagcagtccattgtaatcagcagaacattcgggcctcctcagtgggcacttccctgggcctggctgaggtcacttttgttacccacgagcatgacgacgatcgtggcttcagcatggtcatagagctccttcagccatcgctccaccacagcataggtctggtgcttggttaggtcaaacaccaggaggg

SEQ ID NO: 727489 - DNA, 427 bp, Homo sapiens
acctacgcatgatataccatggactaacccctataccttctgcataatgaattaacctagaaatactttgcaaggagagccaacagcagagatccccgataaccacgactgagctacctatgaacagctataatagcacacccgtctatttcgcataatagtgcgaagatttataggtagagtgcgacaaacctaccgagcctggttagttcctggcttctctctatataatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaag

SEQ ID NO: 727490 - DNA, 801 bp, Homo sapiens
ggttctccgccgtttatgtggccccgacaggccggggttactgtggcgaccacgagagcagtttggcgctatggaggagcccgggctacccctcaaccgtatttggggctgctcctggaggagctacgcagggttgtggcagcaactgcctgaaggtatgagaccagattctaatctttatggttttccatgggaattggtgatatgtgcagctgtagtggatttttgctgtctcttttttttgtggagaagtatagatcggttaggagtcggcttatgtgggaccgagagaaaaacgcttgcttctaagtgctttctggactaattgacgacacaagacgtaaactacttgacaaatttagcctgttccaaaaagagtatgacaggctatgaacgtagagtcatctttacaaggatgccagcttgtgagaaggaggcaacagaagcacaaagtttggaggcacctgtgaaaagctgaacaggtccattctgaaccttgagggatgaaattactctgtctagaacacagagtgcaccagacagagaaatccaaacatttctgaacaagaatgaacttggatggggattatttccaacagaggatacggtctcttagaagaatgagtcaaaatccctccaatttaccagtagctgaagccaaaatgaccttcaagattttccacattgattgaaggcagcggattcctaattcttaaagtggtatcctttaaaatataccccggaaatggaccattcccagtataccattcgaatcccattatacacaaaggggagccgaac

SEQ ID NO: 727491 - DNA, 946 bp, Homo sapiens
  misc_feature (31)..(31): n is a, c, g, or t
  misc_feature (96)..(96): n is a, c, g, or t
  misc_feature (194)..(194): n is a, c, g, or t
  misc_feature (197)..(197): n is a, c, g, or t
  misc_feature (226)..(226): n is a, c, g, or t
  misc_feature (266)..(267): n is a, c, g, or t
  misc_feature (311)..(311): n is a, c, g, or t
  misc_feature (313)..(313): n is a, c, g, or t
  misc_feature (323)..(323): n is a, c, g, or t
  misc_feature (343)..(343): n is a, c, g, or t
  misc_feature (352)..(352): n is a, c, g, or t
  misc_feature (361)..(362): n is a, c, g, or t
  misc_feature (366)..(366): n is a, c, g, or t
  misc_feature (372)..(372): n is a, c, g, or t
  misc_feature (379)..(379): n is a, c, g, or t
  misc_feature (386)..(386): n is a, c, g, or t
  misc_feature (426)..(426): n is a, c, g, or t
  misc_feature (451)..(451): n is a, c, g, or t
  misc_feature (545)..(545): n is a, c, g, or t
  misc_feature (564)..(564): n is a, c, g, or t
  misc_feature (595)..(595): n is a, c, g, or t
  misc_feature (676)..(676): n is a, c, g, or t
  misc_feature (684)..(684): n is a, c, g, or t
  misc_feature (754)..(754): n is a, c, g, or t
  misc_feature (760)..(760): n is a, c, g, or t
  misc_feature (853)..(853): n is a, c, g, or t
  misc_feature (861)..(861): n is a, c, g, or t
aaagggtgaaaaaccaataacccccaaatanaaccacatgacatacaaacaaaacaaatacaaaaaggtttgaaaaaaaagtgtgctgaggaatgntcccgaaaagacaagggaatgaggagtcaaagctacgtactctatccagttgttgctgttctttccaagtgcaaaagacggtggtgaggtagcgaccngcngcctccaccaccgtgttctggctctgggncgcaaatactacttttgtatcagattattcatcagggggnnatgaaaatgtcctttatgcgtgtgcgcttttggggcattttggngngtcttcaganggtttaagtttagtgtctcngcagtttcngctacttannctcnttttangcatctntcatttnaatttggtttggctcagttatttgcctgctgatgtttaantcaagctgtcctcttagggaaaagngagagccaagtttaccttcccctccttgcccttccccacagtgttagagatgtctgcgcccagagctgaaccttgttatgtcattacgtttctnaataaatgtaataaatgtnctaaccactcccaaccccaacccccagtgtngagtgccctaagagtaaaagaactgtgatgaggacaatctggtatccaaattcattcaagtgtgttactgagctgtttagnaacaacanatgttgcaatcaccctcaaaacgcaagctgcacctctggggaggaagccctggtacagcaacatcaagtnggcaangatcaggagctgacctgtggcgacatcattaacccttccctaagctatgccaatgcagaaccctcttgctctttttaattgctcctgtcagtnaaagccanaagttgttagcaccccaaaccccagggtgtttcattatttccattagttatcttacaagaagaaaatgactggaaagcaattttt

SEQ ID NO: 727492 - DNA, 889 bp, Homo sapiens
  misc_feature (329)..(330): n is a, c, g, or t
  misc_feature (372)..(372): n is a, c, g, or t
  misc_feature (388)..(388): n is a, c, g, or t
cttaccaacaaaacactcctgaggagaaagaaagagagggagggagagaaaaagagagagagagaaacaaaaaaccaaagagagagaaaaaatgaattcatctaaatcatctgaaacacaatgcacagagagaggatgcttctcttcccaaatgttcttatggactgttgctgggatccccatcctatttctcagtgcctgtttcatcaccagatgtgttgtgacatttcgcatctttcaaacctgtgatgagaaaaagtttcagctacctgagaatttcacagagctctcctgctacaattatggatcaggttcagtcaagaattgtnntccattgaactgggaatattttcaatccagctgctacttctnttctactgacaccatntcctgggcgttaagtttaaagaactgctcagccatgggggctcacctggtggttatcaactcacaggaggagcaggaattcctttcctacaagaaacctaaaatgagagagttttttattggactgtcagaccaggttgtcgagggtcagtggcaatgggtggacggcacacctttgacaaagtctctgagcttctgggatgtaggggagcccaacaacatagctacctggaggactgtgccaccatgagagactcttcaaaccaaggcaaaatgggaatgatgtaacctgtgtcctcaattatttcggattcgtgacatggttgcgataaatccttggaaccaagggaaatctctctagaaacagacgcgcactccaatggtgtaggcaggcaaagccagaaatgggcacaaccccggcccaagagaaattgggcgcgaatcaaggattcaaagattggactcgattacttaaacaacgtgtttcacgacaaaaaagggg

SEQ ID NO: 727493 - DNA, 869 bp, Homo sapiens
  misc_feature (45)..(45): n is a, c, g, or t
  misc_feature (108)..(108): n is a, c, g, or t
  misc_feature (118)..(118): n is a, c, g, or t
  misc_feature (141)..(141): n is a, c, g, or t
  misc_feature (148)..(148): n is a, c, g, or t
  misc_feature (241)..(241): n is a, c, g, or t
  misc_feature (254)..(254): n is a, c, g, or t
  misc_feature (262)..(262): n is a, c, g, or t
  misc_feature (325)..(325): n is a, c, g, or t
  misc_feature (350)..(350): n is a, c, g, or t
  misc_feature (390)..(390): n is a, c, g, or t
  misc_feature (429)..(429): n is a, c, g, or t
  misc_feature (475)..(475): n is a, c, g, or t
  misc_feature (481)..(481): n is a, c, g, or t
  misc_feature (556)..(556): n is a, c, g, or t
  misc_feature (618)..(618): n is a, c, g, or t
  misc_feature (624)..(624): n is a, c, g, or t
  misc_feature (725)..(725): n is a, c, g, or t
  misc_feature (738)..(739): n is a, c, g, or t
  misc_feature (748)..(748): n is a, c, g, or t
  misc_feature (756)..(756): n is a, c, g, or t
  misc_feature (760)..(760): n is a, c, g, or t
  misc_feature (770)..(770): n is a, c, g, or t
  misc_feature (786)..(786): n is a, c, g, or t
  misc_feature (792)..(792): n is a, c, g, or t
  misc_feature (833)..(833): n is a, c, g, or t
tgaaaagggtttcagtcatatgggcaccaaccatcaaggaagccntggtccccacctggagcttccctcggctgccctggcccttgagcccgtcctgaggatttgtgntttgactctnacagggagcaacaggaagctgcnagcccantgcctccatgcgggtcattggagggcagacggtggagcggcgcttcctcagctcccgcggtcaggccccatcagggatggtcacagtccagcnacaggggcgactntgcccatnagtccccctggggcagcgaacagatcatagctggggcagaaccgggacaggccctctatatangcataaggtcaatgcaggtgggggntcgctgggcccaggccaatgaacccacccgtagagccctnactgggcagcagggccaggagggcacaagggactggcangcagagtccactcggaggcagagagtctgtggatataggaacatgncctcgnaaaggcactagggggttaaggaacagatccactcagacggccttgggccagaagctccctggagagctgggcacntcgaggagcgtctgggagcctcaccctgtcccagtggctcctggcacccctgggagcgtcanacccancccaaagctgggtgcctgtgtcgccactaaacagaagggaaaccgaggcaggggggccggctggcagtggagcattctggcagcgcggggagaccaagtcncgactggcaaagnntggagtttngttttcanaaangaaggctggngttggcacacaggganggctanaccgataaagtgcctcgactgtgttacatttactggaaggngagcgggctcctgggcacgccactcaggcacggtga

SEQ ID NO: 727494 - DNA, 193 bp, Homo sapiens
cgcctgatcatccagccatcggcctcgattttagccagaagctggtgcgtcgacgccttctccttcttccagcatctcctccaggtacatgatacaagaggctttccaccggggctgctttactgttacggggccgtggtgtacacgggaaaggaacccttcagacagggctggtgtttcagccctggggctg

SEQ ID NO: 727495 - DNA, 841 bp, Homo sapiens
gccatctacctttctttccaaaagtactaaagtatgaagtaggctacccaagtaacttgttagaaagtacggaggtgtatcgacgtgtctggcagtgcttctgtcacattagccgcagccggaaccgtgctcaagcactctacggaggaggagtccatggtactcacaggctatcggggcagtcaccacctggttgagagagctgggacaggcttctgaatgctggaaactggcatcactagtgaagtggcctcccaacacggcgccgggtgggtaagcgttgactcttatcctagcctgcaacactcatatctccgtgtgtcttaattcacaagtaacattactttctcagatggagacaattgggctaagatagcaaataacatcgatattgttccttattaaacgtcttcaccagcgtatgaaattctaatgctcgcgctggaggtggctcacacccgacgtaatcccagcacgttggcgaggcacgaggctggtctctgactcctgactaaaagtgatctgcccacctcggcctcccaaagttctgggattacgggcgtgagccacagtcacccggcccggagcggtgtattattgattagctggtgtctttaactatattgaccaaggtgtatagtaacctatttatcacattgttacgaagcaacttttaatcattaaacacatccagcaaatggtgtccctgctgaaacattttaactggaaaccatcacacctggcaggcagcactctctgcagctatgcccttgtggagtcagcaggagctggtgtttttcagccagacagaggcattaccacgtggctgatgttagcacga

SEQ ID NO: 727496 - DNA, 1019 bp, Homo sapiens
  misc_feature (372)..(372): n is a, c, g, or t
  misc_feature (378)..(378): n is a, c, g, or t
  misc_feature (394)..(394): n is a, c, g, or t
  misc_feature (438)..(438): n is a, c, g, or t
  misc_feature (451)..(451): n is a, c, g, or t
  misc_feature (512)..(512): n is a, c, g, or t
  misc_feature (520)..(520): n is a, c, g, or t
  misc_feature (523)..(523): n is a, c, g, or t
  misc_feature (545)..(545): n is a, c, g, or t
  misc_feature (595)..(595): n is a, c, g, or t
  misc_feature (604)..(604): n is a, c, g, or t
  misc_feature (622)..(622): n is a, c, g, or t
  misc_feature (680)..(680): n is a, c, g, or t
  misc_feature (744)..(744): n is a, c, g, or t
gataaagctcacttgggccgagaccgagggagtgagctgtatgagtgagggtgtccgaactccttgactatggcccgtacaccatcctggacagaggcctgaggcaggccatctagtagtcggcaactcaatgttcgccggtaccaaggcactgtggaccggaacctggcgggtgcaaatacaccaaggccagggatgcacagatcattgttctcatcgatacttgtcgtagattactgctatcgaagggcatggctcacctttccatggacgagcactcgagggggacgtcgtagcaagcgaactgacgtccacgagacaggggggttccatgagagcatgcgaatcaaggcctcggcgatcaatggagtngtgtcngcgccgtatgcaaganaggcgcgtccctctagaacacgcaaatcctcgaaaggcgcacanagcgatcgagtgncgagcagtgtgctcggtaagcgaatgtggggcattcgagtacttgagcgtgagagcacaanggtggccncanagtcctgctttagtcgtcccantgcgacgagtatcaccgagtgagagtgggagcctagagcgcgaatgcatntgtcatacntactcccatcgtgctccngaaagaaggcaacgcgcaatgcggtactcctttgctcctactccaggctgggggcccnccctagattcggcggggtgttgtggccacatgagggtcgtaaccccctcgatcgtcccctgcgntagttcccctaggcgtgtttcgcgtgagccatcctcggaggggcgcaacccgctttagccgagcatgggtccgatggacatcttggaccctattggtgcggccccccaatacccgcgaaagttgggcacttagctttgggtactacttggctcgtaaaaaagttggccctcggggctttttggttggtggcgacctcacccgtaggggtaggacccagtgctaggagtccttgctgagggagggtccgtgtatgagacctgtgatatttgatacc

SEQ ID NO: 727497 - DNA, 282 bp, Homo sapiens
gttttttttttttcccccggggaaataggccccaccccccccccagtttgggcccggggtttttgtcttccttgggaatcccagaaaatccgcggtcagaaaatctttaaaaatttatggcccgcccccctctgaaattatgggaaaaattagaccccccccccaggttttggaatttttaaaatgttaaaaaaaaagccccttttttttggggccgattttaatgtttaaaaatttggtttcaaagaaattgcctttcaaaaaaattgggttcctttgcca

SEQ ID NO: 727498 - DNA, 101 bp, Homo sapiens
ccgtggcttgtacgttgaccgatgcgctgtgggttgaccgtggctagtggttgaccgtggcttgtagggttgaccgtggcttgtgggttgaggcgtggcta

SEQ ID NO: 727499 - DNA, 204 bp, Homo sapiens
gtaggatcgtgccatcctccctaaattctttcaaaaggttcaagacgaaggaatactcccaaagacattctataatgccaccatctaccctcattccaaaaccaggcagagataccaccaaaaaagaaaactatcggccaatatcattgatgaatatagatgctaaaattctcaaggtaggtatgatgaaggacgcgtccttca

SEQ ID NO: 727500 - DNA, 371 bp, Homo sapiens
accaggagctgacacagagctggagtcagtgtgctgagccaggagcactgagggctactcaggctcagataattaagctcgtctgcagtgcaagcagccatgcggcccgtgaggaagatctttgatgcacttgcaacatcgccagtcagaaagcagcgacttacccaggatccagtaggatatagtaaccactgccggcttactggatgtgctaacacataccaagccctcagacaaagaatcaggctcagagatactcagacgggcaacgagagttcgcgtctgtctgaaaccacattcaacctgacctggccagaaaggacaccacaaagacctcctagtaaatcaacatgtccgtgagcgtaggaggt

SEQ ID NO: 727501 - DNA, 651 bp, Homo sapiens
  misc_feature (380)..(380): n is a, c, g, or t
ggggcccggggcccacaaggaggtgggcggggccgcacccttcctcggggttgacttctccagcctggacatgagtctctgtgtcgtgctgtacgtggcttcatccctgttcctcatggtgatgtacttcttcttccgggtgaggtccaggcggtggaaggtcaagcaccaccacccggccgtgtgagtgcccgggtgctgccagccacggcggaagctcccttggaggcagccctgccccgtgccacctgcagctttaatatttatgatcagggattttataaacatgcgggcctggtttcacatcggatggcacctttggcttcaaagtcctggttttacaaacgctcttctaacaagggaagaacacggggtaattngtggggatattgcattcctggcgtactcaagtctgttcatgctcctttgcaggtcttacagcaaaaagacttctgtatttttactcttctagatgtgaaaagagggtgcagagtccaggccagatagtcttccccacacactttcatctcgtttcctccactccgccccatcctgcagggccttgttttgtatttggagaacctcgcccatcccccgggtctgttctagaccatataggacaggggacagaaagggcgtaggtagctggca

SEQ ID NO: 727502 - DNA, 215 bp, Homo sapiens
atgcccctatgatgggcgagagcaccggcccggcgcgccgcccatgtacgggaggagacggggtgtaggggaatactgtgatattgacctccacctggcctgagcgtgtaccgatagggtaggatgcctcacagatgtaggtccctgccaggctgtaggttgattgggtcccttgaaagaagagggttctgttctgggcctccacacccttgggg

SEQ ID NO: 727503 - DNA, 440 bp, Homo sapiens
ggccatttactccaggccaggatggtctcgatcttctgacctcgtgatccacctgcctcggcctcccaagagtgctgggattacaggcgtgagccaccgtgcctggccttgacattctttttatacagggattcttggggctatgtcttcccttccgcctgcccactcagcagtgccgtggagcagaggtggttttcatttgtttgcaagtttctggtgcaacttacttctgggccatttatgccagccattaagaggatggtctagctgcaaaattgggaagaagaggactaagataggtctctgggcgatttgctcagtgccattcaatcaagatagagtgagtctcttgatctctgtagctggaaatgtagattgcccctcattcctttgtagtcaggagaccacatccagaattagaagccatggagtaaatggca

SEQ ID NO: 727504 - DNA, 765 bp, Homo sapiens
ggcagcttcccagcagggtccatcaccacctgcacagtaattcagtgcggccatgcagcttctcagcggggtccatcaccacctgggcagtaattcagtgcggcccatgcagcttctcagcggggtccatcaccacctgcgacagtaattcagttgcagcccatgcagcttcccagcggggatccatcaccacctgcgcagtaattcagtgcaggcccgggcgagttctccaaggggggtactcatgcaccacggtggcgcgcataatcgcaggcgttagcgcgggtgcaggtccccgaggcggggtccatgaccaccggcgcggaaaattcagtgaggcccagtgcaggttcccaggggggtccagtcaccagcagttgcgcgagtaagtgcagatgcaggccagtgcagctgtcccaggggggctccatcacgcacagtgcgcggaaaaatacagtggaggacgttgcagctgccgagcggggtccatcaccgacatgcgcagaaaattgaggtgcacgcacatgcaagtacccacgggggatccatcgaccacactgcgcaaggagattcaagatgcggcccatgcaggcttccacagtgggggtccattcagccatatgcggcggataattcaggtgcgcgccgatgcaggtcacacaggggggtccatcaccagctgcgcaggaatcaggggcagcacgtgcaagtgcccaggggggtccaatcaccagatgttgcggagtcacgcgcggccatgagatc

SEQ ID NO: 727505 - DNA, 902 bp, Homo sapiens
agaattaacattaggggcctgataggggaaatggtgaagcaatggaaaatgaacagacaacgtaaggagtagcttctatgtacagaatattgtacctttaaccaaaatgtcagttggcaccataaataaggactgtgagagacgtgtttaaaagctgtgaaagtctgaaacctataagccaaggatgtaccctgcctaaacttatgctgttcccacggaaaggactaagcctgttcataagttaccgaagagttgccattttggagatggaaattgacgaggagggaaggtcgttttgattgggagagtatacaagtacaagcgagatcattctgccttagaggtgctaagttgcccgaaatttagaagaccctttcttttccagtaatgaagtgataaatatcagcttgttcatcctaatgccagctggctgaggtggttaggaagaggaagagggtgtgtacgaggaggtgaagacagtagggaaagacaagggtcgccatgctgctttagtggggaaaagctcttggagcgcgtttagcttatggagctttgagacactgaataccattgttggcagggttcagtgcactgagcagcacaagtttcagtgaattgatccaagaggtttagtgatttcaaaagcctgtggtctcaggagaaagattaaaactttcaatatggggcaggtggttcactttgaaaagacagagattagacaggagcaaaaagaatttcttaagaaatcctaattaagtaagataaccaaaatgtctgtctgaagcaggagaacgaccagttcgtgatattgttagacttgctctaaaggtagttgtaaatctttaggctgtgtagattctgtgtattggtaaggtgatcgactatgcgtttgttgataactg

SEQ ID NO: 727506 - DNA, 903 bp, Homo sapiens
ggtggttgaggcaggaggatgtttgagtgagggacgttgaggctgcaatgtgaactatgattttaccactgcactccagcttgggcataacaaaattgagaccctgtctcaaacaaaaaataccatggttgtactatgacagtaagcgcggaattgaatgcgattaacaattggagggactgtgaacgaaggaatagctagacgtgcatttgaacaattgccttctgatcgtgcacttgtgaaccgattgttgatctgggcactcatcgtgcatatatctccaccaagtgagtttgggtccggcgtatcccaatacgaggatgatctgtactgctgctccctctgagacggtgcgttgccatacaattgggagcagaggttagttctggatctacagttgcgatccgatgccttttgtattttgccatataggccgcttcggtgctgggcagcctcgtggggtatgtcgtcatcccgtacttggggcaaaaggcgcctttaggacaatgtggattaaaacgcttcggggcagacacatgtggcggtgtttgcggcgcaaagaatatctatcgctaattgtcgaaggctttcaaagaaggctatacgccatcttttgttaccttcaactgttaacccctttttcctcaacaagggacgtaataaaagacacagttttatttctccctctttttgttagccaaaaacaaactggggggccctgggctccgtaagtttgttctcctgttgctaagcctattaacgcgaagacgacgattaatgtcgccttgtgcaatgagcagcattaggtatacactctcttcgttcataataatgtacaacaatcacaccttggggccgaccaaccaggggtaaaaattcccacacttggccccaaaaagcctt

SEQ ID NO: 727507 - DNA, 458 bp, Homo sapiens
acccctgcaatctagtcaactcccatctatactgtactttttctacgtgctgctttgtgctgagcgaactttttagttccctgcacttgacctgtcataagcctgattctttgtaatttaacgggatcctttcggtggttactttatagacgaaatttccatgttgcctttacatcacattaaaatataacttctttcagaaggatcatagaagcactgattcatagtataaatcttgtaatgaagctttgacttttaatgtggctattatcttcaaaattgtaaattactagtaacatgtcatttctataggatgtcttacattatgtaccttccattggttcgttcacatttatttcactttctctaagccactttgagtggaatagatccaaagcatacagttgtctccccacataaggaagcgtcgctgcgccttccaacctttcaagccgtca

SEQ ID NO: 727508 - DNA, 904 bp, Homo sapiens
  misc_feature (18)..(19): n is a, c, g, or t
aatatcaatctaaataannaaaaaaaaaaaaccggccgcatcggggctcttgacggataaaggctgaggactgactgcgccgagacatcgttgaatatgactacaaaatatatttacgagcgtcttttaagcacgggattccaacgacactcataaacgtgctcgctgccagcttttacaaacgaaaataaggtttttctccatcaaaaacaacccagttacaccagtaaatcttcccagttctgaaaatctgaagcaactgatactccattaaatgtggaaacactgtctactcaaaatatttgtaatattatacagtgacaaaaatttcccacacctatatagggttaaccatagttttcagcaaagaacaagtgctttacttattttgtctttttcagctcatacagagctccaatttcatgaaaccatactgtgccaaaccaggaaataaacagcatcactctagcgaagccacgccaaccaaacggatactatctcctgttctttataccagctttactcttcccaaacagcaagtgcttgtgcttcatatcaaaaacgtggtctatcccgtctctctcgcttgcccaaccgattgatatttttctgaccattcttcatcataggcctggcgttctaaccatcttgacatccctaaaccccaaactttacggggagcttagagcattccccatctcggccacataggaccgtttagcccaagtcttcccgtttttatttccaatgaaactacggaaatttcttagccaggacgcattatagtgtatccactttataccccaagtaatactgagacggctcttttcgttctccaatcgggctccgatcttatcagcaatttggagatccggctccagggaatcatagtttgaaggatgat

SEQ ID NO: 727509 - DNA, 546 bp, Homo sapiens
  misc_feature (291)..(291): n is a, c, g, or t
  misc_feature (347)..(347): n is a, c, g, or t
  misc_feature (392)..(392): n is a, c, g, or t
  misc_feature (467)..(467): n is a, c, g, or t
  misc_feature (494)..(494): n is a, c, g, or t
  misc_feature (539)..(539): n is a, c, g, or t
ggccatgttgttccctccgcgctggacgggagcagctggagcgggagcctggctgcgctaccgcgggctgcctcctgctgtgcagttccccgaccctctctctgtcctcattgcgcccagacgggccggcccagagctcccgggtcgtctttcgtgtggccgcgaggttcttgaagcttttgagataacaatggcaggtcatcactttttaaagtaattctccttggagatggtggattgggaagagtcacttatgaacagatagtaactaataagttgatacccagctcntccatacaatagtgtggaattttaaataaagattggagtggatggacatttgttancagcagattgggacacggcagtcaggagcgattccgaagcctgangacaccatttacagaggttctgactgctgctgcttacttagtgtcgagatcacaaagcttccagaacttagtaanggaggaatcatatataagcgagtgaanagccgagagcttcctttgggaatcgggtacaagatgacatagcgngcggtct

SEQ ID NO: 727510 - DNA, 863 bp, Homo sapiens
gttttttgagctggagtctcgcttgttgcccaggtggagtgcagtggcacgatctcggtcactacaagctctgcctcccaggttcacgcattctcccgcctcagccccggagtacctgggactataggcgccaccactacgcccggctaattttgtcttgtattttagtggagacgggatttcgccgtgttggccgggatggtctccatctcctgaccttgtgatccacccgcctgggcctcccagagtgctgggattacagatgtgagccactgtgcccagccacctatatgatttttataaagggcatatctaaatcaaaataatccaggaagtgacaataaacttcaaaaggtggaaaagtttatctgtggaccaaatgtgacaaaatgaaagtaccatagccatattagtgtgggataaatagattcatattgatgaaagatgtaatctctaaaagaaataacagttatagcttgtgggcaaggtggtcatgttaataatcccagcatttggaaggcgaggcaggtggatcacgaggtcaggagtccgagaccagctggcgggttattgaaccccgtctttataaaatacaaaaaaattagcgggtgggtggcacggctgtattccaactattgggaggtgagccaggagattgttgaactggagtggagttgctagtgagatattgcatgattagctggggaaggttgggtcgtttaaaacaaaaggtttatgggggatcattaatttaaggacaaggaaatgtgtacattttgaccatggggagattttgtgggtcaaaaaaaaatggggggattaataggcggatgttgtagctgtaagccgtatgtctctttcgg

SEQ ID NO: 727511 - DNA, 500 bp, Homo sapiens
agttcgacggagaacatctcccaatcaagaaaacaaaagtctaggaaccaatggaattctaacaaacatttaaagaagaactaataccaattcttttcaagctcttccagaaaatagaagagagaattttttgaaactcattctacaaggccagcgttaccctgataccaaaaccagacaaggatacaagaaacaaaaacaaaaaaaaaggaggaaaagaaaagaaaagaaaactataggccaatatccttgatgaacacagatgcaaaaatcctcaatgaaatacaagcaaatcaaattcagcaacacattaaaaagatccaaaggttgcaaggatggttcaacatatacaaatcaatgaacataacgaagtatatcaacagaatgatgggctaaaccatatgatcttctcaatagatgcggaaaaaatatttaataaaatccaacatcacttcataagaaaaactctcaacaagttaggcgcagaaggaatgtgcccc

SEQ ID NO: 727512 - DNA, 114 bp, Homo sapiens
  misc_feature (34)..(34): n is a, c, g, or t
  misc_feature (82)..(82): n is a, c, g, or t
  misc_feature (91)..(91): n is a, c, g, or t
gactgaacccggacttggtcctgaccccaagganaccatcattgatgtggtgggggcacccctcacgcccaattcgagaaancgacgggantcggcctccagctcatcttccgt

SEQ ID NO: 727513 - DNA, 108 bp, Homo sapiens
gactgcatccacgccggctgactgcatccaacgcctgcctgactgcatccaccgccgcctgactgcatccaacgccgcctgactgcgtccaatagccgctagactgca

SEQ ID NO: 727514 - DNA, 862 bp, Homo sapiens
  misc_feature (1)..(1): n is a, c, g, or t
  misc_feature (3)..(4): n is a, c, g, or t
ncnngtctgtatgtctggtaggtagagtcaaggaaaggtagcactgggtactataggacatagtgattgggtgatgccgatcacatttggtgacttggtccgcagcgacgttgtccggtaggtctaaattggcatcccttaattggcttgccccagtagacctgggttggcgctgtcacagcctgtgttgcccaccccgctctggtacttcgggccggtttgccctgcctttgcaagcctttcaaactgcaggataccttgtgcctcccacgggtgtcgccccgccctgatggactataccccttcccctgcgcagtggtgattccgagtcacttgatggagcccacacgaatgccgcattgtgtccagccggtatcaggattgccgtcatcttcccggggctcggctggtttcaaatggtagtgcacccccccccgtggtttttatgaagcactggcgtggtctcccctcgccttcactgcgggtttctacaggcctcccggggacccagaattgggtatcattctggtgttcaagttgcaaacccccattaacactcccaagagtcgcaaacccccgtcaatgcctccaccactcaggacatgctgtgccgtcaccaattcatcctgtacaacaccgcgcagcacaaggtccgccatggcccagggtacatccccatccctcctccctttcttcagcaggaaacaaccaataacaatgccggttttcctcaaagaaacacaagaaaagagtgaggttctcccacccccgggcacacaataatttctccccaaaggactctgttcaattcaaaacaaataattggtggaaaaacaaagggttatctggccacaaacataac

SEQ ID NO: 727515 - DNA, 277 bp, Homo sapiens
gattcccgatccagagacaatggacccgatgggattggagcccgaagcgttcatcgagagtaacttgaatgagattattgacagctttgatgacatgaacctctcggagtcctccacgtggcatctacggctatggaatgtcagaagcacctagcattcagcagcaagcagtactacctgtatcaaggtttactgatgtgattgctcaagccaatgctggggttggaagcggtcaacattagcatgatcggtgtctcacgaggtcgacgtcatcgct

SEQ ID NO: 727516 - DNA, 124 bp, Homo sapiens
cacattcaccacaacatttagcctcataactacaaaatgaatcacctgctactcttatctcctttagagacagatgaagaagaaacatctataaagtggatgaagtgacattagatacacagag

SEQ ID NO: 727517 - DNA, 294 bp, Homo sapiens
atatttctagtggaccataaacttgctgcagtttatttgtgcttcagaattttttttgagacagaatttccctcttgttgcccaggccggagcgcaatggcatgaccttggctcactgcaacctctttctcctgggttcaagcaattctcctgcctcagtctcctgagtagctgggattacaggcatgcaccaccatgcctggctaattttgtatttctagtagagacagggtttctcccgtgctggtcaggctgggtctcgaacttccaaaccttaagggtgattccacctgg

SEQ ID NO: 727518 - DNA, 399 bp, Homo sapiens
agtcagatgagtgcagctgttgcgaacatcgatttatcactgtcggtcgaattcacagacaatacttcatgtagcatctgggtggatgagttatattcgtgcatgaaggccaggttgaggtggatttcactgaacgagcgcgtgctgttagcgcgcggtgatgctctggatttgaactggcagaaacccctgcgaatttactcagtgcgataagtgcctgttcctgtgctgttgatggtgcacaggactaacagagtgttactgaacactacttgcgatgcattctatgtgggagattgatgagctaaagaccctggttgagcccggcaaagtgctgaccgacgccgactccctggaggcttacggcaaggattggaccaagcacttcgctcccgcacc

SEQ ID NO: 727519 - DNA, 226 bp, Homo sapiens
tgcatgcttggcttggtgtcacgaggggatggctgggattggctggctgagcccccctgttttaccctgtgttggccgagtttggactccagctgggggtttccagatggggacatcactgtagggggacggaccatcacctcctgctttgacttagggctactctgtgtgtttcctgatggagagatcctcactttagggttactggaatgcattgattgaaatc

SEQ ID NO: 727520 - DNA, 266 bp, Homo sapiens
ttcccttcctgttcagtgtctcatgtcaatcccacctatgagtagaacatgcagtatttggtttttgtccttgtgatagtttactgagaatgatgatttccaatttcatccatgtcttaggataccccattggcttcttcattcagtcctacacataccccagtggctccttcattcagtcctacacataccccagtggcttcttcattcagtcctacacataccccagtggctccttcattcagtcctacacgggtaccgagctc

SEQ ID NO: 727521 - DNA, 525 bp, Homo sapiens
  misc_feature (429)..(429): n is a, c, g, or t
cacacagctctatgacattggggcccttcttttgctgaaactggcttacgtcttggtttaactccttcaccgtagatttgacgtgagtccagtttccttccaatgtcgctgtcctgccctgtttcggcctgactgtgttgtatgctgtggtgatcttgctgggaatgattataattgtgtgtgtggtgggggagtgggtatttcatgcgttgcgtgaagagtcctcctggttttccctcattcctcccaccttcccgtggtcattttaattacggggcagtgtcaccgcaaagggaggaaactcaaagccgaaagccaaattccaggcctgattctggcttttgagtctggttcttgaagccaggcctgtaccgactctcagattggggtcagtcccgtcgctttgcagactgaccctggaaatctacnaaatgcagattttcctgatttcctcttctcttggccaggttttttttttttttttttttttttaaaaccctggttgttaccccattttttttttcc

SEQ ID NO: 727522 - DNA, 370 bp, Homo sapiens
ggagcatatacatctacagttcaggaatacaagtcaattcggcaaccagtgtagaccagtgaggacgagctactctcttctaaacaaaggcagtgcgaaagactcggcaattttatcaatttattacaatgcaaagggtaacacagaaaaccttattctgctttcaataaatactctgtccagtgtcgcagaattttgtaaactaatatctgagtcaagcggtcgcagtgtaaaaccaccctccggggcccaggtcctaagagttagacacaagcatcgtcctgtggatggaccgctggtccccatcttaatgcctctggcctgtcagtaccttgggaacaagtttccctttaataccatataaaatatg

SEQ ID NO: 727523 - DNA, 319 bp, Homo sapiens
acagaatgcatcagtaaaatgaacatatctctacatgcgccgaaatctctggcttgacactaccctactggtgtccagttggcgacagactaacatgcactgaaggactattaggattgctgcctcctaagttatcacagcctcgctctgttgatgtgaatgaggaactgcttggttgttaaaggagattttgctccctgctgccccaaacaggtccttatctaggtttgctccccactgccccaaacaggtctggcaggattggttacaatgatctccagaggctcaaccattccccttccctatccttgcaggtggg

SEQ ID NO: 727524 - DNA, 226 bp, Homo sapiens
  misc_feature (184)..(184): n is a, c, g, or t
  misc_feature (218)..(218): n is a, c, g, or t
tgactgaaatggtatctttcagtcctaccttgtagggccttgtagtaaaagctatatcccatgactaccttccccttaaagagtatggaacatttttagattatatcagaaatccaaagatgcctgtttcactggctgtgcagcggtggagagactgtcctcaggtcagcagcagcaagtgtcngataacacctgcctcctgcaagcaatgtgttgtngtgtgcct

SEQ ID NO: 727525 - DNA, 1494 bp, Homo sapiens
gccttctctctccttcgttctttccgtcctgcctcctgtccctctccttggccgtcgtctgccgctccgcgtccggtgcctgtcgctcctcgtcctggtcgttcgtctgttctccgcctcgccctcgccgtgcgcctgctgctgtgcactgtggtgcggctgtgcgcgcgcgtttgggtgttcgccgctctcttcggtgccgtggcacttctctggcgcgtcggcgtcgtcctgtcgcgcagttcgcggctgttcccgttggtgtgtgtcgcgttgcgcgttcgtggtgtctgttcttttggtgtttggccggcttttttgtgtatgagtgttgtgaggttgttggtttgttgtgtgttgttttcgtgtgtgttgtgtagtatgggttgtatggatatggttgtggtgttgttgtgtgcgttgttgtgttgagtgtttgtttatatgggtgttttgttcggggggtgtgttacgtcgtgcgaaccaatgttagtagtactgttaatcgttgttattgggtagtgcaggagcaacacggtagcggatgtgtatgcgtgatcagctaggtaggtaacctccgatatctgattccccacaatgttgttgtatcattattaatattcatgtgcgttggtaatagatccgtatcgtccccacgtgtacctattgtgtccgcggtcgctaaacggtaatgctgagtgacctttgggtgtggccagaagtctcgggtcattcgactgtggtctagttgtccccgtgcgtctgccgtcgcgtgtctcggtggatagggttctagcgtccgttaattgtgcgtgtcttttgtgcgttcctgggaccccttgatctttgacccacattcagtctgaatgggtctttgtcggctgtctattaatgctggggctgtcttacgccagctgttcgattcctgttgtgttggcgtccatgatgatgatcaaagtatccgatttatcttttgcttgggtttgactgagatgccctggttgtgaatgatatcactatagatatgctatatagtgactactggtcgaatggccaacccagcgtgtcgtgtataggaggcctcgaggtaagaagtgtctgggtaccggtcagcagtccatcagccagtacagtcgtgtccctgacgtctcctgggggcaccgtccgtatgagagagtatcgatttgtctacatagtgtcctcagaatggtgcttagattgatctggcatccttctgagaaggcaatgtatcctgattatctttgtccaagagagaacagtggaagatatatctgtcggagtggaaagtctgggaatcgagatggttaagtcagtctgcaggaggaaatctgccacctggtggtcctttaactgaagctttgcctccctgcccgaataggaatggtgatttgcccccatctgtgtgtggtatattgtgaccatgaccaccgggagcggcccatgtagaaagagagagacctcatgctttcatgc

SEQ ID NO: 727526 - DNA, 311 bp, Homo sapiens
  misc_feature (301)..(301): n is a, c, g, or t
aagtgtaagtgtatacgcatatcaatattaaacagcaagcgagcagaatttggaattcatccaatccactatgcggcctcttcgaacctccatgatgctgcttacatatctcgatcccacttaactatcttgggctgtgacaaagtcacttggttcacacgcgcaggcattctcatctctttccagtggggagtgaattcagtgtaagtacaagaagagtagaaagaccaggtccttgctggagacgacacagtctgaattgctccagctttttcaagttctcatctcctattctttcagntacgatcaac

SEQ ID NO: 727527 - DNA, 242 bp, Homo sapiens
ccccccgggggtggggccccccctccccttgccccttagggaagcccggggtttttccctcccccccttgaccttgaaaccggtccctcccccctcccgcccttccatttggcctcccctgggggggcccccttttttttgccctttttgaaatcccttttcgggggacccccttttactggggtcccaaacctttttccttggaacttttgggttattaattcggggtgggttttttttta

SEQ ID NO: 727528 - DNA, 290 bp, Homo sapiens
attatataagatgttagctttgaggcacaggagataggtaatagcttacagctctaatctatgtcgtgatatgagaaagagcgtctagaatagcctggtgtatctactagttgacctaccatgattttgccttgcaagcatttcattccttctgtattacacagtagtagcttcgactggactggctagtcaatataggcatgttcactcaatgtcaaactaacttagcagcactttcacggctaacaccaccagctacggcgctaccagagcctcgacatccgctacct

SEQ ID NO: 727529 - DNA, 116 bp, Homo sapiens
ggctagacatgatagctagtcaggaagcatgtaaagctaagggagcaaagccaggcctatgcacaatgattgtcagtgcgtaaaggaaattcttgatattcgtgaatattaatgcg

SEQ ID NO: 727530 - DNA, 358 bp, Homo sapiens
cgcccagtgtaactggtgtgtcccccaattatcccatacataagaaatcaaaacattaaactaacccccttccccccccacaacaaccctcttaaaactaatgggctttttagaaacaccccacaaaagctcagaaatgggctttaaaaaaaacaaccaccaaaaaaaaccaatgggctaaaaaaaaaaagtattaaaaacgaatgggcggagaaacaatgggcaaaataaaggaattgggcactccccacccccctctttctcttctccctgggactttggagtcaaatgggccgggactggagtcccggaaccagcaaagagaaaagagggaccccagagcacacagggggggcgg

SEQ ID NO: 727531 - DNA, 156 bp, Homo sapiens
gacagtgacctcaaactctttcccactctgcctcgtgtgtagtgatcgcacaacggatgagtgcagttgacttccctgttccctgtcgatggatggataggtttgtttccaattttagttattgtgaactaaaaaacaccttagccatctacaaac

SEQ ID NO: 727532 - DNA, 328 bp, Homo sapiens
gaggatcccctaccgtctcgtagaagaaactacatcagttaatggcagcaaaacaaccagctagcatcataatgacaggatcaaattcacatatacaatattagccttaaatgtaatgggctaaatgccccagttaaaagacacagactggcaaattggataaagagtcaagacccatcagtgtgctgtacccaggagacccatctcatgtacaaagacacacataggctcaaaataaagggatggagcaagatctaccaagcaaatggaaagtaaaaaaaagcaggggttgcaatcctggtctctgataaaacatactttaaactaa

SEQ ID NO: 727533 - DNA, 425 bp, Homo sapiens
cggcacgagggaaaagaaggaagttcagtgatctattgggcgtcatggtgacagcagttaacaacagcctattgtgttcttgaaaatcgctgagagtagattttagttctcaccacacacaaaagaaatgctaagtatgtgaggccgtgcctgtgttgaatagtttgaccgagccactccacagtgtacacacacatatcaaatcctcatgctgtgtaccgtaaatacatacaatttttacttgtcaattaaacagcagcacacacaaaaacaagatgaaacaaaacaacaggtggacagacaatggctaggttaacaccactggttggtttagtggaccagaggttttgaaaaatgggacctggcacgtggctggctgccttaaaggctgtctgtatccctgtgtatttgaaatgttcctttta

SEQ ID NO: 727534 - DNA, 138 bp, Homo sapiens
ggtaagatgcatcttcattggtgctggagctgttcctgagggagcaggccatgggaccctcatcgggaccgttgccgtcagctacttccgcgtacgggggatactgtgtcccaagggtaccccttctgtcgtcttctc

SEQ ID NO: 727535 - DNA, 135 bp, Homo sapiens
  misc_feature (129)..(129): n is a, c, g, or t
ctccctggggccgggttcactgtttttttttccttgtgtttcccccgggccttggcccgtgcttggcaccttgggggtggccattaatggttgttgaatttattaacaaggtgaggggggggcttttgnaatgga

SEQ ID NO: 727536 - DNA, 693 bp, Homo sapiens
ccctgagcatggcttctgtgaacagcccggtgagtgtcgatgcctagagggctggactgtaccccctctgcacggatgccctgtcgtccagcagcagaatgactcaggcccaggagcccgtcctctgataccaccggatgccttgtcgctgggcctgggcccgtgtgacgggaagccgtgtgccaatggaggcagcttgtagtgagatacccaggtcctttgaatgcacctgccacgcgtgggttctacgggctgcggtgtgaggtgagcggggtgacatgtgcagatggaccctgcttcaacggcggcttgatgtgtcgggggtgcagacccgtgactctgcctacaatctgccacatgccacccgtatatccaaggctccaacttgtgaggaatgagggttggaccggtgcagcctgcaggacatgcacgcaatggcggcaactctggccctgtgaccctggagccaagcccatggcgctctgccagatgacacgacgaccaggattacggggagtccctcggctgcgacgcaacgaccatgtaacagaactgcacggagcccgaacacttgaggctcacaaaagccggacacgatgatgatgaaggcgacagcggcgacaccaacagacagacacctgcggaccatgggaatcgagcaggccgacaaacaactaaccatcgaaggaggac

SEQ ID NO: 727537 - DNA, 1295 bp, Homo sapiens
ggccggcgccagttggccgagcgaggccgcctcggacctgccccggtgcgcccggtgcgctcaactaggcctcggtgcccatgaatccttgttcgggcactcgtgggcaggtggcacggctccatggctccgagcgtgctgatgcgcctaggtgttgtgcatgccgtgacgtcgtgataggaagcttgcgtggtctttcatagggacgtctgggaggagagggacgtcgtgactctcgcggtgggtgactcagcatgttcgaatgcactgcactgggacgtctcaaaacgagatcctgtgcggatcccactgacgagttgatgctagcaccctccaagtaggaacaatggtggcagaccagagccttgggcccatgcaccgcgttcgtccattgtccaggttatccctcgatctgtccttgaagagcaggggcagatgggcgaaacgagagcattccaggattcgagtgcatagctgatggcgagataaaagcaggcataacgcaatgtcaaaccagtagacctcattcacatgtgggtcgtaacaagtgaccggcgtgggacccgggctgagtgacatcccactcgaggacagttgggctctcgcaggggtgtagtgtcaaagcgacccccggatcgtggaaaaggaggtgagacctaagagtagcctggaaggacacactcattgcaaggcatgtcatttcacacaggaagggacacacgcctagtcatagagggaggcgccctgatgaagtcatagggattctgcgccgttcacacgttgatccaaggtcgcaagagactcaagtatagaacacaaacggaaaatggaacatgtcacgtcacgtttgccaaggggagctcgttggcacacccaagaagggtgtagtaaagtgattccacagacgaggaatgtatagcctgaacttcccgtaggtgaagggaatcgctaattgaaaggaaggcgctatcgttccggtccctagaaatgccaccgggcagggggcacgcaaagttggaaacggtgaaaccggcaccagattggtccagaggtgggagaccagcgtggacacttttggcgggaacccggactggggaacacagaaccatttttatgacaactggattgggcggagaaaaagacccaggcaaacgaacaaagcacaaacggacggcgacacgaattccgggatatcacaactctaagagaaagacagtcaacacaacggcgcaacgaaacacagcgtgacgtagagatctgactctaggcacttggacgaggagacaggcttccca

SEQ ID NO: 727538 - DNA, 315 bp, Homo sapiens
tttactccctggggtgtttatagagatacatcactgcttcgtccaatcccactatgcttcagggtctcctggctctcactacgcagctcttgcaggatcttcagcagctcctcccggatcttgagtgcaagccaactcctatctggtagaggtgagagcctttctttgatggcagacatcacaccaccgtcaatgattgtttctgtaaggagatggggtttcaccgtgttggccaagctgatctagaactcctgacctcaggtgatctgcccacctcggtctcccaaatgctgggattacagacacttgccacta

SEQ ID NO: 727539 - DNA, 1032 bp, Homo sapiens
tgcgcgtcgggtgtggtggtgtgtctgttcgatgcggcgtgtgctagtggttcttctcggcgtgcgttttctgcaggcacgtgttttcgggtgagtgtgttttgtcgggctggtgtcggtagtgtggtgcgtgtggtgtgggtgcggtcgcgtgtgcggttgtcgcgttcatggtgtcggttgtttcggttcggcgttaatagtctgcgtttgcgtggtggggtgctgtagtgtctgggtggcctttgtttttcgcggcctattcgttttgcgcagtgtttgtgcgtcgcgctgttggtcgacgctcgttttcttagctctgtgaccagtgttcgccgagctggtggtgttgtgtggtcgcctgtgctgttgtctggacccgcgcgagtgtaaggtgggcgtgtcgttgtgtagatgaacacctggcttcgtcccctgtggtgccgccgttatgtcgctggggtggtggttcattgtcctcgtggcggggcggcgatggagtctggcagtcgcatgcgtatctgctttcctcgacctggtgggtgtggtggtgaagttcgggccgctgtagttgtgtgtgccgcacctgttgggaacaacccccgtgggttgaatagccctcttgtaggtgatgtatgccccctctttgtgtagtggtacattcccgccgctgttctacgagggctcctcccacttggagagaatcgaactccctgcactccccacccgctggtgggagcacccaactcacagtgtagatcttcttctaaaatcaccgctttcctcaaactagtgttccatattctttttaaaagcactcgtaatctgtcacaccaaagaagataataataattgcttctccatatgcacccatcagtctcgttcctaaacttccactatttctctgaatctaattacaagccctcactaagacccccctgtttagaatcccagcgcctttcgttttgggggtgggaatctttttggaccagcgatcccaaaaaccccttttttttccaaagaccaacataa

SEQ ID NO: 727540 - DNA, 213 bp, Homo sapiens
gcagtgtatggctgttatggttacagtgacatataaagaaacaagtttaatagcgagtggaacctgctttagtgttggtattcaggcaaagaaatatttaaagcactgttatgctggagccagctgccaattcagaagaacagatatttccacaattgtgtgagctgtctgacatgccattggcggtattaaacgcattgcaacacggtctct

SEQ ID NO: 727541 - DNA, 240 bp, Homo sapiens
acaagcaggcgtacagcacccctctcagccaggacggactcacgcctccagtgtggatcagacaacaccacaccacaacagaggtccacggtgacccctctccatccggggacaaccacactgcacagtgttgacagcaccaccacaactgtgggcacttgttcctatgggaacagccttctctagcacacagaccagtggtactcccccatcagtgagcatcacaaatggtacgtggat

SEQ ID NO: 727542 - DNA, 486 bp, Homo sapiens
gtcttctgaatccccccccagctctcttctgctgcagttctgctcacacctggatttccccatgcattcccacaaaaagtaattaaatggcatgcgtgcaggctggacacgccaacaacaggtttcccacaatgccccacatggggccaagacctgtgtgcattactcattgcatttttttgcttattctctgctgtgtggtataaatatattgttgaaaacgtcaaaaagacctaaagatacccctgtgaatatcagtgataagaaaaagaggaagcttttatgtttatctatagcacagaaagtcaagttgttggagaaactggacagtggtgtaagtgtgaaacatcttacagaagagtatggtgttggaatgaccaccatatatgacctgaagaaacagaaggataaactgttgaagttttatgctgaaagtgatgagcagatattaatgaaaaatagaaaaacacttcataaagctaaaaa

SEQ ID NO: 727543 - DNA, 633 bp, Homo sapiens
  misc_feature (23)..(23): n is a, c, g, or t
  misc_feature (508)..(509): n is a, c, g, or t
  misc_feature (512)..(512): n is a, c, g, or t
  misc_feature (516)..(516): n is a, c, g, or t
  misc_feature (533)..(533): n is a, c, g, or t
  misc_feature (554)..(554): n is a, c, g, or t
  misc_feature (562)..(562): n is a, c, g, or t
  misc_feature (564)..(564): n is a, c, g, or t
  misc_feature (569)..(569): n is a, c, g, or t
  misc_feature (573)..(573): n is a, c, g, or t
ggtctagaggatccctggcatgnagtgaggatactcgaaggctggcagcgagctgctgggccccggcagccgtgaacttgttgtactgggacgtccatcacccggagggacaccatgtccggaagcacacgagccaagctctcggctcccacgtcgcagatgcagttattgtacaagcttagcctgagcagggatgcagcgagcggaggcagggcctcggcgagtttgtaggcacccaggtcagtgatgttgtcctgggacagactataatcccagcactttgggaagcggaggtgaggagattccttgaggccaggagctcaaggctgcagaggtatgatcatagcactatattctagcctgggtgacacagcgagcccttgtttgagggtttccaaggacttcagctgggggaaggtggctgagagctgcgagacaccctcgtccccgatcttgtcctcactcagtgcatcgggttccgaatgctgctgggtggtcatggccgtannttncgcnaccagtttggggaaagnctggacactgaatgggatggngggcgtcnanatcgncagngtctccaatgaggacacctccgaaggctggcagcgagctgtgggcccgtgagcgtgactt

SEQ ID NO: 727544 - DNA, 334 bp, Homo sapiens
tgcgaagtgtcaccagagaaaatattcgctggttttatgcatgcgttgccagtccattttgaacactgcgatgtctcgttgtagcaaaagactatagcgagtaacacgtattctcgtactcttaataaacatttcgagagttcttccttagtcgcccaggcaccttctccatgctttgcaagatgcacaggcacacctatccccatctttccccaatgccttctcctgccagctccgtagggtcccagtcaagtgctggcagtgtggggagcagtggggtggctgccactatcagcaccccagtctccatccagaggacactttgcatccagag

SEQ ID NO: 727545 - DNA, 235 bp, Homo sapiens
  misc_feature (80)..(80): n is a, c, g, or t
  misc_feature (196)..(196): n is a, c, g, or t
acctttctcaacctacgcgcatcactagagatgggcatctcggctggcagagcatactaacagctaatgtgcgatctctntggtatgaactttatttattaagcatacaaaaatacagctagatgtaggctctgcattctaaaagcatattaatcaacttaaactatgttcttggaaacccaccacctggactgtncagtctgcccatctccctgtggaatctagtatcagtgtt

SEQ ID NO: 727546 - DNA, 436 bp, Homo sapiens
ttatgtaaatcattgtaagaccaatgtgaatttaaaccacagtgttggtgccagatattagccagggtcacaggctcttttttaaaatgaagtcaaattagttactgatataagttttatattttgtgattttgccatcatactggttatctgtgctcttgaagtctgctggttctcacaccagcagcaagaggcaaggcatgagacattttaaatatatttccagacatctaaacatctagacaggcctgagtcatgattggctctggtgtgcttccaggtaacatcttgttattgctgtttggggaaaaccaccaatagaattgcagctagacttttggggactgtgcctcgcaggctgtatcacttgctgtaggccaagcaacgagcacttccctcatggtagcaacagtccttaagcccaaagccaaaaaaa

SEQ ID NO: 727547 - DNA, 402 bp, Homo sapiens
  misc_feature (383)..(383): n is a, c, g, or t
ggctccactgggtgcaggctggagaataggggcgtgatcattgggtctctacagcctcaacctcccaggctcaagcagtctacctacatctgcctcccaagtagctgggactacaggcgtgaaccaccacgatcagttacttttctttttttaaatttttggtagagacgggggtctcccttatgtggcctaggcgtgatctcaaaggtccgggagctcaaacaattcctccggatctcagcactcccaaaggtgctaggagttacagggcatgagcccaccagtgccgcggctggcagtttgtatttttttacaagccctttctgactgattccaagtgctgtgggaaagctttaccttggctctcagcagtggtaactggntaagaggcgtgatttctaa

SEQ ID NO: 727548 - DNA, 360 bp, Homo sapiens
tagtatagatggggtttcaccatgttggttagaatggtcttgatctcctgacctcatgatcctcccacttcagcttcccaaagtgctaggattacaggcttgagccactgtgactgcctggctattacacattgtgctcttcttatgcaaatttctccagtaggcttaagttcctccccagaaaatgtttttttcttttctaccacatggtcaggctgcaaattttctaaacttatatgctctgctttccttttaaatataagttccaatttcagatactcactttgtgcacacatatatagtgcatgctgttaaaagcaggcaagtcacatattgcacactgtgctgcttaaaaatttc

SEQ ID NO: 727549 - DNA, 420 bp, Homo sapiens
gcggacgctactactactaaatttgcggcctagcggccagtgatgccatctccgctcactgcagtctccacctcccgagttcaagcgattctcctgtctcagcctcccgagtagatgggactacaggcatgtatcaccacgcccagctaatttttgtatttttagtagagatggggtttcaccatgttggacaggatggtctctatctcttgacctcgtgatctgcctgcctcggcctctcaaagtgctgggattacaggcatgagcaccgcgcccggcctaattattgtactttttatagagatggagtatcgtcatgttgcccaggctggtctcaaacttcagagctacagcagtctgcacaccttggcctcacaaagtgctgagattacaggggtaaagcactgcgtctggcctcaa

SEQ ID NO: 727550 - DNA, 772 bp, Homo sapiens
agggtgattcgtgctgactgaagatgaatggtggaggaggaagcagagtgaggaggacgcgtgagctggctgccagacagagtcagaagaggagagctccgagatggatgatgaggactatgagcgacgccgcagcagagtgtgtcaggtgagatgctggacctggagtaagcagttctcgtgagtctaacaggagaacgttgttcatgggaacgactgaagtcagctgcggcttgcggctggagcgaacgtggtggcgctgagagagcccctgaatacactgggagccccttgtggggtgctgtagcgtgacgcctcaaagattcgcattcagggtggcaacgggatctacaagggcttctgtctggatgtgatcaggaataacgtacgaatgtgagctgcagggagccaaacagcacctggagagtgagaagctgctgcttctattacacgctgcagggggagctgcaggaagcggatccagaggctggaggaggaccgcagagccgtggacctcagctctgaatggtgggacgacacaactgcagcgaccagagtgcgagctccagagtcttgggactccctgccgccagcgaggagtgaagagggcaccctctggtttctggcccataacatcgttgtccttgcttcaagagatcgagatcctgggaggactggccagcatcaaagaggtatgtcacttgtgtcccctcagagagaaattgtttggccttgacctgctgtaccagccaggggacctcaaagacactga

SEQ ID NO: 727551 - DNA, 278 bp, Homo sapiens
aacatagtgagaccctgtctccacaaaaaacaaaatagctgggtgtggtggcacctgcttgtagtcccagctacttttgaggctgaggtgagaggatcactctgagcccaggagttagaagcttcagtgagctatgatgatgccactatactcaagcctcgggcaacagtgagcccctgtctctgaaagttcactggaatgctttaacagcagcttaggcacaactgaggagagaactagaaaactagggggttagacataactgacagtagatatgt

SEQ ID NO: 727552 - DNA, 900 bp, Homo sapiens
tgtgtgctgtgaacctgagctgactgtgtgctgtgctggcctgctgctgcctgcaaactctgtgtgtggactgcacctgctccatgcctgccctgctgtgtgccatgctgcacctgtgtcccccatgctgtgcatgcctgagccctgccctgctgctgcactgttctgttgcaccatctgtgatgtgcttgtgcattgcatgtgatgtgcatgtgacatgccctgtgccatcatgcaccacatgtgagtgtgatgttcacaacaacgctcatgcacatcaccactgtgtgtgccttgttgcatccctccttgacccgacatgatgtgcgatccacaagcactgcttgtactatttctggcttgctcgcatgtgctgtgactatccatgactctgacaacatgcaaggatacgtgctctgatgtgaccatgtatcatgctgatgtgttgtacaatggaccactcttgccttgcttgtgacaggtgaatgacatgttgtgctcgtgaatgaatgtgttgcatgatcttcttgacccacttgactttgtgacctgccagaagtgcagcatgagccagggaccttgcttgtcccactgtgagcactctgtgggcatcttttgcaaggcagaactcgaaacaccacactcaatatagtcgactcacaggtactcctgagacctacgtatactctgacaggcacacactgcgagcacttgcagaccacttctgtagcgtagcgcagggtttgggcattgacccgccccctggtgcatcctcgatcggcaactacttgacttcaactccttcctctttacctcactcgcatcgacagccagtgattacattagccacggacccatccgacccatgtacttggacaacgtacctatctggcgcgcagg

SEQ ID NO: 727553 - DNA, 491 bp, Homo sapiens
accctagaggattaataagcggatagggtcggagtattgtgaccggaacacacagatcttcaagaccaacacacagacttaccgagagagctgcgaatctgcgcggtactacaaccagagcgaggcgggtctcacatcatccagaggatgtacggctgcgacctggggcccgacgggcgcctcctccgcaggcatgaccagtccgcctacgacggcaaggattacattcgccctgaacgaggaccttgagctccttggaccggggtgtacaccgcgggtcagatcacccagcgcaagtgggaggcgcgcccgtgtggcggagcagcggagaagcctaccctggagggcctgtgcgtggagttggctcccggagatacctggagaacgggaaggagacgctgcagcgcggggaaccccccaaagactaacgtgaccccaccagccggtcttcttggaccaattgagtgccaccctgaggtgctgggccctgg

SEQ ID NO: 727554 - DNA, 100 bp, Homo sapiens
ttacaaccccacgatcacgtattgaattcaacacacctacaatactatgtccatgcatacttaagtattagtacttgaatacaatacgtgatctgtggcg

SEQ ID NO: 727555 - DNA, 396 bp, Homo sapiens
acagatgtgattctgtggcggggagggtatgtgtgtgattgtgtgtctgtgtgtgtgtctgtgtatgtctgtgtgtgtgtgtatgtctgtgtatgtaacggtgtgtctctgtggcggggggtgtgtgtgtgattgtgtgtgtgtgtgtgtctgtgtatgtaatggtgtgtctctgtggcggggaggatgtgtatgtgattctgtgtctgtgtctatctgtgtgtgtctgtgctatgtaatggtgtgtctctgtggcagggaggccctgtgtgtgttttcctgtcagaatgagcagcgagctgctcttagaaggtgcacctacgagagaggccgccaccctgaatatacatggacatatctcggcgtgcagcatgaatgacatctgaggccaggcac

SEQ ID NO: 727556 - DNA, 162 bp, Homo sapiens
  misc_feature (69)..(69): n is a, c, g, or t
  misc_feature (72)..(72): n is a, c, g, or t
  misc_feature (106)..(106): n is a, c, g, or t
  misc_feature (114)..(114): n is a, c, g, or t
  misc_feature (139)..(139): n is a, c, g, or t
  misc_feature (159)..(159): n is a, c, g, or t
acggcaacatggccctgaacggagctgaagtcgacgacttctcctgggagcccccgactgaggcggagncanagcgtcgctgcaggcgcgacgggagcggcaagcntcgcatcnttattcattattgtttgttttcacnttttacaacctgcagggcangta

SEQ ID NO: 727557 - DNA, 623 bp, Homo sapiens
ccgcggaatcctttgttaagacccgctcttcgtctacgacaagagaccgacggttcttcattcacatacttctattgtcgcccactcgcctaaagatcgacccttttttgatggatggactttttttttgtacaccaaacctcgctcgcgtatatactctccgctcctgtactccgccccccccactttttatactcctcctcggtggagcaacctacttctgatgacgtctgattataaccaacggtttttcacctaggcaccatagatatccaactgtgttcgcgtactcgtccacgtagtagtcttacaacatatacatgttttcgccatcgcccctctttatattctctcctgtcctacaacatattttccccctccaccacccactatggtggtccttactctccctcacctccccgcccccctttttactcacaccactatctataacccctctctctgttctcaccctcgcgagtattacacacctctctcacgctgctgttgttatcaatacacctcgtattctccccctctttttgactctctcctaatttcccctcactcaccccgctacttcctcttccccggtgttttcctctcttacaaaattaaacaaa

SEQ ID NO: 727558 - DNA, 478 bp, Homo sapiens
gcagtgagccgagatcgtccactgcactccagcctggcaacagagcgagactccgtctcaagaaaaaaaaaaaaaaaaagtaaaggacaactaatgaatcaaggaagactttatgggaaaaagtaagatttaacatgctctaaatagaaaaatggtttgctttttttttttaaggtttaacgtgtttatcatggttggcagctaagtagaggaagagccaagtccagaatctaacatttggacttcccctcatttaaacagtggcgttttgccacgttgcccagactggtctcaaactcctcagctcaaacaatctgcccacctcgtcctcccaagatgctgggattacagtcatgagccactacagccagcctacatttttaaatggttggaaaatcaaaagattatttgatgacatgtgaaaatggtataaaactgtgaaatctattgtccataagtaaagttttctttgaacaca

SEQ ID NO: 727559 - DNA, 557 bp, Homo sapiens
gttagacatcgcggacgtggtgacgtgagctgaatgctgcgggagaggcgggcgcctggcctgcagtgttggtgtcagctgtctgctcgctatggctcgtagatcgttgctcctaggcattggcgggtagcctgccgtgccgcctgtcacgtgactgtgtgtccctcaggggtgtcttctatgggtacgtcctggaggtggagcgatgggtttgcaatgaccgccggcatccagcgtgtcgtccgagtcctccgggcccctcacctcacatctggaagcccgataagagccccaagcatgggtcaatgcactggaagtggtgactccactaggcgcgcatggttcctcgctcaagatgagaagcgctagacgtcttgccgcacgttcaatacccctatggacatgcgatccctcatgcggttgagccaccgttgcacgtggagtcccacgggtagtccgctatgccgatcgactcgtcgatccgcgccttggagctgtcaccaccgcgtgggcctagtccttacgccgatccggcgagctcacttgcacgcgttcac

SEQ ID NO: 727560 - DNA, 269 bp, Homo sapiens
atcttatagtgaaagagcacatacgctattctttcatagagccgttcagagatcatatgctaaacaaatatcattagttggcatcaatggcacagatcacttaagaggcattttaagagattatttacaagatgcaaatgcctctgagtgaagtgtatgtcctatcccatcactgaagcccacaggaacaagtcctacaattaacaaaggctcgatggacacatttctcaatcctgaactcccctagggaaggggtcaggagacagtgc

SEQ ID NO: 727561 - DNA, 373 bp, Homo sapiens
  misc_feature (207)..(208): n is a, c, g, or t
cagtggcatgatcttggctcactgcaacctccacctcctgggttcaagcaattctcctgcctcagcctcctgaatagctgggactactagtgcccgccaccagtagtgcgtattaaccgtgttggccaggctggtctcaaacttctgtcctcaagtgatcagcccgccttggcctcccaaagtgctgggattacaggcgtgacatcnntcactagagaggtatttattttgtttgagacagagtctcacactgtcacccgggcttaagtgcagcggcacgattctcggctcaccgcaacctccacctccggggttcctcccaggttcacgtggctctcccgcctcagccccccaagcagccggggaccacagg

SEQ ID NO: 727562 - DNA, 103 bp, Homo sapiens
gaccgttcatattaggaggtggctctaaaacattttaagtctcttatatttatattgtatcatgctatgttatgacctcagaaaacagcaagtgcagaataaa

SEQ ID NO: 727563 - DNA, 1066 bp, Homo sapiens
acacgcccgcgctggttctgccgcgctctaacgtggatcgccgccctcgtcgtctcgcgcttcccactgtcgggcttttccccggtcgctctactccatcgtgggaaggcccttttcggtccccactctacctgctgtggttggtgctcgtccctcactcgagcggaatcatatccgggcgggcgctgcctgctgtttgcacgtcttctcgggcgtcctctctcctttccccgcttcgtttctcgttttccccgttctggcgcggcggtcttcccccgtgtgggaccctccgtgcgtcttgttcccgtttggccgatagccctctcgtgtaaacctcctgttggcctccaacccccttcctggtatatcgtccattacctacgattccgccccctgcctggcgtgtaacaacgtgggtgctgtggctgcgcctgcaacaggtgctgtctccctcttttctcgtcaactgtcggtgggtcacctacatcaactggggcgttcttgcgccagtaacaggaaatccccctccatgaaaagccccccttcttctactcaaataggtttctctacaacacagcccttttgccttccttctggattaacacaatggtctttccacaggggtggaacctcgggtccctatggcgctgggaactgaacttgcgcgggtagggtgacagactactatggggatgctgaggtcaactcctggcgtctcagtaagatggacctagcttatgcgtcgtcatcctagggcttgctctagtctaggtctatctgccgcaatcacgcgctcgactttccactcaagggagccatactaggcggacaagcgttcagctcactacgcccgtgtcccaactccacagtcatgctgcgcgccgtagcagagcacacgcgagaagtgctcttggactgacccctctggtgtgcggtgaggggctttctcttccaccttgcactgctttcagactccgcctcacatttacgccagcacatggatgtggggggcctgggggaggtcacaagcagagtgttttattatatccgccttaggttttaggta

SEQ ID NO: 727564 - DNA, 85 bp, Homo sapiens
cttcccccctcctccctccttgggctttaaataatgttattgtggaggaaaaatgataaattaaagtgatttttgccccttgtga

SEQ ID NO: 727565 - DNA, 279 bp, Homo sapiens
tcgggcgaatactcctcctccttgcgctcagagaagagagagcatgggtttctttaggcctcattcctaattgaaaactcagagatcagaaacgagagacaagccaaggtctacttccccagcaggacagcatcatactcctatatcttctagacatcactcatcttcctcacaatcaggatcatctatgcaaagacagtctccttctcctcggagaaaaagaactccttcaccaactaatcagaggacaataagatccaccataacgacgctctgacg

SEQ ID NO: 727566 - DNA, 379 bp, Homo sapiens
  misc_feature (139)..(139): n is a, c, g, or t
  misc_feature (378)..(379): n is a, c, g, or t
ttccagtgaaataatagaaaacttttattagcagcatccttaaaaagtagggaaacaaacaccccagtctcttgataaaaatgagtctcttgggcccggcgtggtggctcatgcttgtaatccccagcactttcagagncccaggtgggcagatcacaaggtcaggagttcaagaccagcctggccaaatggtgagaccacgcccccccccccccatctctactaaaaatacaaaaattagccgggtgtctgttgtcccagctacttgggaggctgaggcaggagaattgcttgaacctgggaggcggaggttgtagtgagccaagatccaagatcgtgccactgcatcccagcctgggcgacagagcgagactcttnn

SEQ ID NO: 727567 - DNA, 261 bp, Homo sapiens
gctcaatgttacacactccaaactcacgactcaccaatacaccaagacctgtgctccatcgattctaacaaccagctctttgcacctgtgagtgtgcgacttgagctgggtgcaaaggtgcacgcagcgtgacgtgctcagtgagccaatgcccttcagcacgcaagcatacagaaagcttgctgcgccccagctaactagatacttttgaatctgctatctcacgccctatcacacaatactgtgtacccaccagaaatg

SEQ ID NO: 727568 - DNA, 207 bp, Homo sapiens
catcttatcatctgtcggctcattcattgcgctagagcagcagtggaatattaataatcatcatgatacgagagcctctcgtatcgatagcgaaaagtccgtaatagtccaggcaccctccatagagcctggagtgaatatatggatgccccccaccctaccacacattcgaagaaaccgtatacataaaatctacacaaaaaagga

SEQ ID NO: 727569 - DNA, 122 bp, Homo sapiens
ccggtaccaaagttgtcctgtgaagccaagaacgtggctagataagatgaagaagaggatgatgaggacgaggatgacgacgacgacgaagatatgaagacgatgatgatgaagatgatgac

SEQ ID NO: 727570 - DNA, 949 bp, Homo sapiens
gcacgagttggacccgcctgtggtcctgcctgtgagaaaggtccagtggtgacaacgggtgtggtctatagccgctcggcgcggccaaaagggtgttacacccgaaccggtgttgtaaaagtcgcaaccgtctggccatgggccccccgtcatgccgcccttgtaccctccggccaaaaagtccgctgcgttcccccccgaccgccgtttctgggtgtgtaaaaaacacgggcaaccccaacgagtctccagaattgttcccagcaaggacccctaaaaaggaggggtcagaaattaaacctcccactggtgctcaccctcagagctctttagagaactggtaacaccgaaactagacgcgcacaagcgaggaaatcaacgcgggtgcttaaaacacaccgcatcattcttgccaaaagggtccgtataaaagagattaactgtgtgccaggcaccacagggttatacgagacaggcttctctccgggagtctattgctcgaccatttctacatattttatccccccctgtagaaaagattataattcgccctagtatccccccctcttaacaggcgctcatttgggctctagactcccccggtggcgtctccgccctgttttaactcctcgcccctttgagggagctgagtcccgggtcgggaccgcctcgcggttccaggaatttttctgacccaccgctggccccaaatacggcgccaaacactccaatatatgtggaccttgaaataatacctaaaatatattgagccccgagtgctctgcgtgcgcgtgctacctatgactcgcgccgcagttattcgcggcagacgttgcatatctcggaggcacaacgtttcgaccccgtgggggtcgagcggatccctagcagccccagagtggggtacgcaccccccccgcgggcaccaacaaaaccctcttgcaccaca

SEQ ID NO: 727571 - DNA, 236 bp, Homo sapiens
catgactgagatgtccctgataatcattgtagaatgataaagtctctgtgtccttggggcatcactgatagtcacatagtacttgactggtctcaaatttccacaatggagatatcaattgtgtgataccactgttcacgctacagctttcagtttatccaagacccagtgcatacttgaagtgagccctttcccatctcagcagcctccttctcaaatttttcaattgtgttctt

SEQ ID NO: 727572 - DNA, 358 bp, Homo sapiens
ccgatcttatggtcgatcactgtactatacgcctgtgtatcaatctactgagcaattgtggtatttatcaaatctacttttttatttaagaggagagggtcagaatatatagctcaggctgacatcaaactcctggactcaagcactctttctgcctcagcctcctcagtagctgggtataatggtatgtgtacatatatacttatagagacaaggtctcgtactgtagtccaggctggactacagtggtataatcatggctcattgcagcctccaacacctgggctcaagcaatcctcccacctcagcctcctgagtagctagggactacaggcgtgtgaccaccaatgcctatctt

SEQ ID NO: 727573 - DNA, 334 bp, Homo sapiens
  misc_feature (238)..(238): n is a, c, g, or t
catttgaaaactactaatcagaccgggttcagtggctcgcggctataatcccagtactttgggaggccaaggtggaaggatcgcttgagtccaggagtttaagaccagcctaggtaacatagtgagtccctgtatctaaaaaataaaaaaaataaaataatgccagggtgtgatgggcatgtacctatagttccagctacttcagggaagctgaggtgggcaggatcactttgagccnggggagatttgagggcttgaagttgagccgttgatccattcattgcttacttgcacttccagccttgcgttgacagagtaaggaccctgtttttca

SEQ ID NO: 727574 - DNA, 121 bp, Homo sapiens
ctgcggcctgcactgtggcctggcactttctgcgggcccgcggcggcctgccggctgggacctgtgacgactgtctgacgacctgggcgggacctgtgacgacgtgtctgacggaccgacg

SEQ ID NO: 727575 - DNA, 798 bp, Homo sapiens
tccaggtccgctcggtaaccgtttcccgcgcgcccggccccgactccggggtaaagagccccggagcggagcagcgctggccgcgtgccgcctccggagccggcagcgtgagtggccccgcgtccccgcttctcccgtgtccccggcgtgggccgctgtcatccggcacctcggtcctcgtgcctgcctgagccggcgccggacgcgggggataagcgggggatgagcagccgctgtgtcctcggctcaccgagcggctgccctgaggactccgagtcactgtagcccggtcccggcgcgaagaccccgtcggcgggtcgcagtgcatgcgtgcgtagttagcccgggttccggacagcgcagcacggtgtccaggtatgcagcgtgcccaatctgccggggcctggctcggggcgctcgtgccgcgcacggcgtagacgcgcttgaacttcaacgccgcagttccatgacgtgtgcgcgccggtgatacaacggtccccttagtaggccctcgatgcgccccctgggcgactccgcgggcattgccttacccttgaggcaagcagcgacttgtacaagtatcatacgtccacatgacgatccccaagctttagagcctatctccgtatcacaggcgacaagagaaagccaaccgcgtcttcagaccacgaggaacatcaaggcgcggaccaagaagaagcattgggacaacgcacgatttccgacaagccccccaaatggaacatatgaggcccgcgatatacattagagaaagatttgacttcgggaggtagaccc

SEQ ID NO: 727576 - DNA, 302 bp, Homo sapiens
  misc_feature (288)..(288): n is a, c, g, or t
cgatcagaggactccgtcatcgctcttggtgctggaataagtctttccggtcgtctgattagcaggctgtctaacttttggtactttgagtttgtccagatgagtggttcttaaagcaggggcattatttcccaggagaattggtatctctggacatagttgatgtcacaatgggggcagggaggtgctgccggtacctagtgggtagaggccggggacgcctctgagcatcctacgttgcacaggacagccccccacgctgaagaattctctggcccaaaaatgtcnagcagtgttgaggc

SEQ ID NO: 727577 - DNA, 708 bp, Homo sapiens
cgtaggcaacatggcgccagccggaatggcatggtcttgaagccccacttccatagaggactggctagctggggcgtggcacgtggttcaaccagcggccgtaatgatccgtagactgtaaggaccggcaagccaatggagcgccgcatcgccctggcgtcccgcgattgaggtcccattcctggggccatcagtgcgctaggtccccacggtacggtaccacacgaagtgtgcgcgctgagtcgcgaggccttcaagtctggaggatgctcacgtggttgtgacgcgtcatatcacaaagaaagagtggcccggatcatcgagccatttcttgtgagataccgtgaggaagtggctggaacaaagtccacggattccctgaaggccagacgtgtagaggatgaaggagtacgttccaaaatcattctctttcccaggaagccctcggccccatgacgggagacagttctgctgaagaactgaaactggccacccagctgacggaccggtcatgcccgtcggaacgtctataagaaggagaaagctcgagtcatcacttgaggaagagacagaatttcaaagccttcgctagtctccgtatggccgtggcacgcccggtcttcggcatacgggcaaaaagagcccaggaagccgcagaaccaggatgttgacaccagaaaaaataagcctcctggtgacttggaatca

SEQ ID NO: 727578 - DNA, 181 bp, Homo sapiens
tgggaagaagacccacacccaccagggacccaaggaagtcgtctactgtgctgaccgatgacaacacctacagccggggagcctgcttgagggagatgcgctgggacccgtggtgtctacagtgtggcctgtggggcctggatggagcggcatgcgattcgagggcccctcaggatacagg

SEQ ID NO: 727579 - DNA, 253 bp, Homo sapiens
  misc_feature (61)..(61): n is a, c, g, or t
  misc_feature (107)..(107): n is a, c, g, or t
ctcgaggatctccgactagccgaaggtccgttagcttcaccttccagagagggcaggctgnagccctgtgcgtcgcgcctctaagcagtcaccttgtcccttcaggnactggcatctgacgccatccaggtcccagggggcggagtcgcaaaccctaactctggggtgtattctgctcgagctcctctacccctccccagatagctctcccagcctggggcacggacagcacagactgtcgggctagtcgggg

SEQ ID NO: 727580 - DNA, 380 bp, Homo sapiens
  misc_feature (14)..(14): n is a, c, g, or t
  misc_feature (120)..(120): n is a, c, g, or t
cgtcgacagcgcgnacagggttggggcgaagtgcttgagtggaacagagaaagagcgcgatgcacaaacacttgagcgcagcagaagaccaggaggagctgaggggcaggaggatgacangacttcggggatcacattatcagaatcatgaagccaaggatacgctatgggcatgcctccgggatggtgaggaagggccaccgagcgccgagcactcgtgcacgtgcgctgggattacagccgacactgtaaggatacaaagagatggctctgcggctcggagacagctgcaatccccatgacgccagattacaagcatgggtggcagatcgacgtgacttgatgagggcgctatggtgtctatgaggatgaaactagga

SEQ ID NO: 727581 - DNA, 112 bp, Homo sapiens
gtactggatagacgtcctgatagacgtcctgatagccgtcctgatagaacgtcctggatagacgtcctggatggacgtccttgataagacgtcctggatagacgcctacgga

SEQ ID NO: 727582 - DNA, 185 bp, Homo sapiens
tcatatctgcatcttgatatactccaaagctctcagacatgtcctatctctttactaggctccagaatcacattcacctagaaccagaagatctattagcaagatggctactgagttctaaagaacacaaggcttaggtatagactcgagtttctggcgagcacggacttgttaagatctcattg

SEQ ID NO: 727583 - DNA, 129 bp, Homo sapiens
cgcggaccgggaagagatgcgttgcgtgcacatcaatcccgcgagccacaagtcagtagtgatcagaagcacgacttgaccgctgaccggaattccctcatgataacatctctctccctcgggccttgt

SEQ ID NO: 727584 - DNA, 421 bp, Homo sapiens
tttgataagagaggtagtacgtgaggtcacggacagcaagtccaggcgcatgatggcatggacgcaggacaatagccttcatagatagggacattgtgggtgacgccatcacctgaatccaggacgatgcctgtcgtgcggacagaggcatagagggagagcacagcttgaatggcgacgtacatggcagggacattgaaggtttcaaacatgatctgggtcatcttctccctgttggccttgggatttaggggagcctctgtgagcagggtggggtgctcttcaggtgctacacgcagctcattgtagaaggagtggtgccagatcttctccatgtcatcccagttggtgatgatgccgtgttcaatggggtatttgagagttaggatccctcgcttgctctgagcctcatcctaccaaa

SEQ ID NO: 727585 - DNA, 131 bp, Homo sapiens
tacattacccaaagctgcattcattcctgcaggtcgatcgtgtttcaccactgcggtgcatgcctccctgtacaagttccgtcgagacgtgagcaccgtgctgccctccaaatatcgttcagctggagcct

SEQ ID NO: 727586 - DNA, 141 bp, Homo sapiens
cacacgaagtaagtagccagtgctgacttctctagcatgctctctgaggagcgaaaaggaagagttaaaagcagagttcagttcagctagaagacgaaattacacacactacgacacgttttgtcatgcgaaagaaaggca

SEQ ID NO: 727587 - DNA, 124 bp, Homo sapiens
agaggaccgcccggtggccaatggattgaggttgatggactgctctcctcactctgtgctccagacaggaaggtgactccagtgacagctggtggtggactgtgctggcgcagcgctgtgactg

SEQ ID NO: 727588 - DNA, 1204 bp, Homo sapiens
ggacaccaggactccaaaatggcgtcagttgtaccagtgcaaggtacaagaaacttctggaggtcaaactggcgggagctgcctaggctggatcttgatgcgggacttcagtcctagtggcattttcggagctgtttcaaagaggttactaccggtactactacaagtacatcaatgtgacatgaaggggcagcatctcgagggtattaccatgcgtgctggcatgctacgtgctctttaactactccttttcctacaagcatctcaagcacgagcggcttcgctaagataccacttgaagaggactagcgctctgcaccctcgcccaggcccacgatccttgtgcccgaggcccctccgtgaggaacatcaattctcaattcgttgtctgaatcctttcgatcatgccttacataggcagatttaatccttcctagagattaaagacattgtacttgggtgagtgaacactacacgaaagaaatggcttgagaggacaattcttacattgtggcgatgccgggacaaagagaggtaacggagcatagcgcggtacaatgtggtttgcagtaatggtaggtcattcagtgaacacactagcgtttgccttgtgtttcccagacttggtcgcgtgcacatcgatgccggtcataccccattcaatctgggtggttcagctagtgaaaattgcggaggacatacctcaggaggttaaagctggggccaactgcatcgagacttgtacggaccaatacagatggagctcatataccaccaccatgagtggtgaacggtatagaagcgcacgaaacagcatagacaacaactggcgggacatcaacctggaacaggacacacaagcggcgcccagaggtgaactataaaaattaactccatacaaaccccctcgtaacactgtcacacagtcgcccaaactaaattccccagacatctaaaaaacactttatacaacacgaccctcacctcgggtgacaattacgaagctgacagcgtagcaagcaaatgagaaaaggggacaacaaatagcacaatcagacaaatcatgacgcacaccgaagcggcataagagtcagagaagacgaacgaccagcatctaaacacatagaccaaacaaaagatgccgccgcagccaaagggcagaacagtcagataatatcaggagacataacttcacaccagcaaa

SEQ ID NO: 727589 - DNA, 564 bp, Homo sapiens
aagaggaagccctcccgggtgctgtctctctttgatggaatcgctacaggactcctggtgccacaggacttgggcattcaggtagaccgctacattgcctcggaggtgtgtgaggactccatcacggtaggcatagtgcggcaccagggggaagatcatttacgtcggggacttccgcagcgtccactgaggcatatccaggagtggtgcccattcgatctggtgattgggggcagtccctgcgatgacctctccttcttcaaccctgctcgcaagggcctctacgtgggcactggccgtctcttctaagagttctaccgcctcctgcatgatacgcttcccaaggagggagataatcgccccttcttctggctcttagagaatgtggtgaccatgggcattagtgacaagagggacatctcgcgatttctcgagtccaaccctatgatgattgatggccaagaagtgtcgctgcaaacgggaccgcaacttctggggtaccttcccggtatgaacaggccgttgaatccactgtgattgatagttgagctgagaagtgttgga

SEQ ID NO: 727590 - DNA, 725 bp, Homo sapiens
cgtccagctgtcatgagcgagcgcctccagtcccaggaaaaggagaaggaatggcaacgaaaaagcacatccattttccccccagacaagaagtagaacaaagccctgtctttcaggattcctgggacacagagtcttcaggcagtgacagtggtgggagcagcagcagcagcagcagcagtgatcaacagcccggacagggtcagcgggccggaaggcagtcttgagccagaccatgggcggatccagccctaacacgcctcagcccgtgcccgagcagtcctgctgcatgtgccaaggcccgtctacttccacatcaaccagatccctgagggaggcccatttccacagcctacagtaccgagggcggctctgacatagatgtgccggcagtatacttgccttctggtgaagggacagcgctgtgcagatctgatatatcaacttacaactgtgtttgaacagaaaaaatggcaccacgaacaaatggcccctggctatagggccttcttctccaacgctcctacttaattttgaacctaacaaggtttaaccaggccagtcgtttcaccttgatgggtattagctgccactaattgcaattttcaacaggcggctttagacagcacatatttcttactaggattctttcgcacggagggctatcacaatctatgtcacgcgcagctggtatcgaggaacacctcattctagtgtgttgaatc

SEQ ID NO: 727591 - DNA, 497 bp, Homo sapiens
  misc_feature (217)..(217): n is a, c, g, or t
tggcaggtctcttgttcaaactcagttccaagtcccaggaagaaagcagaaagttcccttccacaagggttagggctctccccccaatgtcttaggtccggggttgtgtttagggtggaaaaaccaaaaaatattcccttttcctttccctgtggttgaaaaccccagtcagtggaaaaatgtttggaaacccccgccagtggagcctgggggggcncccggcttttgccttattggatgtccaaacccttgtttttttcaaggaaccgttttaaaaaatttggccccgggggttttcaccttttaaaagtccctccccctggccccaaggaccctgggtcctgttttttaaaatttttatgtttttgtgaaatttccaaagggttttattggcccccatgggttccttcccattttttgtaaaaaaaaaaattacttttttttcctaggtttccccccccggccgaataataaattttgggccccagccctggtta

SEQ ID NO: 727592 - DNA, 341 bp, Homo sapiens
gataagtatttgacccccaaaaaaggaaaaaaattgtgaggtaaaagtttgagcagatggtggtgtaaaaagatgcccaacgctgaatcccagcactttgggaggctgaggctggtggatcacctgaggtcaggagttcgaaaccagcctgcccaacatggcgaaaccctgtctttactaaaaatacaaaaaattagctgggtgtgatggtgggggcctgtaattccagctacttgggaggctgaggcaggtgaatcgcttgaacccaggaagcggaggttgcattgagccaagattgtacccctgcactccagcctgagcgatgagtgatactgcatgtc

SEQ ID NO: 727593 - DNA, 1977 bp, Homo sapiens
catactgtccccaaggtccatccattctcttccttttgaaggctgagttgtgccccactgtgtgcctagaccgcatctggttgacccatccatccgtcgatggacacattatgaatggtgctcctgtgaacactgtgtaccaataagtgctttttgagcatgatcacgtgcctggcattgtgctgggctgcagtgggaaatgaacttggttcccatgctctgggggtaatgttaagaagcaaacaccaatagatgtttactaagagactgcaatatgtcccgtgatgggaaagagcagtgttcggggagagaattatggcaggggtggaggtgggtggctgggacaatggtcaggtctcaggaagtggcctgaagaatggggaggagaggtgggcaggggtggggagggtccaggcagaagtaacaacatgtgtgaagccactggattgcgacagagttgcccgttggagggattgatgcttagatttctgcttcagtgtcttctccagcaagcatcctatcagcctccaggcccacctctccccaccatcttctcctctctgctcttattctagttcattcaaactgcctctttgctcagctatttctcccactgtccagtgagcggcttgagtgcaggaactgttttattttatgtttgcgccttcttttcatatcttagtaggtgtcagtgactctcaaacagatactctcctgaaggagggtagtgctttcactggcaatgacccaagaccatcatctggggcctgccagagtcaggcacagccccggcattagaactttgggctgtaagcctgtcctctgtgcttatgtgggtggtgcacaaagcacttgcaaacatctgtgtgcagtgctgctccattcggcctgctgaagctttcctgccctgttgccgctgaagcagggagtgtgggaagcgcccagctcagagctgggccagatgtggccatacctcccagcagtgcaagcagcatcactgcgccaggccagctgactcggctggccctggtgcacagtgcttaggggcttgtggccacgagccatgccccaccacctctcctgttagccttggtagcttcccagcttcctctcacatgactgtttctgtttacttctccctctggccttcctgcctgcggcgtccctgtgccacctagagtctcatctaccgcactagacatagcctctgcaatggccccgcaccagggcctccttccagggcatatcccgtctctgtctcacccttctagtctgcgcttgcccttctcactccccagctctctctgttactgtcagtggagggtctgtgcactttgtcgttttgatcctatgacgttgtatctgtggctcttccttcaagtgcccaggagaggcccagctcctggggccagaaaggggttagtcttgaagtcttgggttggacatttcaccatggccagcccagagctcggctggaaacagatgagagacaacatgtgaggaggcagacaggagctggggatccaggctctgagcacctgagaggtttgggggaaggtattggtaatggattggattgtgtcccccaacaaaagattttcaagtcctaacccctgtacaggtgaatgtgaccttatttggaaatagcgtctttacagaggtaatcaagttaaaatgaggtcatttgggcaggtgcagtggttcatgcctgtaatcccagcactttaggaggctgaggtgggtagatcacttgagtccaggagttcaagaccagcctgggaaacatggtaagaccctgtctctacaaaaaatacaaaaaaattagccattagctgggcatggtggcatgtgcctgtagtcccagttactcaggaggccgaagtgggaggactgcttgagcccaggaggtggaggttgcagtgagtggagactgcaccactgcattccagcctaggcaacagagcgagaccctgtctc

SEQ ID NO: 727594 - DNA, 154 bp, Homo sapiens
gtgtggcctcgtaaagtgctgcgattactgacgtgagccatcacgcctggctgaagcacagaatttcttaaacctgggaggtggaggttgcagtgagccgagatcgtgccactgcactccagcctgggcaacattgcaacacggtctctcaggc

SEQ ID NO: 727595 - DNA, 1007 bp, Homo sapiens
gatatattgctggatccttgttcatagtgcatctgctttacagaattaacgagaagcagtgtcaagacagtaaggattcatagaccatttgccaaaaatgggtctaagtgcattatactctcttacctggcatagattggtggtacgcagatgaccattcactatgattctgattttcccctatcaagttctatgggcaatcgatcaccaaactgtgcacccgagaaagtaagctgaccctgaaagctacccgaagttgccatgtactgtgatgaagctgaaattgaaatgtgtacccttggtgcctcctggcaatcaaatatcttaccttagtgaataaccgagattgaccatagtttgattgagaacaggcctgttgacgaatgtattcgtgactcttgtgagttgggcctcaatgcatagatcacgagaaccgttctagaaaaaactccagcgtatataaaagggaggagtttcctctctagaattgagaatgaaactgaatgaagacgtgcagtatataaccaagaaactaaacctgacacgagtctgtgggcgccacttcccaaaatctcgtggagggatctgcagctttaatccataacaacggatcaccaaaggctggcgctctttttgcaaggatttggtgaaaccttgatcttaatccagtctccagcacaacaggtgaaagcaggctgctggtctcccgctgctttcaagagggtctttagcgttcgtcgaacatactttgaacctgtggcagtatgtttgagatgcaagaaagtgctttgggaccccccaaatcatctgtctaagcctttctttgaaaaagtttaggctcgaatcctttggagatttaaaggggctaacgatggtggaactcgcgttattcacacacagcgtggtgcgatgacactcggatcgtataacgggtgacaacagaggagcaccagaaacaaaaatgagagaacgcagcatcagtggtgcacacaatcagaggaagtgcc

SEQ ID NO: 727596 - DNA, 353 bp, Homo sapiens
accaactttagtggccttaaagaacatagcggcttaggcctggtacaagtggctctcacctgtaatcccaacactttgggaggccgaggcgggcggatcatgaggtcagggagttcgagaccagcctggccaacatggtgaaaccccgtctctactaaaaatacaaaaattagccgggtgtggtggtacacgcctgtggtcccagctacttgggaggctgaggcgggagcaggagaatcgcttgaacccgggaggcagaggttgcagtgagccgagaccacgtcattgcactccagcctaggtgtcagagtgagactatctccaaaaaataaagaataaataaaataaaacca

SEQ ID NO: 727597 - DNA, 266 bp, Homo sapiens
aggaaaccagatgacaagaatgcaacgactgtagacacagtcttatcatagacagatagcaagacatgcgaattaaaaagcgaatgggtcccggagcaacagctggtggatgcatgagaagtccaatgttaaaattcagagcactccagtcaaagcagtcaggatggaggttgctgctaaaatttgcctccatccttttctcacagcaatgaattagcaatctgaaaccaagtgaacaaacaaaattgcctgaattgtactgtatg

SEQ ID NO: 727598 - DNA, 242 bp, Homo sapiens
tcgagctcggtccttgcttgtctttcactgaacaaaagacactgaatatatacttttcaacatttaagattaaacaaacacataacaaagaaacaattatgtcccatacctcctcaagtattttgatgatttcaacataattttacagtaaggaatttaggagtccatattgtacccgctcccgctcctaggtaggtattcaccaatctccccaatgaggtaagtggtaagaaaaggatttg

SEQ ID NO: 727599 - DNA, 421 bp, Homo sapiens
acacagaggctcgtaaaacaggtatctagcactgtgtacacacatcatgtatgatatagtacgtcatggtttcagacagctatctctatcaggtttgtcaacctgtatatgtatacctttccatcttctcatcagcagaagtaatagaggtaggtaacgtacagtgtgtacatgttaggtgtcacttcaaataggtacactgggtgtcaggtgacgacctccttcaagtaataactcagacttcgtagacgtgccctgtggctgggtgtctatcctgctacatgtctcgacagagactgggtctggctttgcgtatcacagttcatcgttcacagctgtatagtcatagtcatcctccatgtcaggatcctatgcatcttacaggtccttcagatcatcatcgtcctctgccccatcctgg

SEQ ID NO: 727600 - DNA, 258 bp, Homo sapiens
cctgcacttcagcctgagcgacagagcaagactccctctcaaaaaaaaaaaaaaaggtctttcttattttgaatccacaaaagtatgggtttttgtaagaagggcccatgatctggagctatgggatataagtttaatgacagctcttcatatatttgaagatagcaggcatggctccacaatggtggctttcttgaatgaacaaccctggtttcttccttatgaacaggtgggattttggggggcccctatccctct

SEQ ID NO: 727601 - DNA, 770 bp, Homo sapiens
cgtggtggctcacgcctgtaatcccagcactttgggaggctgaggcgggcgaatcacgaggtcaggagatcaagaccttcctggctaacatggtgaaaccccgtctctactaaaaatacaaaaagttagctgggcgtggtggcgggtgcctgtagtcccagctactcgggaggctgaggcaggagaatggcatgaaccgggggggcggagcttgcagtgagccgagattgagtcactgcactccagcctgggaaacacagcgagactctgtctcacaaaaaaaaaaaacacaatttaacctatagaatttgtccattgtggatcccagccaattctgacttcctggatttggaaagcggggactcctattgagatttttgggtttccccttggtatccccgcgcagcttttttccacattaagccaaaaacagaaacaactcgggtccattggatcgactggacctgggggaacgcaaacatacaggtatacacaaaaagaaaatattattcagctggaaacaaattcgtgggcccaggaagggtggggcctccccggctggttaacaccagccacttggggaaggccagggggggtgcatcacttgagggccaaggaattacaaaaacacgctgggcaacatagaaaaacccgatctttcaaaaatttaaaatgagggccggccaaggggtccaaactgtaatccacgcactgggaagccgaggacagggacaccgggccagagtaagacagcggcaactgtggacctg

SEQ ID NO: 727602 - DNA, 112 bp, Homo sapiens
gggggtgtccctactctgtagaatctgggactgggcaaatggtgtggcctccaaactagctgttatgttatgaattctttgtgagttaattagaataaagtcattttcttac

SEQ ID NO: 727603 - DNA, 149 bp, Homo sapiens
tacacggatcccgcgcatcaacgccgcccggaaacacagtctttgtggttcctggggtggagtatggttgcataagctgaatactaaaccggtaatcgacgcgaagaggcaccaccaggagtgtgagcctgcggccttggatgcagtcc

SEQ ID NO: 727604 - DNA, 367 bp, Homo sapiens
ttgacgcactcgcattggtccgcgcctgtacgcagcaggaagtgaacctgaatgtgtccctccagctgcccagccgcagctccaagatcatccaccgtatccattggtattctgccagcctcctgcgactccgacgagaccacggaacatgagggtttcacatgtcgacaagatgaccagaaaaggccaaggcaccttgtacggtggtagacaatagtaaccatgctacaggccacagatcaattcacctgtaataagttcgccctcaaggtcaccataaataccagcaccggaaacagacaagaggtctcatgatgcctcgaacactatgatccttgacgatctgtaccatgtaccggggcgacca

SEQ ID NO: 727605 - DNA, 130 bp, Homo sapiens
agactctagagcacccccctattatagaagtttcaatagcaggtcattttgaacctcaaataagagatcacaatatatagtattaattaaaaaggaaaaaaacattgctgcctcggggcgtctatttact

SEQ ID NO: 727606 - DNA, 1599 bp, Homo sapiens
tcctggcagccgctgggcgggccaggccaggtcgaggccgaggaccgagccagggcacatggacctgggcctgcgaggctctaattgcaggcgcttatgttgatgattattttattataaatcacagacagacccccagattatagcggactgattatacctcccgtgtattggtaaatatgatcacagtgggccgcagcgaccaatggtggaggctgcagactgacgaacatagtcggtggctacgggcgacacggcagggagagactagcatcgagaggaagagacacgttgtaatgtatggagtgggagatgcgggacgcacatacaaaatgtacttaccagatggcaacccatcagaacaaactcactacgatggcactccgactttattaggcccaatggcagggacgacacagaagagatgtaactgacgcgagacgactatcgaggacacgaacggggggcacatggacgagcgcaggggacacagagccatgaacaggatggtgagcctgaatgggaccgagaacgaacaacaaggaaccgaaccagagagttcaagcacaacaggtgataaaggattagaggacacccacccaggaagatcgggaccagactgataccatcgtggacccgccgactgagagtcaccgcaagagatgcaccagaatcagacacaagacagcgcaccggaggcagacaagcgcaagagaagacaagagacgccagagaaagaaaagaaaaccaaagacccgggaagacagataatccacacaccgaagcagagcacagatagggaacaagagacaaacaagggaaccaacaccgaaagaaagacagagcaacgaggagccaggatgacagaacatgcaccatgagacactcggaaacacaggccagggcagccaaggacgagccaccggcgagaagggagaggtcggggacgagaaggaggagaacaaggagaagagcaggcaacgagacaagcgagaacacacaggaatacagcagagagacaccaagagcggaaaggaagcgcaaagggaacaagaggaacaacgagaggaagcaccgagacaacggacagcaaaccacacaacagcagcggaggaaaacgggagacgacacgagagtcgagagcaacaaaacaagtggaagaacaggaaagcagaagaagcgagacagacagcagcagcaacgcagagaaggcagaagaaaccgagacaacgcagagagcagacaagcagcacccagggagctcagagacagacgccggggaccagagaagagagaagcgagacaaggaacaagacagacgccagacgaagagacaagggaagggagaacaagacggacgaaccgaccgacgcgcagggcagccgacacaggcaaagcgcgaaccagcggccgacgcgagactacgagaacgagaaacggaaggataagagaagcaggcagacaggcgcggcacagcaggcaaagacaggcagaagaacgcacgagcgtggaagcacacagagaagggaaacgaggagagcagaagaagaagcaagagaacacggaacacggagcaagcaacaaagaggcaaaccaaga

SEQ ID NO: 727607 - DNA, 1121 bp, Homo sapiens
ggcctgatcctctgggtttgtgctccgttcgtcgcgtggcttgcgttttggctgttgtcctatccgtttggggcggttgcttggtagggctctctattgtctgttggttattggttatttgcgcctgtgcatactgtggccagttgttttgtctttgtgtgttttgtgtttgtaagctgtgttggtgttggtttttgtgtgctgttgtgtgcgagggttgtcggctgccgtggtggttgtagggtgctgggtcgagggtcttgtgtcctggggcttacgtgcgttgcgttggtgtattgtttgtgtagtgtgtgggtccctcttgactagtttgttgtttgcgtgtgcctgtatacgcgggttgttcccgctgtggtgtagttgttagtcatggccgctagttgactgtttctccacgctcgttttcttttaatatgtgggttgtattgtgtttttattgcggtatctgttccagtatatctttcttggtgctgtgatgctgtttgtactggtttctttcatgttggcttctgatggtctccttggcgggattgtcttcacccgatgctcagcgtggtcactgatcgctgcctggcctttgtatgctgcctttgtcctcttgcgattgattttggctttggttaagcatataagtctgacgtgatagacatacctatctacgctgaatgtaaacgtatatacaggtcaattgaacgaagcccatacgttgctgttaacacggtgtgtcttgcttaagagaagttaatgtttgactctttttgtggaatatatatagcagcataggttttcaagaatgatttatccaagagtctatgctcttgtcaaatggagaactggggatattgttgtatttgagaccactgttgttgcctgttgtcctgcgccaacatggttaggtgcacatgatatagattagccctgtgaagttgggtcactgatctatctgactctgtcaagtaatttaggattaaagtttgaagtgtaattacatgttgacttttacaggcatctcagggtggacttcttatgaatagcactgaacctatacaaatgaatcttagaaaacgtttaagatcagagattcttgacctggttcgcaa

SEQ ID NO: 727608 - DNA, 513 bp, Homo sapiens
  misc_feature (351)..(351): n is a, c, g, or t
  misc_feature (474)..(474): n is a, c, g, or t
  misc_feature (476)..(476): n is a, c, g, or t
  misc_feature (508)..(508): n is a, c, g, or t
cagcagtgttctcaccagacagtatagcctcctccaaaatggtagcaatcccaaagattcacaataaaacaaaacctttaagactatgataaatggtttttatttcttttttaaaaacagttcttcctttattctttaatctttaaacactgagttgaaatggatgattgaaaatattatttggggtatattgttgtacacataagagagtaaattttaagagctgaattaaatttctcactctaccttttctttcagtttatttttaaatatatatatttgtagaagcagttatctgccatccggaaattaattctcattttcttggattattttatggtgactactttntaagtattttatcctttagtgaacaaatggtctttctttccagttagaaggtgatcctcaataattatgttcttttctttaaccaaaaccttgtttcaattatgacattttgttgatatgtananattctgaagaaataaaagcaaaaaatattgantaata

SEQ ID NO: 727609 - DNA, 407 bp, Homo sapiens
  misc_feature (13)..(13): n is a, c, g, or t
  misc_feature (124)..(124): n is a, c, g, or t
  misc_feature (134)..(134): n is a, c, g, or t
  misc_feature (241)..(241): n is a, c, g, or t
  misc_feature (245)..(245): n is a, c, g, or t
  misc_feature (251)..(251): n is a, c, g, or t
  misc_feature (267)..(267): n is a, c, g, or t
  misc_feature (273)..(273): n is a, c, g, or t
  misc_feature (275)..(275): n is a, c, g, or t
  misc_feature (298)..(298): n is a, c, g, or t
  misc_feature (302)..(302): n is a, c, g, or t
cccccaaattttnccccaagtcccccaagaatacagaaaatgcttttcccgggggcacggaatcagacctcatcctacacagcagtatgaatgatgttttagaatgattcccctcttgctattnggaatgtggnccagacgtcaacccaggaacatgtaacttggagagggacgaagaaagggtctgataaacacagaggttttaaacagtccctaccattggcctgcatcatgacaaagnttcnaaatcnagggggtataaaatcnaggtcnantaaatcctaataggctttaacgnttantgcttaatccctctctcccccttcttttttgtctcaagattatattataataatgttctctgggtaggtgttgaaaatgagcctgtaatcctcagctgacacata

SEQ ID NO: 727610 - DNA, 136 bp, Homo sapiens
gctgtctgggtcgatctagaggaccccatgagttttacagtgaaatatctgaggttgcggaaggaaagggcacgatggtgttttacagaagcagcaaagaactatcagtgttaaactcatttgcaaaatctgcgtg

SEQ ID NO: 727611 - DNA, 1227 bp, Homo sapiens
  misc_feature (1195)..(1195): n is a, c, g, or t
gaggacttggagaacttggtggtctgagctgtcccaagtcctccggttcttcctcgggattggcgggtccacttgccagggctctgggggcagatttgtggggacctcagcctgcaccctcttctcctctggcttccctctctgaataccgactccaggctgggctgagccaagccagagtgccacggcccaggagggtgagctggtgcctgctttgacgggccaggccctggagggcagagacaatcacgggcgtcctgcacagattcccaggccagggctgggtcacaggaaggaaacaacatttcttgaaagggaaacgtctcccagatcgctcccttggctttgaggccgaagctgctgtgactgtgtccccttactgagcgcaagccacagcctgtcttgtcaggtggaccctgtaaatacatcctttttctgctaacccttcaaccccctcgcctcctactctgagacaaaagaaaaaatattaaaaaaatgcataggcttaactcgctgatgagttaattgttttatttttaaactctttttgggtccagttgattgtacgtagccacaggagccctgctatgaaaggaataaaacctacacacaaggttggagctttgcaattctttttggaaaagagctgggatcccacagccctagtatgaaagctgggggtggggaggggcctttgctgcccttggtttctgggggctggttggcatttgctggcctggcagggggtgaaggcaggagttgggggcaggtcaggaccaggacccagggagaggctgtgtccctgctggggtctcaggtccagctttactgtggctgtctggatccttcccaaggtacagctgtatataaacgtgtcccgagcttagattctgtatgcggtgacggcggggtgtggtggcctgtgaggggcccctggcccaggaggaggattgtgctgatgtagtgaccaagtgcaatatgggcgggcagtcgctgcagggagcaccacggccagaagtaacttattttgtactagtgtccgcataagaaaaagaatcggcagtattttctgtttttatgttttatttggcttgttttattttggattagtgaactaagttattgttaattatgtacaacatttatatattgtctgtaaaaaatgtatgctatcctcttattcctttaaagtgantactgttaagaataataaaatactttttgtga

SEQ ID NO: 727612 - DNA, 282 bp, Homo sapiens
aggctttgtgggttcagtgagattctcaggcctaagcttcaatagtagaaacggggtttcaccatgttggacagccgggtcttgacttcttgacttaaggtatccacataccttggcttcacaaagttctggattctcaggcgtaatccaccacacacagctgattaagtgtttaaatacaccttttatatgtctaactcgaggtaaaagtctagttatatgaaactctccctctttctcactctcctctcgtgccatattcgtacagcccggggtatccac

SEQ ID NO: 727613 - DNA, 543 bp, Homo sapiens
  misc_feature (17)..(17): n is a, c, g, or t
caacgatggtcctcagnctggtctgacgccagtacatggcatttggaggtattcaaactgcacacaaaggttaaacagggaaagaggttggacaaaaacactcagtatttatacaaatgctctgttcaaagacattacccataaagttatgcatctacacagtccaatgtcaggagaccatgatagtgaatagtgcaagcctctttcaagactttcttctacatccaagaaaaaagctgaaggacatacttaaaatactttttgagacggagtctcgctctgtcacccagactggagtgcagtggcacaatcatggctcactgcaacctctgcctcccaggttcaagtgattctccagcctcagcctcccaagtaggtggaactacgggcacatgccaccacgtgtggctaagtttcgtattggtagagctgaggaccatcgttgggtcctcagctctgtgagcgtcgtctcagcagatccaacctcagcagactgtgtggggaccactgtggtgctctgctcaatctgctgagaccagtaca

SEQ ID NO: 727614 - DNA, 654 bp, Homo sapiens
actgtattcatttgctaaattttaaaaggattttgaaaaaaataaagaggatttgtgtctagatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaagaataaaaaaaagaaaaaagaaagataaaggaagaggaagagggaagttggtggtagtgagagtggtgtgtgtattgttttgtgtggtgaggactgtatgtggtagtagtgaaaagtgtcgttgtgagtgagtgtgtaatgatgtttcagtgatagtagtttgtgtcgaaaattctttttagtttaagagaggcaggaggaggcggagaccgaccaccaagcaaaagcaagacgccaccgaaggaagcaagaggaaagagaggcaggcaacaggagagagcaagtgcggaagacgacaagagaggcaaatcaagagggaaccgacatcgacacaaacacaagcgaaaaagagaaagacagaccagacaagctcattaggacgtcgagaggagatacgagcaaaagccaaagacagcaatacgaaaccaactacatagaaagaacaaacaccagaccgcacaagagacacgcgagcgg

SEQ ID NO: 727615 - DNA, 83 bp, Homo sapiens
acatccgtgcctaggtgcccaagtgtggtccggtcaatgtccgacgttaactggtttccatgaatccgtcaacagtcaacgat

SEQ ID NO: 727616 - DNA, 373 bp, Homo sapiens
gacttgagatcacttgtcactttttattgtattttatcttttgtagataaatgtagaaatacacggttctggggagctctgttcccttccatctgaaagggtacaaggagtgttgtagcttctgaaggggcagaaaacaatttctaaaaatgcttttattcctgggctaatcctgtccctccctaagacgcagcgaggtgtctgtcccagggctggagatgcttcccaaggaggagtctgttttgttgagagtggacgagggcttcttcacataagcctggggaaggaagaaaaaacggctttcattaccaaataatgtaaaacctcaaaagcaagggcttcaacagccttaaccaaatattattcgggtacc

SEQ ID NO: 727617 - DNA, 322 bp, Homo sapiens
ttgagaagttccatagcaaggcatgcactatcacaactgtgtaaataccggtgttccaggtacataccaataccaaattttgtcgtaataaagattgaactttgtacgcagtctgtgtacctccttccctaagcaagttcacgcaagctccccatgttagtccagttgctttatagtgttcggtaggtctatgggtttccttctcattaaaacttattcctggccgggcagcagtgggtcacacctgtaatcccagcagttggggaggctgaggcaggaggatcgcttgagtgcaggagttcgagagcagtctgggcaagat

SEQ ID NO: 727618 - DNA, 436 bp, Homo sapiens
tatcccccacaggggttcgagatgcttaattactcctgctaacttcagtctccctgttctgctgtcgtcactgcacaacatgattttgatcatagcaatcatagattaactgcatacaggagccgtcactatcgctgctttgtaaacaagtgctgtatcgtcaggcagtatgtttggaaaaagtcatccccatcctccattcttgattaaccagggacacagtgcactgcagaaagccgcaggacctctgcccaggaaagcctgggattgtccaaggtttccccccactgagacagccggagatatggcctcgtgcgaaaggaaagatctaccatcccccagcccgacaccagtaaggggtctgtgctgaggaggagtagtgaaggagggaggcctctttgcagttgagataagaggaaggcatctgtctcctgct

SEQ ID NO: 727619 - DNA, 416 bp, Homo sapiens
ggtctgtgtgcggaacttagaaaggaggattgagagtgagatcaggctgagaagaagttgccaagatgctcgaaaggcaggaggagcttatctatgaaaaagcaagccatcacaaggatataggccgtgtcagaactgaattcgaatgggaggatggcagaaaagctggaacttctatgtacctgcagaacccaaattggcgtttgtcatcagaatcagaggtatcactggagtgagcccaaaggttcgaaaggtgttgcagcttcttcgccttcgtcaaatcttcaatggaacctttgtgaagctcaacaaggcttcgattaacatgctgaggattgtagagccatatatagcatgggggtacccccatctgaagtcagtaaatgaactaatctacaagcgtggttatggccaaa

SEQ ID NO: 727620 - DNA, 290 bp, Homo sapiens
gaaagaacagttctctgcgcgtaaataaagttcaacataactgtgccattcttccaagtagtgtacggtacatattgagcagacggagatgtacttccctcacacagtgcattgaaactcctattgaaccaaacaacgaagaaatcagaaactcactgatatcttgattgctacaaccatttgctctctgaacaatcttatcctcttcagacacaattaaagccaaatcactaagttaagccgagcactgggaatcaaaaatgttactaaacctcaggaaatgtccgctg

SEQ ID NO: 727621 - DNA, 521 bp, Homo sapiens
ggcgggcgcggtggtcacgcctgtaatcccagctctcagggaggctaagaggcgggaggatagcttgagcccaggagttcgagacctgcctgggcaatatagcgagaccccgttctccagaaaaggaacacacaaaaacaccaaacaaaaaaacacccaagggcccaaaaaaaaacacaaaaaaaaaaaaaaaaattttggggggccccgcggccacaaaaaaaatttttaaaacacactctgcttgggcgggcgcgacgggaccccgaagagtgtatgagcagacaaggtgtggcacgaacggggctggccacagagaagaaaccccttgtgccaaagaagacaagtgggcgtgtggtgttctcccacccagaaaaaaagaagcgggcggggggggaacaacagcgggtgttgtcgagaacaccccagcagaggggaggcaggagacgacaagagggggactacaaacaaagggggcccccacgcagggccagagaaaaaactccccgcgcggcggtggg

SEQ ID NO: 727622 - DNA, 132 bp, Homo sapiens
acgacctggatgacccatgacattgtatataggtaatagcttatctagtcaggttaggtctaggaggagtaggggcaggtttgggctcgtaaggaaggcctagatcggggattgtgcggtgtgtgactgcta

SEQ ID NO: 727623 - DNA, 1078 bp, Homo sapiens
  misc_feature (364)..(364): n is a, c, g, or t
  misc_feature (373)..(373): n is a, c, g, or t
  misc_feature (457)..(457): n is a, c, g, or t
ctcaacgctttatacttctgtagttgctttaatgcccagctcaaacgtcatctttttgtgaacttttccccaaccttctgaaatagttaagtcttctgcatttccatgccaccatgacacccttctatcggaacatttatcatattacattctaattatttgcatttaagagtacacttctatcttgagtttaaggttacaggagagctcactttattacactttgaattctaaataccttaacagttttatggtacaaaaaaagcaccaatgacttcatttagacaaatgaaatgtttcgtgtatatctaaggaaataagttcatagcaagcagaatctattctttattcttctgtaagtatngcctctatnacacctatagcactgtaccatgattccagtctggaagaggatctgaggatgtagattagattatacctggtctgactggatcantggaatatttggggcgctaaagcataaatcatgggtaatgaattagtttctttaaatagctttagcgagcttggaaaattagaaagtgcagccaaaagagtaagtatttgctgagtgtcaagtcagtgatgcaaaaataatttattacagaagctcagagcagggcacagttacagaacaccatcatgctgtggaaggttaagaatggagtgagggtccgggtatgggactgaaggaccggcacttaatgctgttgctgggaacgtggaaggtaggtagagcttaaacaaatgaaggacagcaggaaaagcacttgtggcaaagagaacgcaaaagcttggtctgagaaaagacaagcaatgttcagaagatatgaatttaagtttctgtaaaatgctataccgtcaaagatagataaaggagagaaaatgtgtgtctgtatgcattggggtggtccaggcctgatgtgaatggcaactaacagctgtacctaatgtgtgccagcatagtcagaagtttttaatttagctctcacaaagactaagtctaaagtagctcctgacagaacagattttaggtaatctgccccaagtcacatggcaaatgttttgtgaggtctgt

SEQ ID NO: 727624 - DNA, 158 bp, Homo sapiens
  misc_feature (63)..(63): n is a, c, g, or t
  misc_feature (68)..(68): n is a, c, g, or t
  misc_feature (76)..(76): n is a, c, g, or t
  misc_feature (98)..(98): n is a, c, g, or t
  misc_feature (103)..(103): n is a, c, g, or t
  misc_feature (144)..(144): n is a, c, g, or t
atcgatatgcatggagtgaagaaccaatcaaaagcagatgcagatccaactatatcaatcgtnacatnagatgtgnatggagtcaacaacccaatcanaagcngacacagacccaactatatcaatcgtactattagatgtgantggagtgaacaacc

SEQ ID NO: 727625 - DNA, 225 bp, Homo sapiens
acgcatcatacacaaatagctacagccagcctattatcttcgatggacggcgtgtcctggatgaactccagaatgaactacacaccattggcttccagatagaaacaattggcaaaaaggtgtcttcaaagagaataccatatgctccttctggtgaaattccgaagttatagtcttcaagatccaactaacaagaaacctaaagtgtatagattgctcagcgct

SEQ ID NO: 727626 - DNA, 1173 bp, Homo sapiens
tggacaatgggaatttagttttaatttcataatcataaacttaactctgcaactccagcataggcatgtgggagggaacagggaaaacatgtggaacccaaggggaacgtgcagcgagagcacaaagattcataggaatacgtgcgagcaaagtgggggtggagggggtgctcttccgtgagctacagaaaggaagtgatcgtgggtggtttaagataaaacacaagttcaaacttatctcgagttgtgtccacagttcagcaatggggtgactctctctgggcgtggctcgtggcccattctccgtggcacccaagaggcgcctccagtggccttccaacaaatactctcagtgccttctctttctacatttgtggccaaacaccacatgtgctgtgcacatccaaaccacttcgagtcgtggcgcagtgtgcacgatgtgaacaaaccgtgcggaaccatttgggtgttggggtctccgagcatttgtgccatgtggcacaaaaagtgccaggaacccgatagtgcttaaggagtgaaggttcctcatctttccaaattttctccccaatagaatgtggactgtggccaccagtggcccatcaagtgggcggggtgaagctcaccaccgctgacacaataaacccgggaaataactcgggtgaacagccgggaacccttataaccaaaatcctggaagacatcacccaagagggcgtatggggacgacattcctaccaagagagcctccacatattgactgggggaacaccccctgggaacatcagagcacttatctgggccaatgggccagagggacaccacgggcaccaggcagaaaaacacaacggagggcccctatggagccctctggggggacaccacgaaggagagcgcagcgacaccaatgaaagcacaaaggcccgcggggggtgtcaccaccaggagggccagccgtgctgtgatgtgatccagccagacgagtacaaacaacccgggggggggagggaagccaccgaaaaggctgccacacgagactggacaagagttcgtggagcaaaaagaggcaagaactgaccaaattttcccccacagaggcaacacctggaacacaagacaactaactaacgtgtctcagctaacacatcaggccacagcgtacgcggatcacat

SEQ ID NO: 727627 - DNA, 468 bp, Homo sapiens
gtgtttcaataggagagaagagactgtgggtggggttttttttattttattattattttttttgagatggagtttcgctcctgttgcccaagctggcatgaaatggcacgattttggctcaccgcaacctccacctcccggggtcaagcgactcccctgcctcagcctcctgagtagctaggaccacaggcatgcaccaccatgcccagataattttttttttttttggtattttaagtagagacggggcttctccatgtgggtcaggcgggtctcaaactcctgacctcgggcgatccacaggcctgggcctcccaaagtgcgggaataataggggtgagccaccgcaccaggggggtagagtctaaatcccttaggagataagtgggcggggaagcaatgaataacaccggtattacacagatgtccaacgggcagtttagggataggttaagtaagaaaggtggc

SEQ ID NO: 727628 - DNA, 153 bp, Homo sapiens
agtccaggtctcattctaggagcctacaggactgttctggtagggtccaagggtagcacactataatctgcatccaagacgtaccgcgccatgagtagggcagtccattaggacacccaagaccagcaggctgacatccatcagatagaagtc

SEQ ID NO: 727629 - DNA, 162 bp, Homo sapiens
ttctatttcgagagtttaaaatcgtcttttttagtttattgattccacaatttccttcccaaaggaaatcaggcagctgagaagatatgacatgtggttgatacacataatcaacctcactgacaacattctaaagctccttacaattttttttattttttt

SEQ ID NO: 727630 - DNA, 642 bp, Homo sapiens
gatccttgctgaggctggggcaaccagcggagtgtcgagacagcgaggcgcgatcaagtggacagtcgcgggatgtgcagagcgtgcggcgctggatggagctggtgataacttcagggatgagtctgcgtgcgaggcctcgaagcagcagaaggccagcgccgagctgatcgaggaggaggtggcgaaacttcctgtaaactgaaggcacgagcatgggtccgtgagtgaatggcagaacagagagatttgtgcgtcaagagccccaagggcacaggagacttatagtccccggatggtatggcaggtcgtcgagagggtgtttgacgtatgtcatccgttgcttcatgcgccagcgggtgcatgaagctcgattgattacacctgtatttgagactagaaggaaacgactgtatgggaagagtatggggggaagagtcctcagcttatctattagctgaaggaacaaggaggagagctgcctgtcccttcgctatgacctcagctgtctccttgttgcgtcggatattttgtcccatgaaatatgactgacctaacaattaacacgactgacgatatagtcaacaggtactaggtcggtgggatgaagccagcgcatgagccgggacgaataccgggaat

SEQ ID NO: 727631 - DNA, 390 bp, Homo sapiens
  misc_feature (22)..(22): n is a, c, g, or t
  misc_feature (387)..(387): n is a, c, g, or t
tgcttttgcttttctcctaatnccttgccctgactgggatgtactgtggcgggctctttactcgacgagggctttaaggtttatcttgggccttgcgagctctccgctgacttcccttacgctaaccaacctcggcccgccgcaaacgggaaggtaagccgccggaaggcggaaagcttgctcaaggggaaacggaatggaccaagcagaggctagatcatgaacctcgctaccaacgagcttggggcctaatagatgataactcgggccctgaactattattatacgctttgctttgtttggatgcttttaatgaccctagcacgcttaagcctctctctggcggcgatcacttgatctagcgaggctttccccaacaaaagaagnctt

SEQ ID NO: 727632 - DNA, 1173 bp, Homo sapiens
  misc_feature (304)..(304): n is a, c, g, or t
agcaagactccgtttttaaaaaaaaaaaaaaaacacaaaaaatctgagtcggcttattcttatttccactcccttaatggctaacaaatggcttttatcattccctcactttcattggcccagccttaggccaagcttctgtaaaggtttcttttacatctcaaagctctgaaaatacctggtttccacctggctttcggcattaagatatccgtgaggtaactagtatcttcactctagacttgtctatatttcatttagatttctacttgtttagagaccggggagttctcgcctttgttcngccacaggctgggcagttgcagtgggcgacaaaatctcttcgggttcacccgggaaaggctctccagccactcctgttggggttgacgcgccatttcttcactgtgccttcaggctcttctccaaggttacgctggggaacataccgggtgcaacccagctcaaacacaattggcctgtggctgtaaatttttctggggacatctcttgtcaacgttaagaaaaaccgccaatatcttcaataactctcaaagaattcctacaataaattttaacccccaggcggcatttgtgtttgtgcaccctggccgacgctttatttagggcccacaaagggccatacccgttgtgggactagcaccatcttgagaacggggccacgagcacaagaaacatttccgggtttgttgaaacaccccctggaggtggatcgcgccaccacaaaggggttttacggccggagtttggacacgctcgtgagcacactcattcttgggcccccatctggggcgcaacccttaaaaccagcgtcctctggggggtgccagaacccaaatcgtgggcgtttcggaagagaacttccccggggttgctttccaaaaggacataaacacacattcaacaagacatgttcttctccacaagaggtgtgagagggcccaaaaaagtttttttataccccccctcatcaaaagggggggcgttactatggtactgtgcacacaattatatcgacccccgggtttgtagcacataatatacgagtggatccactccgattgtagatgtcggcacagtagaaagaatgcggtttcatttagacgtaaacccggagttgtgatacatccacacaatgtcgggtgcgcagac

SEQ ID NO: 727633 - DNA, 412 bp, Homo sapiens
caagctaagtcgagaccgaggctgagagacagctttgttagaattggagctgttctccaactaccccctcctttctctgcctctccaaaaggggcagagctaggcttggggtatggtcaaatgtctctttccaggaattttcatcctgtcatctatgcccagagtgttgaattagggtactggagtgttagaccttggtgacattttctgacttgggctgttttcttagagtagccgcctgcccaggctgtggagttgaccattctggtgggcgtgtcagctgtggctgcaactcctttggaaaatgcctgctcctgtttagaaggctgtgcctgtgttcattaaagagtcactggtgtcctgttgtgttggacacagtcaaggcacaaaatcaaatcctatccagtatctg

SEQ ID NO: 727634 - DNA, 467 bp, Homo sapiens
  misc_feature (9)..(9): n is a, c, g, or t
  misc_feature (11)..(11): n is a, c, g, or t
  misc_feature (17)..(17): n is a, c, g, or t
  misc_feature (52)..(52): n is a, c, g, or t
  misc_feature (56)..(56): n is a, c, g, or t
  misc_feature (62)..(62): n is a, c, g, or t
  misc_feature (88)..(88): n is a, c, g, or t
  misc_feature (141)..(141): n is a, c, g, or t
  misc_feature (174)..(174): n is a, c, g, or t
  misc_feature (224)..(224): n is a, c, g, or t
  misc_feature (234)..(235): n is a, c, g, or t
  misc_feature (237)..(238): n is a, c, g, or t
  misc_feature (302)..(302): n is a, c, g, or t
  misc_feature (317)..(317): n is a, c, g, or t
  misc_feature (349)..(349): n is a, c, g, or t
  misc_feature (366)..(366): n is a, c, g, or t
  misc_feature (380)..(380): n is a, c, g, or t
  misc_feature (385)..(385): n is a, c, g, or t
  misc_feature (433)..(433): n is a, c, g, or t
taaggtgtntntttttntttaattggttttaagttagtttaaaggtaagctntggntgcttncacccattcccagggagaccaaaagnttttatatattttaagttgggggataaaaagggggaaggggggggacgaaggnttattatttaaaataaaaaaaaataaaaaagtnttaaggggaagattaaaaaaattttggattatataatttaaacgaaaggnatgttattanntnncctgtgtggatttgggagaggattgggccattttttttagagagaagtggggtgggttttaggntgggaagggattttntgttaaaacgcattttatatttggaatgattnttaaaaaaacaacaatntgcaattaaagttnttggncacattgtgaactttgggggatgctcgctccaaccgattgctgttacntttaccgtttcagtttttaaattttgagttaagc

SEQ ID NO: 727635 - DNA, 270 bp, Homo sapiens
cgaacgggagcgccagtccaccaaccacttggacctctagcaaaacatatgacaaccatgtgggcacttcgaaggcagcagcccagagccagaacctgagtcctctacaatggctttagacgtaactcgtcagactacaggactgggtccttcagcagtttttgcggagccgcggaggcagtgccacacggacccccaacatgactgccagttccaaatccaaatcccagcacctcgcttcgcagacccagcaggaagggcaggccccac

SEQ ID NO: 727636 - DNA, 1353 bp, Homo sapiens
tgcagtgcctgctgctgaggagtgccacctgaagctcgtgtggacgcgagtgagcctggctgtggccctggaaaggactgcccctgatcctggactgctggtgcagcgcatccaccatgctgcagtgctgatgctgctgctgcagggcttccgccgactggagtgagtggtttggcgcctggtgcatgggccttgagagcctgtgtgtggctgcgtgcctcaggggtccccacgatgcctgcagatggccacacgacatgtaccatgctgcaggctggcccttgactcacgacttctgcgctgctacctggcagcacagttgcactggtggtgacgccaggggccctttcgcctggcctgcccatcgccgcgttgagggttgcttggccgtgttggacatgccagggagcttgcgtgctgtggcccttcgcacaggtgccgagcccggctttgcttctgacccgggacaaactgttggcggccaggcgctgcagcgaggcttgtgacggcacgcaacatcctgggcgttggtgacaacgggttggggccccttgcctgtccagttctgaatggtgaggaaacggcccaggaaggcttgggacgtggtgcccagggcagcgaaccgacttggctccggcacttgccagccaagcctgacgacctattgcacggtgtctaatttacacaccccatttgtggcagggcgcgaatacaaggctgaaggggttaccgtcggaaggtgaacgccttaagcggatctgtgatatgcgggcacattcttggccctgacgtttcgcaatgagccggctcccccccacgtgtcaatgcctggcacggagcgtcacccactggggcaccaccgtgtggccgtgcaatgccagcccaaggcacagaccctaagcgcgcggcgcgggtcgggcatggcggaccgaggcccccaatgctgggtgagtgaccgtctcctgcagacaccgagaaaacgacccaagacgcaacggctgaccgcctcgggggagacacacgcaccacccacgcgcaggcacacacgaacgacggacgcaacacaagcacagggggaaagtgacagccagaggagggacgaacagcacggcacgaccctgagagagaggggcgaccagacgcgcgcgaagacgacggccgcgcatcacaccccaggaggccacggggccgccgggctgaggcgaaccactagcggggcagaccgagcccccaaaggggccggtgggcagcacacgacagcaacgccgaccggcgccgcggccaacaccgagccagacgcacacagcggcgtcagagcggagaggggacgagacagggcgcgcgcggagacgg

SEQ ID NO: 727637 - DNA, 279 bp, Homo sapiens
tgtgtcgagtaagcactaaacgttctactaactcactctcactggccaagaactatcaaaatcctgagccaacaaacttaatatgactagtttacgataatacgcttttatagtccagatatctcttcatggactccatttataactccctaaagcccatgtcgaagcccccgtcgctgggtccataatacttgccggcattactctttaatactcacgtcgagactaggttataatacgcctcacactcattctcaaccccctgtataaaacacatag

SEQ ID NO: 727638 - DNA, 403 bp, Homo sapiens
atagctctttcactgtagaaaacattatcattatatactatgtaacagcgtgcaaataatacaaaataataatataaactataggctattagattactagtcctttgaaaaatatttctggaaggccgggcacggtcgtcacgcctgtaatcccagcactttgggaggccgaggtgggtggatcacaaggtcaggagatcgagaccatcctggctaacacggtgaaactccatctctactaaaaatacaaaaaattagctgggcgcagtggtgggcgcttgtagtcccagctacttggggggctgagacaggagaatggtgtgaacccgggaggcagagcttgcagtgagccaagatcacgccactgcactccagcctgggcgacagagcaaaactctgtccc

SEQ ID NO: 727639 - DNA, 694 bp, Homo sapiens
  misc_feature (168)..(168): n is a, c, g, or t
aataataaatgaataaataaataacctttaaagttgcataagggaaaataagccaagtgcccctgccagagattattatcaacagtcatttgctccgactggcagtcctttaaaaaaaaatacgaagaactgagatatgaaagactttaataccaaagtagtctgaanaagattcgagcttgaggctccataaggaaacacgtcatggagcaagagatttgtctatggtagagcctgatagaaatgttgtacgtggtggtaggagtctgtggacatggtgtatttgcaggtgatatgggtgaatgagaaatgaccctgtaatgacgaaggacaggaagcaggttggcatagccagtatcgatgcgacatgctagtacttaacaaatgctacttgtctgtgctatagtagcaaattgatgcagtgatgtgaaaatatgtctggagactttggctggagtggagaagggcagcttgggaagtagatgctctcttaaatcttgcacaaacatgtagatctgggcactaattgctttctccaggtctgtgcactttaactgttgacatttcctaagtgttcttatttaatataagagtaccatattcttcaatagacaagatatattacaagtctcaaatctgtataatagctatgaaaaggaggacaggtaaaagaagggaatgaggatgaatatac

SEQ ID NO: 727640 - DNA, 1101 bp, Homo sapiens
gactaccgactgcagcactgttattactgggatcaaaatgcagtgaggcctgggttaccccaagctcatccccatgcactgtctgcgtggctatcagaggcgcccacatcgattgctcgtgctacacccggctatccaacctgctcaaggtcgacagacgctaaccctctgtcaacgtgtatgctcatgtacatggtgcgcttttatgatcgtgagtggtcctgttaccctgagtatagacctcgaataaaatctctgtacagggcatgtactactaagcaatcccggatcaacagtctttcatgccacgccattgaggaacatcacgcgtgcccgatacgtcttactcgtgagcacgtagcacaacgaggctcctaccttcatccgatggcggtaatactagttacctggtgatatcctcgagattgcccagtgcgcaggaccccatgtcgagcagtcgacctgtaaatacggctggcgacgcgctaatcagctgtgtttttgtacacacttttgcctactgtctgcggacaggggaaaaacctgacgatggcatatgtcttcggagccgttcatccttactgaggagcaagacatcgtcgtgctggtttccagatgaacgtgccaagtcccagtataaagcccggcgaccgtggcacagcgtgggtgaccagtgcctaacggtaggactcctcgcacatggggtttgggcccgttctctacatctcatggtcagtgttaccacccccgatccgctacttaggactaaggatagtcgaaaccgtttgaggagcaattcgagaaacggagaaaggcaagcgcagtccacgagcgagggccaaaatccctgtggaccgcacaacgagaatgtcctcaacggagaccatacctgggccagtgatgccttgtcccttgttacctcccagatgtgtataacctcactttttgatgccctcaattctgattgcttacgtgttggagtgtgtttgatgctgcccacctgttaaccccatccagaggtcccactatgttctcctggacgacagtactaaccgggtcaatcttccgcacatggggagtggaccctgtggacaatccata

SEQ ID NO: 727641 - DNA, 198 bp, Homo sapiens
tgcggtgcactctcgcggctccccgcggggcacccatccacttcagtcagtgcattgttccacgtgcattgttccaagtgcattgttccacgtgcatggttccaagtgcattgttccaagttgcatggttccggcgcgtgggtcccgcagctcgcatttcgtcaatctatggtctatcagctgtttcccagtgcttgt

SEQ ID NO: 727642 - DNA, 241 bp, Homo sapiens
aagcagttaatacagactcatttccatccagaaagacctgatcatcatgtggctcaagtttgaattttttcttagttcccttcttttaaggagtcctggagttcctccttttgggatttttccttttcaccatctttttttttctctttttcttttttggtcttctcatcctttatattttctttctggctctttttatcttcttcttttccactgagtctgtattaactgcttggggtca

SEQ ID NO: 727643 - DNA, 277 bp, Homo sapiens
ggctgtccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaagttcatgaaccagaggaagttcaagaagaggagaaaccgagacccaaactcactgctcctaagatcccagaaggggagaaagtggacttcgatgacatccataagaagcgttagaacaaagacctaa

SEQ ID NO: 727644 - DNA, 146 bp, Homo sapiens
cctccatcattcccacccgttgttgctgcctcatcgtggtgccgctcaggttcaggggctctccgccatctctagacctctgccctcgctgctcttggacattgcagcccccaagatgctctctcccttctccaatgcaaggagcc

SEQ ID NO: 727645 - DNA, 804 bp, Homo sapiens
  misc_feature (435)..(435): n is a, c, g, or t
  misc_feature (477)..(477): n is a, c, g, or t
  misc_feature (515)..(515): n is a, c, g, or t
  misc_feature (535)..(535): n is a, c, g, or t
  misc_feature (610)..(610): n is a, c, g, or t
  misc_feature (612)..(612): n is a, c, g, or t
  misc_feature (643)..(643): n is a, c, g, or t
  misc_feature (649)..(649): n is a, c, g, or t
  misc_feature (666)..(666): n is a, c, g, or t
  misc_feature (682)..(682): n is a, c, g, or t
  misc_feature (685)..(685): n is a, c, g, or t
  misc_feature (689)..(689): n is a, c, g, or t
  misc_feature (692)..(692): n is a, c, g, or t
  misc_feature (717)..(717): n is a, c, g, or t
  misc_feature (731)..(731): n is a, c, g, or t
  misc_feature (768)..(768): n is a, c, g, or t
  misc_feature (770)..(770): n is a, c, g, or t
  misc_feature (779)..(779): n is a, c, g, or t
  misc_feature (786)..(786): n is a, c, g, or t
ggctgtccacagggagctccagcccttctcacactcgacccgcagaaaccacccaccttcaccatgtctgacgaggaagttgaacaggtggaggagcagtacgaagaagaagaggaagcccaggaggaaagctgcaggaaccccaaaaaaaaaaaaaaaaaaaaaaaaaaaaaaaaagaaaaaaaaaaaaaaaaaaaataaaaaaacaaaaaaacaaaacaacaaaaacaaaaagaggtggggggcggcggcggcgcgcgcgcggcgaagaagaagatgaattctcttacaccacacacaacgagcgggggggggggcgcgggcgcgcgcgcacataagatgagtgagaagagagatggatctggtggactatgttcttacggtctagtctcactcagacacaggagaaggtgcactagccctggatgacgatgnaagaacgaggtggtcgggtgcggtcgtacttcaccaccaacnacataaagatagagacagagcagacgccgcggcgcggnagaaggcgaatagctggatntgcgctatagtttcacatagctaaacaccactaccaacacaactaaggtgactgtatgtcggggcgtctggtagncntcgaaaacaaggccggcagtatcaggaggtngagcgnagtctgatctaacacanacataagcaagcgaancgncggnagnacgccaagcccgaggccagagcagnggcagcttagaccntatatataaattaatatttcaaaaatcccgcacgcgncnccgcgcctncgcgcgnccgctgccggcgggtgct

SEQ ID NO: 727646 - DNA, 284 bp, Homo sapiens
  misc_feature (124)..(124): n is a, c, g, or t
gtttgggggccgttttaaaggaagcccccaaaagtatttgggggaatcccttgagaacagatgtagtgttcccccccaacttatttaaagtcgacctgtggccgccttctttgaaacacaattnactcccttaacttccatgggccttgatggaattatgcctttttaaaagttcccgaaatagaataaattactattccctaatatgaatttccgctatagataggattattttttctttcaggggggaatgggcccagaatagctagaaacgaagccttcca

SEQ ID NO: 727647 - DNA, 314 bp, Homo sapiens
ggctgtccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaagttcatgaaccagaggaagttcaagaagacaccgcagaggaggacgcgagaggaagttcaagaagaggagaaaccgagacccaaactcactgctcctaagatcccagaaggggagaaagtggacttcgatgacatccataagaagcgttagaacaaagacctaa

SEQ ID NO: 727648 - DNA, 547 bp, Homo sapiens
  misc_feature (430)..(430): n is a, c, g, or t
  misc_feature (500)..(500): n is a, c, g, or t
  misc_feature (511)..(511): n is a, c, g, or t
  misc_feature (535)..(535): n is a, c, g, or t
aaacaagacaaataaaattctcgttcagtactaagattcccagaaaagttttagttttataatgggagaatatgaatataaactttttactcttttgtgcaaaacaaagcaaatataatcaaaattataaaattaacagttcagcacagaaatgctgctatgtcacagtctgaccgtgtccaatctaccacaaattttcagtgtttatgttagaatcatgagttcttccttgacaagccgcctttcctgtcaccttgaatgaacattaaaagtccagggtgtttttccattttaagtgatcaaagagcaaactaacacaattccggggctaaggaccaatcattgtccaaaagccaaacctatctagaaagggtcaccatagagctgaagacaggttcctccgccatgggaatccgctgcacagatccanactcgtctttgatctcatttccttgggaagacagtaagccttttcccctgaagcagcacagtgccttggngcttagttacncgagggtgatgccaccgtccattngtaattcctgtt

SEQ ID NO: 727649 - DNA, 244 bp, Homo sapiens
ggctgtccacagggagctccagcccttctcacactcgacccgcagaaaccacccaccttcaccatgtctgacgaggaagttgaacaggtggaggagcagtacgaagaagaagaggaagcccaggaggaagaggaagttcaagaagaggagaaaccgagacccaaactcactgctcctaagatcccagaaggggagaaagtggacttcgatgacatccataagaagcgttagaacaaagacctaa

SEQ ID NO: 727650 - DNA, 863 bp, Homo sapiens
aaagtctgacacggctgctgcatgctgtgcgccaaatgaatccacatatccgggtgacaagccaccagaaccgtgtgggtcctgacgactgtacgcggtctagtgcatgacgattttttccaaaaagctagcatggcgtggccacatgctccgtggacaaacgttgggagtgccccggcatgtaacaatggaccgcctgggtgtgtcttacttacacgggaaggccactgcttggagtccaggcacacatggggcaccgagaggggcaattgtgccagtgtggtgatccccttcctgaccaagagttcgtacagattccagccaggacccacctgagaagtccatccccatctgtaccctgaagaactttccctaatgccatcgatgcacaacctgcatgtggggctcggggagtgacgtttgaacggcctcttcaagcagccagcagaaaatgtcaaccagtacctcacagaccccaagtttgtggagcgaacactgcggctggcaggcactcagcccttggagggtgctggaggactgtgcatggcgcaagcctggtgctggcgggaccacagcaccttgtgctgagctgcgttgacctggggccctgacaccattggcgaccacccagtactcggaacaatatccggtgaggctgcttgcacaaagttcccttcctgtacccaggttcaccaagctcagggagcgccggtcgtggtcgtggggcccagaaggcttgtccaaacccgtctccacctttggctgtccagcaatcccctgcctctggcactatgtgtatggctgcgtgccaccctgtttttgtccagacctaggggctgcagtgggcctcagagccgggctgg

SEQ ID NO: 727651 - DNA, 135 bp, Homo sapiens
gatccccgtcatcatagcgaaagtctttattgaggtctgggttaaaattaagcacttggccagagcacgcagtcttatatctagtgcaagcagtcaggtgttagccattcctggggctgggttggggtcattagg

SEQ ID NO: 727652 - DNA, 306 bp, Homo sapiens
taaggaagggtccaccaggtggggagagccccaagtgagaacaataatgaacaattatcgtatgaacaactgttagagacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 727653 - DNA, 100 bp, Homo sapiens
ttagctctgatcccagtgattgatgctggatcccagtgttgtgctgtgtccctggattgtgcttgcctcacccaagacccccagtgctgtgcttgtgtgt

SEQ ID NO: 727654 - DNA, 479 bp, Homo sapiens
  misc_feature (302)..(302): n is a, c, g, or t
  misc_feature (365)..(365): n is a, c, g, or t
  misc_feature (450)..(450): n is a, c, g, or t
attcggaacgaggtgcataataatcacatcgcgcccggcctaatttttgtattttttgtagagatggggtttcaccatgttggccaggctggtctcgaactcctggcctcaggtgatccgcccgcctcggtctcccagggtgccgggattacaggcgtgacagctgacacccggcctcttttagctgtttttaaatgtacaataaattattgttgactgtagttaccctgttgtactatcaaatgctagatcttatccattctatccaagtatattgttatactcattaaccccactacccnccccactatccttctaaccttctcataccatgggttctaattctctagcttccatggagttgnttcaaattgttttttaatttttttaggcttccccaaaatggaggaacatggcaaagtatggtggttttttggtgcccggggtttntaaaaggggatttttaaggcaaggaccct

SEQ ID NO: 727655 - DNA, 141 bp, Homo sapiens
taaagagataaaaaaaattttttttaattttcaatagttggaatatacctatgtataggttttttttgggcatttctcaaggctgggggtcctcgtgaaacttccgggaatcggggaaatgggccacggtggccataaaat

SEQ ID NO: 727656 - DNA, 181 bp, Homo sapiens
tagaggatcccttaagcatcagaagctttctttaacaaatcacacgcaccaccgcatcaggtgggaggggtctggccatgctgatcaagtgtccaggcccctcccacctgatgcggtggtgcgtttaattttagagaaaacgtcctaaaaatatctcgggtaaggaatgctgccggaaacc

SEQ ID NO: 727657 - DNA, 111 bp, Homo sapiens
tcaaggatctcttgttgggaggggaatgagaggatgtactttaatgaggtgtgggatgatgggtagaggagcagttgagtccttcaccattactcggcgtccaaagcacag

SEQ ID NO: 727658 - DNA, 112 bp, Homo sapiens
attagaagttgtggctcagttgcactataaatgttgagacacgagatatgatgacatccatgccccacctactctggaacaagaaagatgactggggaggaaacacaggggt

SEQ ID NO: 727659 - DNA, 144 bp, Homo sapiens
catccccatccaggcgcaagcagtgtgggcagcaagtggcagtcagggtgtgggtgcagggtgcaaacatggggcatgggtggccagcatccttccacacaatgtttcaaatcactcatcttcgttcaatgccagtctggttgt

SEQ ID NO: 727660 - DNA, 149 bp, Homo sapiens
  misc_feature (21)..(21): n is a, c, g, or t
  misc_feature (41)..(41): n is a, c, g, or t
  misc_feature (61)..(61): n is a, c, g, or t
cgcgaccttggggtgagaaangtccagagcttgggacaaancaagggcatgtttcagactngggacatacctgctctaaagaattatgggctctagggagctcaaagatcaggacaataagaggagggtggatcaggaagggtacagga

SEQ ID NO: 727661 - DNA, 813 bp, Homo sapiens
agcgacgatgtagaggcggtaccggttttattcagtcacggggctggagctttagtttatgtaatggacgtcggcagcaatatgataatgtgtgctcagtaccaacccacagaagactatggtaggatcagccagctggacagactgtagcgcgtaagggatatatctaggtctagaggaaaaaaaacctgtccccatggtagcagagagaaatcagagatagtgagaggaataactaggggttgatctattataggaactacagatagcagtaggtagaagcatgtactagagggtcacgatcgtggagtaaactagggctagccttccaccaccactatgcaccctatataagtaatactaggggacagatagatacgtacaacgtgaagatctaggcgacatagaatagaatacaaaggcataggagaggtatagatcacctagcacgggagccatataacaacaatagtaatctatgtagccgatctataccacacctcgaccaacgagtatgatacctacagacaatatactagagagacaacagagtaatatacggagtactagaggatatagtactaaagcaggcactaggagagtatacagaactatcacacgcagaagaacccactgatacgtatctctaggcgatccataggcgtgctacacgcctaaaaccttaaagctactattgccagccaggcacatgaataggtaggtaatgatagtgtcaaagctaggaacagggaaacggccagcctatgctagtacatagggcaatcatgctacactcttgtccaggaccgctac

SEQ ID NO: 727662 - DNA, 337 bp, Homo sapiens
  misc_feature (21)..(21): n is a, c, g, or t
  misc_feature (122)..(122): n is a, c, g, or t
  misc_feature (191)..(192): n is a, c, g, or t
caaaaatagccacttttttcntctctctctttttttgagattgggtcttgctctgttgcccaggctggagtgcagtggtaggatcatggctcactgcaaccttgacctcccaagctcaagtnatccctcgcacttcagcctcctgagtagctgggaccacaggcatgtgccaccatgcccagataattttnnagttttttgtacagacagggtcttgatatattgcccaggctggtctcaaacttctggtctcaagtgatcctcccaattcagcctcccaaaagtgttgggattacaggtgtgagccactgatcccggtggctagttttccttttga

SEQ ID NO: 727663 - DNA, 198 bp, Homo sapiens
gcagtgcacgcttgatgctgcaggtactctagatggaccccggcaggcacgtgaaagccaatcgattttgtacatgtttgaagattctgctgtgcttcctcagcccgatgagagggtgccgaggagagtagcctgtttcggggagcgcggggcacggggactgggtcatgagaagccccagggggacgtggaaccgag

SEQ ID NO: 727664 - DNA, 327 bp, Homo sapiens
ttgaagcatgcgccagtaaaaagactggtggtctggaaaagaatggagatactatccattgcaacgactgcctcactatcaacgccagtgtaccatgtgctcttccgacccatgctcctacagctgatcgtccttagccagtccagtctctacgaagaactggcatatgtacttgctgtaggtcaccctgtagctgaattacttctccatattccggctgctcaattacagtaccattgcaggcaaactttatcttaaacgccttcactagtttctgttgatcgtaatcatcagcgatcccttgtcatagctgctgtaattggggta

SEQ ID NO: 727665 - DNA, 1024 bp, Homo sapiens
  misc_feature (422)..(422): n is a, c, g, or t
  misc_feature (802)..(802): n is a, c, g, or t
taaaattgtttaacactgacttctttaaatgttactcttttcaaattatttcaacaagcaaagtaagtgtcagcagttttaactaataattggccaaagggttattcaggaattattcacctttcctcccttgcttacaacaaaaacaaatacaaaatattaaagtttataggtaaagtattattatttatcaaaggggatttttttttaagaacaagagatgttctccgcttcttgtgtgcaaccaagggtgtgggagtgtggcagtggggggcaatctctccaagctccatctgggaactctcccatcctcccggatgttccaaaggcagattctcctctggcctacaagccttccgtgagttatccgtgggatttagcgggctctcccccacacccatgtgccgtgttaattccccagnctataattttgtgtggatatttttaccataaaagaccaagggtttttcgccgtgggtgtgaacaaaaggcggagaaccacctattctccaagaggagtagagtgggtcttatccaaactctaacaattggtgccgagagaagcccttgggggaatatttcactatttctctcaaaaagaagcaccctagtgtgtggggacctctcttatggcgcccttatatacaaacgagaaaacaagacactggggggctacttttctccccaagatgtgaggggccccatgtgtgtgcaggcgcgggtgaattataccctttggggaaaaccccccatttcggggcctttgaaaagcttgtgggcgaggcgaaaaagaattccccanttgtgggtaagcctccccagagagaaagattttcttactgcatctaaaaatttatacgggtgattttaggccccaaatcttccccgtgtgtccaaggggagacactctaaagcgagacacactgggggttgagggggcttcccccggaacaagttgtgtttccattcttcctcggcgcaaaaacttggtgggccaggaaatacccttctgggtttcccctcg

SEQ ID NO: 727666 - DNA, 715 bp, Homo sapiens
  misc_feature (343)..(343): n is a, c, g, or t
aggaagatggcgggctctggggcggacgccgtaggtcctggtacaatacttggtgttacgaaaggatctatcacaagctccgtgtctcctgtgccggcgggcgcactggtagcgcaggcttgtgatcgcggcgcaccgcggtgcttgtcgagcactcgaccgggagcacccgtagactagccgtttacctccaagtaggctggggctgctatgcagctaaagtgtgtcctcgtagggcacagatgagaccaaccgctaagaggaagctggtcgagaccctgctacagaatgaacattgagcacattgtgtgtggggctttggagtcaaactcacgatgacacnattcgaccagcattggtgagtatggcgtgctggcggaccgcgtatcgccgcgaacaggagagaaggtgggtgccagatattttgataagaacgtttccgagtttgctatcagaggtaaacctgggtggcattatggactgttgatattgtaacttactgcagagcgccatccctaattacgccacaaaagacgagtcactgggtggttcccttttggctacgttggtccatgcatttgtgctcccccggtcgtgtcctcgaggtgtggtgcagcaagtcttccttgaggggctataaaagcaagcaggttcccgagtattaagaggttgtccattaaattaagacatacaacaacaacacacacagaacaag

SEQ ID NO: 727667 - DNA, 811 bp, Homo sapiens
  misc_feature (707)..(707): n is a, c, g, or t
  misc_feature (712)..(712): n is a, c, g, or t
  misc_feature (774)..(774): n is a, c, g, or t
  misc_feature (778)..(778): n is a, c, g, or t
  misc_feature (781)..(781): n is a, c, g, or t
  misc_feature (798)..(798): n is a, c, g, or t
  misc_feature (800)..(801): n is a, c, g, or t
  misc_feature (810)..(810): n is a, c, g, or t
agcggagagtgtggtcaggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggcttgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttaatttttcccttctgacaaatattttagaagcttatgtatgactgtataagtagatccagatccagactgttagatgttgtttangggcntaaagggagaaactggaagtgtttactccttttctaaagtggtggcctttctaaggagctantttnctngtggaacttttacttangnncactggggnc

SEQ ID NO: 727668 - DNA, 756 bp, Homo sapiens
  misc_feature (652)..(652): n is a, c, g, or t
  misc_feature (657)..(657): n is a, c, g, or t
  misc_feature (719)..(719): n is a, c, g, or t
  misc_feature (723)..(723): n is a, c, g, or t
  misc_feature (726)..(726): n is a, c, g, or t
  misc_feature (743)..(743): n is a, c, g, or t
  misc_feature (745)..(746): n is a, c, g, or t
  misc_feature (755)..(755): n is a, c, g, or t
agcggagagtgtggtcaggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccaccgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttaatttttcccttctgacaaatattttagaagcttatgtatgactgtataagtagatccagatccagactgttagatgttgtttangggcntaaagggagaaactggaagtgtttactccttttctaaagtggtggcctttctaaggagctantttnctngtggaacttttacttangnncactggggnc

SEQ ID NO: 727669 - DNA, 198 bp, Homo sapiens
ggacatccaagaagattgtcatcacagactgtggccagttgagctaatctgtggccagggtgctggatggggcagctgcaatgtccatgcaccaggggccgcgttgggtttcagcaaggtgcttaacgatacgtgtgtccactcactgtcacagtgtgccttaggaaggctgctagggatgttagacctcggccagga

SEQ ID NO: 727670 - DNA, 539 bp, Homo sapiens
agcggagagtgtggtcaggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggcttgccaaactggaacgttgcgagagagggtaagcacttgaagaattgggaaaaaagagatcaaagactgtgagagatgagctgatatgggc

SEQ ID NO: 727671 - DNA, 335 bp, Homo sapiens
  misc_feature (42)..(42): n is a, c, g, or t
  misc_feature (49)..(49): n is a, c, g, or t
  misc_feature (74)..(74): n is a, c, g, or t
  misc_feature (86)..(86): n is a, c, g, or t
ggccaatgtgtcctaaaaggctcctaataaatggggcccccnacccccnggaaatgcctacagtcatgagctgnccgatacaatancccatgagctgcctgtagatatcaagtgcttgaaatgtgaacacccccaagttctgatgcactgtgaatgtaaaatgcacactggatttcaaaaacttagtttaaaaaagaacatactatttcttattattgatacatctcaaaacaatatttagggccaagcatggtgctcatgcctacaatcccagcactttgggaggccaagatgggaggatcacttggggccaggagtttgagaccagcctgggc

SEQ ID NO: 727672 - DNA, 159 bp, Homo sapiens
cccgcccgggggggttttcctttgaaaacggggaaacttgggcgggggcccggggctcccgggttttttttcccccctttggggggttgggggggggggttcccggggtcgggaaattgaccccctccggcccggggggggggacccccttttttctta

SEQ ID NO: 727673 - DNA, 1743 bp, Homo sapiens
atggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcagcgtgaactttgtaatggagctattcttgctcattgtaatttacgtcttatgggtagtagtgatagtcctgctagtgctagtagagttgctggtattgctggtggttgtcatcatactcagcttatttttgtttttcttgttgaaactggttttcatcatgttggtcaagctggtcttgaacgtcttacttctggtgatcctcctgcttctgcttctcaaagtagtggtattactgatgttaaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcag

SEQ ID NO: 727674 - DNA, 260 bp, Homo sapiens
ttgttccttggtctactaaaaatacaaaaaattagccgtgtgtggtggtgtgcacctgtaatcacagctacttgggaggctggggcaggagaatcacgtggacccgggaggcagaggttgcagtgagctgacattgtgccactacactccagcctgggccacagagcgagactccgtctcaaataaataaatatttctctatattatttattacatgcaatctcctacaactcaatggttggtttgattttcctcaggga

SEQ ID NO: 727675 - DNA, 1608 bp, Homo sapiens
atggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagtcttctaaatactggtcttctagaaaatctaaacaacatattttattaaatttttttgttctttttaaatttattaatgatgctttttttggtatttgtccttttaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcag

SEQ ID NO: 727676 - DNA, 485 bp, Homo sapiens
gggtcatgttactattaaacgaaaacagctgatggaaagtgtgcatacagagcaagttactcagatggaaaactgaaagcccctcctaaacatggtgcctggcaatccaaaggggacccagatcacggtggaggaccttttttacaacataagccacgaggagaaaagccttaaaaaatccaagtgaagaatatgggaaactttggaagtcgtcggcaggtattcagtacaccatgccaggcattcagatttctccagattaaaacaaacaaggagagacagtagctgatgttaggacactaccactgctcaaccgtggacaatattcgctccatctttggaaatgctgttagtcgagaactgatagaaatcgggctgtgaggcattacaaccgtagccttccaaatgactggttccatatccaaatgcaaaactactcagtgaaagaagtgcatctctcttactcttcatcaaccatcgtctgg

SEQ ID NO: 727677 - DNA, 291 bp, Homo sapiens
  misc_feature (102)..(102): n is a, c, g, or t
gcggggttcatctcggcctgcttgatcgcctgcgataggcgaaccaggtgacggccacttccgatggcgtcgcatggctgccatggctcgcgccgtaacggngggcagaaatccatcaccggcttgtagtcccaccagttggcgagcttgcatttgatcggaccgcggttcgacgcatcgcccgaaagcgaccgatccgcataaatctcgggcgaaggcgggcgttgatcgtcgagacattgccgccatgcccgtttgaaaaaatagatgcgctcgaaaccgtgccgcgca

SEQ ID NO: 727678 - DNA, 390 bp, Homo sapiens
atgatgtcatgtccacaaaaataaataaattagccaggtgtggtgggcacatgcctgtagtcccagctacctggagaggctgagtcaggagtatcagatggggcccaggaggttgaatttatattgagctgagattgccccactgcactccagcctgggtgacagagcgagactgtctcaaaaaaaaaaagaaaaaaagaaaaagaaatggagaaccgggctgtgtttgggggcaacaaagggggacacttgaggagccaacttcctcccttgaatagcgggtgtgtttcttccttccgggattgccagcttgcaggcaggaattggtttggatatagtatctaaatactttctctattggactatcttaatctgggggcccaaagcctg

SEQ ID NO: 727679 - DNA, 837 bp, Homo sapiens
tgggccgcatcgcagtttattattttatactgctttgtatgttgtcagatcctgggccactgctacactccacaatattattaaggaatgtggtgcactactttttaacatcgcgcgcaaaagaatagtaagccttgtggtcatggacatcttcaattgattgatcgtagagccgctgttctgtattaacttcattaatacttgcagtttatgaaatgattggtcgattaactgaataattgaggctgttgtgtatatatacaaatagagattctggtctcaatataatatactgtatacgacataacattcgtatctttcccttttaatgtgtaatgtacatacacaggaagtgtctatccttatgaatcgccagccatttctcttgttgctatccatggtaagggcccgcagcttctactgggtagttcactgctggtataccaatgccttttgtctatgcccctgcagcctacttttgtgtaacccatgggattgcccttggtctcgtagaaacattggctcagtgggccttttgatacagggaccttttgcaggactgggaccgtcccggcccacatgttcaatgcagtctttttggctcgcggcggtaccaacttattatactgggacacacgctcagcttccctcggcgggcgggccacaatggcgcccgaccctcatgggcattttgcaactcttaggtattttgtattcctccataaaaaaaaaaaggaggtttcaaggctctttacttttgacttaacctggggtagacaaatctgggtcttattgggtctttttgggcgaactttgggcttttccacaagtcttttg

SEQ ID NO: 727680 - DNA, 169 bp, Homo sapiens
gccagtagcctatgccagagccacgcaggtgcaggatccgaacctcattgtgacctacaccatagctcatggcaacaccagatccataacccactaagcaaggcaagggatcaaacctgcatcctcattaaccactgaacatgggtttattaaccactgagcacgacag

SEQ ID NO: 727681 - DNA, 211 bp, Homo sapiens
atatatattttgaatgcctttatagattcctttaaattcccttatacacccattaatagaaaatcattacatttaaaatataccttacagctaaagcatccaaataagaatagggctcatgcccttatttttctttcagctgaatacgaatgaacacagtggtgcaattcctgaagggaagtgatgaaattatatttattccagtgggcac

SEQ ID NO: 727682 - DNA, 506 bp, Homo sapiens
gtaagtcatagtatgagtaattaattattatactggagtgtgaatttgaagcctgtgcaaggaacacacccatcagaaagtttgtgaatgagccacaccatggcccagagtctgtatcttcctgcagcctctgcttccctgcctgtcacccacctcaaagtagctctcatgaaatgatcatttgttattattcttcatcactatttaccttttacaaatgttattaagttcatgtctgaaattgctacaatagtgatgtcattgacacctatggtgaaaaattatattttatggcagatattattttacaagcttctgtaagtttctttggtcctgtatttgtcacatcattatggacctgaagatgtgcccactaatgaaatattttgttacaatttgttgagttttgtggggaaacttgtctgctcttgcagtttgttcaaatttggcatcaagaatgtttctggatatattcccctcccatgtcaagggtttttagtacaaaa

SEQ ID NO: 727683 - DNA, 1606 bp, Homo sapiens
gtaatgacttctgcggatcttttttctcccctataggcttcaataggaaaaaaaactcccacctttatataaagggaactctttaacaaggtttcctcagtaagaggaaccggggcttacgcagaacccagagttttggaggtccgtgggtgaacaagtccagcgggtagagatgtgcgtaaactcagggtgatataacccgaatgtggccccaatgtccaatatatttagaaattatagtgtataacagagtgaagccaagctcttatatttctcacctatacgcccatcgccagaaggtgggcccaaagagcacgaattgtgccggtggaacctgtggcctctcttaagacccgaactcttctcctgtggcccaaacatataacttgtggcgcgtatatacgcgagtgatgcgtgtctcccgtgactgtgaatatgtgtgctctctccacaatatagattctgtgggagcaattcttatacacaccacacgcttttgacgacgcttatgtgcgcgctctcgccaccacaagaagtatacccgctcttatacaacacgggcgattttgtctcctcttccttgtgtggggcacattctctcctcctctgcgagacgacacagccggccgcgataagacaatgttgtgagacacgcgatatacgcagcacaaacccccaaaaaacccgaggagacaaacagtgtggccaccacttaaacgcacacaaaccccgacatcttgctggggagaggcttccccactcctgtggcaacaccgcgccgacacaaccgtggtggtgtagcaccaccggctcctcatacattttcccccccacaacttttgtgcccgtagaaaaggccgcacacacacggcttgtgctctaccacgaccaacaacacgtactacaccacctccccccacacatgacgggcgtctttttacaagatgcgccaatgatgagaggccaaccaatgttgacaagtcttgtgggggcacggcattaactaccaggaggcagctcttcctgtggccccccaagttgcgtcatacgccactacagcgattatagcggggcagtggtagcaaactctcgcccgcttacaacattagtcggcggctaccacccgacttcgtgtggcacaaatcattcaccccttataattttataacagaccgcccccctattattaagtgggcgcccactacgcggcctccgaccaagacacggcgggcgcccccccacgaacaaaccatattacaacacccgatgcggccaggctgccccccttgctaaacaagacagacgcacccactgcaggagccaattcaaccgcccacgagagcaccctgcgcaacacggcggtaccaaaaccaacaccggcgcgcggcccccgcgagcgaacaacagagcggcggccgccccacccgcaccatcataatattagtggcgcgcccccaccacacatcatgatcgccgccgaacgaccacaacccaactcgcggaggcggccccccaaacatatgccgtggcggacgtccacacaacacatcacacaaaataggcccgtcggctcggacgcgagccacaccccaccagcctctccaac

SEQ ID NO: 727684 - DNA, 537 bp, Homo sapiens
gggaccctgcagccgcagagatgttgatgcctaagaagaaccggattgccatttatgaactcctttctaaggagggagtcactggtgcctcaagataggatgtccacatgcctacagcacccggagactggcagacaagaatgtgcccaaccttcatgtcactgtaggccaagcagtctctcaagtcccgaggctacgtgacaggaactagatcttgcctaggagacatcttcatactggtaccttaccaagtgagggtatccagtatctctcgtgagttaccttcagtctgcgcctccggagaattgtgccgtgccaccctaccgccgtagaccgtccagagactggcaggccatcggcctaaaggtctggagggtgagacgacccgcgagactcacagagaggggaagatgacagagatacctacagagcggagtgctgcgccaccatggcgccgacaagaaagccgaggaccggggactgggtcagcaaccgaattccagttcagaggcagataactgccgaccatgtcagcca

SEQ ID NO: 727685 - DNA, 310 bp, Homo sapiens
  misc_feature (215)..(215): n is a, c, g, or t
  misc_feature (279)..(279): n is a, c, g, or t
  misc_feature (304)..(304): n is a, c, g, or t
tgttttggtattcagatgtctgtggtagttttatttgcaatggccaaaaactggaagcagctcactaaacaaacagtggcatacccatagaactgcatacttctcagcagtatgaaagaatgagctacttatataagcatcattgataaacctcaaaaaaaaatgccacatgaaggaaacccaaaggggaggaaacatgaaaaactttatatgtncagtccatattaaaattctaggaaaatggcaaacttattccatccttaaagggaaagttaaatncaacagttgttctggggagggcccngtggag

SEQ ID NO: 727686 - DNA, 678 bp, Homo sapiens
gagcggtgtgtgtagggcggctttgagactggggtgtctgtccccagagctcagagcagaggtggggcggtaactccatgcccgcgggcacaggcggggtcactgagtgaggagaatggctcgaggctgagccgtccctcacacggggccagcgtggacacttggcgtcctcccttcggtctttgcgtgtctgttagtgagccgtgtgtgtgtgtgtgtgtgtgtgcacaagaagctggtgcccgtgatacactgctgctctgtgacctgcatgtctgcaccctggctgtctgcacccaggagtctgtgcgggaaaggaactgctgccttcagcccatcggcatcctttattggcactgagacgagaaacagcagaaatccatacagggagaggacatccctgatcagcgacatcgagcgaattctgagacccgagttgatggtcagcctcgaggagcagcaatagcctggccagaaaaaaaaaccaggtctgcagtcccagccagcaccgttttgctctacatctacgctgcgagttgtagcagtggatcccagcatctggcagacagcatcagccttggcaccgctcgatcagcaaagacagagtggcatccaagactagtgaatctgaccacacagaaccagccaacaccaacgggcacgaagagccagggaagc

SEQ ID NO: 727687 - DNA, 280 bp, Homo sapiens
tttttatacttgcttttggtatgagatagggtctcaccatgttgtgcaggctggtcttgaactgctgacctcaaatgatccatccgtttaggcctcccaaagtgctgggattacaggtgtgaaccactgcagcgggctctggataatcttcctcaaactctcctgattagagacccttgaaactttaatgctcctttactcagtgccacataccaaccttggctcttttcataacccttattcctcctcagagcaatcctgtgaggtgggaggagaggaa

SEQ ID NO: 727688 - DNA, 164 bp, Homo sapiens
gggccaaaaaaaaaaatttttctccccccaacctccaacctttgggggccaaggcccggcccccccaggtcctgggggggtttccccccaaccagggggggaaggggggttttttttttaaaagggggggcctttccccccaaaaaaaggcaatttttttaaga

SEQ ID NO: 727689 - DNA, 220 bp, Homo sapiens
ggggggggggttttctcgcaattttgtttttttttggggcgcccccttcgggggcgggggggaaaaagccaccccccgttttccttcggtcggggtggggggctagggggggggttttttagggccccccttcccggcccccggcccggggggggggggttccccgggggggggcccattaaaccccccttttttttcccttttcccccttttgggggga

SEQ ID NO: 727690 - DNA, 155 bp, Homo sapiens
agtacgggggaaacctcactttaagcgagttacatgctaaacatctaaaataaagcctcacaaaaagttaaaattcagaatatgggaaaaggcatgaagaagaatgcaagacagaatgtccaggtcgactaatggcgtagtactattcatcaggc

SEQ ID NO: 727691 - DNA, 365 bp, Homo sapiens
tcatggaacaccggggcaaagagggcaggacagctccaaagatgtcatgtgccacggctgatgaaagcgcccaagcagactgctcagtatataaatatattttatatttatacgagacgaagtcaacctctgcctcccgggttcaagtaataaacctacgtcagactcccgagtagctgtcaggtgcacaacactacacccagataatttagtatttaatagtagagacggggtttcaccatgttggtcaggatggtctcaatctgacctcgtgatccgcctgcctctgcctcccaaagggctgggattacaggcatgagccaccgcgcccagccttacttttcgtatttataatggagatgggg

SEQ ID NO: 727692 - DNA, 155 bp, Homo sapiens
tgatctagagatctccgcggtgctctacggggtctatatggtgaatcatcctgcctttcaaattggtttcataatagttagatgaaaactattttttgggagatgttactgaagttgatgagcaataaaagtctacttaattaaaaaaaaaaaag

SEQ ID NO: 727693 - DNA, 990 bp, Homo sapiens
  misc_feature (990)..(990): n is a, c, g, or t
ccgcagctcctggcgctcggcgtgggctaactgcagcgcggagatttcgtgccgccaagctccgctcccgcccccgggctgtgccccgtgggctcgcctgaggccgacaaccgtaccaccacactcctatggcggtttgcgtcgatggcccagcttcttcgcaggccacggaaatccatgtagtgctcgccctggttggcatcgcacgactgccaggcgacaacatgcacgtgcggacacccgacccacaagccagtaaccggcggcactggagcacatgacgaaccaggacacacgccgacactggacacggcacgcgccaggtggacacaggacgacagtcgaggacagagcaacgagaggggcagcagcaaacagcaacgggacgaacacaaggcaagaaaacagcccaataatgacaggccaaagagcaccaccgcctgagaatgtggggcagcaacgcaacaacggggcaggcgggtcaagggggcaacacagcgaacccagacaaaacatacgcgcgacagacagcgacaaagaagataacagcagtacagggcccaggaagggcataacagacacgcgcaaacaggtgagcaggacacccagaagctgcacaaacccgcccccgtagcaaggacaccgccgactgcactggcacggaacaccggcaggagacagacccgcagcaaccaagatagagccgaagagacgcgaactgaaggatccacacgaggcagaccaaaacaccccgcaggacggaccatggaacacctggggaccatacacggaggacacaaagagcagcaaccggaaagaaacacacagcaggacagaagaccagtggagacgtcagcgcaggaagcacagcacgacgcacccgccagcaggccccacgaacaaagaagacgcgccgacgcgagcgcgagcacgccgaacacacgcacgagccacgacaacaaaagaaaaggcacagcagacgcacggggn

SEQ ID NO: 727694 - DNA, 810 bp, Homo sapiens
gtgtacactgattcaccaggtggtctcctctgcactttcaacagcgacacccactcctccacctttgagcgcttggggctggctattgtcctcaacgagcactttgtcaaggctcatttcctggtatgacaagcgaatttggctatcagcaacagggtggtggacctcatggtccacatggtctccagggagtaagacccctggaccaccagccccagtcatatgagcacgaagtaggagcgagagagaccctcattgctgggtgagtccctgtcatgaatcgagtcctccacaacaaaactgaatctacccctcctctacagtttgcatgtagacccccttgaagaggggatgggcctagtggagccgcatcttgtatgtaccatcaatgaagtactctgtgttcgacaagattggaccctgtgttccctagaagcacccctcattgctggaggggcgcggaggcaccaatcctttctgtgagcggccgccttggtattccttggcctccttttctttagctcagggcgctcgcctctcttgtggcctttagttatattctctgcaccggggggctccatcccaaagaccatttgccagggagcaccccgcggtgatggaggtgccccgaggaggggagcctttgcccggggggggccacattctttgaggagactggccccggagagatcaaggggtcccggaggaaggtgtacgccggcaccctttttcggggcaggaacccggctggaattcccgggggggaatatgccgcgcgggctgtatcaggcgaaattaacgacggcgaca

SEQ ID NO: 727695 - DNA, 156 bp, Homo sapiens
gggttagattccggtgacagcacagacagtagaggttatctcctgaacggtaattggtgtatgaagggtgaattctggggaggtctggaccatggcggagattcagggctgaactggagtgagttggagacggttagcagcgggtacctgagctcg

SEQ ID NO: 727696 - DNA, 208 bp, Homo sapiens
aacagttaaaaagaaacccacaatcatatggcaatggcctctggttctaatataaacttggttacaaccattcaaattctatctttacggcaatttcacactgctcctaggagcccttatagcatctgattctaagttattctgacacggacaaccaaaactactcctgacaacctatacctcactcaggactgactcacactggaac

SEQ ID NO: 727697 - DNA, 428 bp, Homo sapiens
gagagagagagagagagagagagagagagagagagagagagagagagagagagagagagagagagagcgatagtgagctagagcccgtgacagcgttctcttatgccctgtctgcttactgttgccttcttgcccttgcccctcatctttttcctcgcgatatttttgtcgcctctcgctgtctccttctgtcctctcatcctgatctacatctttaccttttcttctagtcttgtcgtctcttcactccttatcactggcttttcaagttctccctgttccttcctccttacctctctgcctcttctgtctctttatgattacttcccactgctccttgtcgcagtcttctcccctgtccattgccttgtcctccttttcccgctgcctccctgctgccttccctgcttctctttctgttcctctcg

SEQ ID NO: 727698 - DNA, 266 bp, Homo sapiens
tctagaggatccctgtgcgtcgtagcgggtcatttccgcgccgtgcacagccaggccagcaggaccaggaacaggccccagccgaggtattgcggccaggtacgtatgcccacggcttcagcgtgcagagttgtcatggtggtcctcgatctgaatgtgggagctggcttttgtgggagcgggcttgctcgctcccacacaaagcccggttcccacaggggttagccgtttgctgccgttttcttgtcgagctcagagatgcgttg

SEQ ID NO: 727699 - DNA, 708 bp, Homo sapiens
  misc_feature (226)..(226): n is a, c, g, or t
  misc_feature (228)..(228): n is a, c, g, or t
  misc_feature (250)..(250): n is a, c, g, or t
  misc_feature (252)..(252): n is a, c, g, or t
  misc_feature (301)..(301): n is a, c, g, or t
  misc_feature (340)..(340): n is a, c, g, or t
  misc_feature (425)..(426): n is a, c, g, or t
  misc_feature (460)..(460): n is a, c, g, or t
  misc_feature (608)..(608): n is a, c, g, or t
  misc_feature (683)..(683): n is a, c, g, or t
  misc_feature (689)..(689): n is a, c, g, or t
  misc_feature (692)..(692): n is a, c, g, or t
tccattggtttaagccccttgttccaagtatttatgccagggaaaatttgtccctgtctagagcttgcacaataagaaataagcggttcccaacagtcttaataatctcaacgtcttcattaggtcaataaggaaggctttgtaaagattactaaggactctaaaaagcacacttgaggttagggtattatcaaccattgtccttttttttttttttttttttttnanacaggtctcactctgttcccangntgaagtgcagtggcacgatctcggctcactgcaacctccgcctccgggntcaagcgattctcgtgcctcagcctcctgagtagctggnactataggcatgcgccaccatgccggctaatttttgtatttatagtagaatggggtttcaccatattggccagtctggtctgganntcctgaccacatgatctgccgacctcggcctccnaaagtgctgggattacaggcgtgagccaccgcacccagcctttttgttttgttattacagataatgtggcaagcatattttggattctatgaattatttctggagaataattttttcttctttgatcgttatctgaaacccatgattntgaggtaatcatatttaacaattttgtgccatacatacatatatatatatatatacgttgagactccatcaaaancaacancancaccaacaaaaaaaaa

SEQ ID NO: 727700 - DNA, 118 bp, Homo sapiens
cgtgcgctctgaatcgagttcatcgaactggcggtggctgatggcccaccagaatactgccccgatagcaaaaacaagcaataaacttaaaggtacaatgcaaatacaagatgtccat

SEQ ID NO: 727701 - DNA, 244 bp, Homo sapiens
aacattcgtgttcctgtaaggagacctcccacgattgtactggaatcatctgtggacttgcaagagcaggatcgtggagggtagcagctgcctgtgtgagattcgttatcccactgaaaccgcctgtccgtgcaacgccacacttgactagaacaatcctctcctgccacagggccagggctttccttttccacagtggagcagctgagcccaacacacctttggcgttggacacgaatgttca

SEQ ID NO: 727702 - DNA, 714 bp, Homo sapiens
  misc_feature (232)..(232): n is a, c, g, or t
  misc_feature (234)..(234): n is a, c, g, or t
  misc_feature (256)..(256): n is a, c, g, or t
  misc_feature (258)..(258): n is a, c, g, or t
  misc_feature (307)..(307): n is a, c, g, or t
  misc_feature (346)..(346): n is a, c, g, or t
  misc_feature (431)..(432): n is a, c, g, or t
  misc_feature (466)..(466): n is a, c, g, or t
  misc_feature (614)..(614): n is a, c, g, or t
  misc_feature (689)..(689): n is a, c, g, or t
  misc_feature (695)..(695): n is a, c, g, or t
  misc_feature (698)..(698): n is a, c, g, or t
cccctgaaaaaatgttccagggggtaacccccctggacaggttttagcccgggaaaatttcaccctgggcaaagctggcaataagtcaccagcgtttctcccagtctcaataatttccccgtctccattagatcaatagaagaggcttggaaaaatacttaggactcaaaaaagcaccttgtaagtaggggttatatcaaccattgtccttttttttttttttttttttttnanacaggtctcactctgttcccangntgaagtgcagtggcacgatctcggctcactgcaacctccgcctccgggntcaagcgattctcgtgcctcagcctcctgagtagctggnactataggcatgcgccaccatgccggctaatttttgtatttatagtagaatggggtttcaccatattggccagtctggtctgganntcctgaccacatgatctgccgacctcggcctccnaaagtgctgggattacaggcgtgagccaccgcacccagcctttttgttttgttattacagataatgtggcaagcatattttggattctatgaattatttctggagaataattttttcttctttgatcgttatctgaaacccatgattntgaggtaatcatatttaacaattttgtgccatacatacatatatatatatatatacgttgagactccatcaaaancaacancancaccaacaaaaaaaaa

SEQ ID NO: 727703 - DNA, 538 bp, Homo sapiens
  misc_feature (35)..(35): n is a, c, g, or t
aacagctctgagaactggcatttttctttcatgtntctggtattgattgctttgttgttttttgtttgtttgtttgttttgttttgtttttttgagacggagtctcgctctgtctcccaggctggagtgcagtggcgcaatctcggctcactgcaagctctgcctcccaggctgaagcaggagaatcgcttgaacccgggagatggaggttgcagtgagccaagatcacaccattgcactccagcatggacaacagagtgagattccgtctcaaaaaaaaaaaaaaaaaagtaaaataaaaaacctgcacaaaacctgcacacagggcgtgcgagggtgggtagagctgaggagggagtggggtgggggatggcaccgcgtccgcatcccggccatggcgtggcactgtgtgtacacagcaggtcactgttggggacatcgcatacattcagggtacgcaggatctctctatattatttctaacaaccgcactcaaatgtacgatgatggcaaaattaaaagtttaattttaaaaaaa

SEQ ID NO: 727704 - DNA, 435 bp, Homo sapiens
gcaaatgcgaaacaactgcatcgaaggtctcgatgccggcactcgagagttcggacgctgagagcaccgaaatggaagccgggaccgcttgggcgggttcgatctcccggcgggcgctgacgacgacctcctcgagctgcatcgcaggcgccgcggcggtgtccgccgccggggcctgctccgcggcgaggcccagcaatccgagcgcgagtaccgtcgacctgcggcccatttcggcgctcccaaacccgtggtacggtaatcatggaagttgcgagtgcgcagcgcttatgcggggcacacaaagagttttggcaggcgcagttcctgggcgcgacagatggcgacggtttgttcgctgcaccgcacacaggatccgagcggaccgatctggaaaggggggcgcgtggagccgtttcgttggggcggggtcga

SEQ ID NO: 727705 - DNA, 935 bp, Homo sapiens
taacaatataacaacttgtttttcccttaaattttaattataacccaataggcatgtaaacggaatccaaactctccaaatcatccggcccaaaaaatatccggatcaatttttttaaaaaacaaagaggtctactgggtttaataaaatgtggtttgtagaggaaacttacaagtgggtccgaaacaccaaagaaataaaaatataaaatatatcactttgagagcacgagacaacataaatttatttgtggtaacacagcgagcaaatctgggtgctagaaaacgagggagtggagaaaaaatctaattataagagcaaaaagctcgaggaagaggggttgtccataaatccccggcttaatctaagaacctcaccattttagtggcgacaaaagggggcctcgtgaacactcagattctggggtttactaaaaatctaaaaacttccctcccgggtctcggcctaaaaatacaaaaataagcgggggcggtggggggcgcagtgccgtggtagcccccagcctaccccgtgaggctgaggcaagaaaaacgccggcgccgacagagagccggccccaaaaaaaaaaaaccccacaccactattactttacaactattaaaactgttcccctaaaaacttacaaatttcctcaccccccgcagacaaaaacctccgccgcggggaaaaataccaaaacgccgggggccacaagggggccccacttcagcaacaagccgcgggctaagtttcaaaaacaccacaccacgcggggggaccatcgagggccgaactgtgggaaaaccactctataattcttgtcccccagaagaattggggccagaaaaaggaaacatgctaacgtccgacaaaagtgcgccaacaaacttacgcacacttagaaaccaaactccatcaagagcaacaccgttcga

SEQ ID NO: 727706 - DNA, 1051 bp, Homo sapiens
gatgaggtagagagacgtgagtcttgtctgggtccttccagatctcggtgcagtctgaaatggcaccctcgtctctagcccagccctccctggatgtggactcgcaggttggtggatgggggatgggggatgggaggggggcgagctggggctcctaggaaatgcctggcggtgacgcgctgatgtctttgcaagagcttcattggctcgagctgggctgcttcctgccaggtgatctggtggggcatgtgggtgtttgggcatccgtccatggcggggatgtggggacgaggtcggattcccaactaaggccaaggagggggatccttagagatagtgacccctcagaacactgtgctagcagatgagatggttggggcgtgcgagtcgtgagcaatggtccgctgaaatttgacatgatgccataccttgcgaacaccagccctgatggttctgtcaactggcttctttgcacgacgagccaaaagtcaaggctggaccttgagcagctcaagcaacactgggtgacctgggcccgacagacacccgagcaaggcactgctgagacctcctgaagcggggcaaggtgccacatccaagacacctggaggaacaggacgacgggcactgagcataaaggagcaacatagagaaatgagcatacagatacgtgaaaccgagagcctggaccaagctgcaggcgaccacagcgtggaagaggggtgcgcaccgagatacacgggctacgactgcgcccaagtgatgaaagcaagatgaagtgcacataacggagccagaggaccgagagaactgaagggctggacacaaaaagcggacagacaccaaagagcaaaggaacgagcataagggacgacccaatacggaagaagccccacgaaggcagactagcacagcattcgcgaaaagcgggcacccaacaccatagcgcacaaaacagtgcagaaacgcagggaagccacaacaacagcagcgcgggaacacagagcgagaacagaacaaaaacaccagcagacacgagagcacgaacaac

SEQ ID NO: 727707 - DNA, 426 bp, Homo sapiens
tccccaaagaaagcgaaaaaccaatgcaaaaaggctgacaattacaaaaaccagaacccctcttttccttcaaaggatcacaactccctgctagcaagggaacaaaattggatggagaatgagtttgacaaattaacagaagtaggcttcagaaggtgagtaccaacaaactcttttgaggtaaaaggagcgtgttctaaccaactgcaaggaagctaagagccttgaaaaaaggttagatgaattgttaactagaataaccagtttagggaaaaacataaaagacctgatggagctgaaaaaacacagcacgagaacttcatgaagcatacaaaagtatcaatagccgaatccatcaagtggaagaaaggatatcagatattgaaggtcaactcaaagaaataaagtgagaagacaagattagag

SEQ ID NO: 727708 - DNA, 425 bp, Homo sapiens
tcatcgctgattcctgagcgtaaaacgacgtccaggagtcccattcttggtcatagttgaatccggagtaaaaacacccttcacactattcctattttttgtccaaggggcccccggacaaaaggcatctaaaggagactctactataatttcaggtttcctactctggatagaaaccatcttctctgcaaacacacagtctgtatctctgtgttcattggtatagaaagccctgtatgcaagatggagagagccacatttcccctgagaggttcaaaaaagtttgaggttgagatgacatatctgacactctgttgttaccctcagaagctactacatgtgaaattcttaatgactgcattatcctgccaagtgaaagaggcaggcttgagcaagtgcggttaagaggggtgggagccttatca

SEQ ID NO: 727709 - DNA, 287 bp, Homo sapiens
gacaggactcatggttgctttgaattgggtccttaatatttgtatggaaaggaaaattcttttcaagtacagtaggagactctgtattcagagcaattataatctatttattggttattttaaaaacgtcagttaaggcaaggcaatcaccccacacatcaccatatccataagcattcaaacaaagcaaattcaaccacatattgcccaggtgccagtggctcaccacttgccaatctccagcccactttcggcgcaggctcgtgcgtgggcaggcattcgcttgc

SEQ ID NO: 727710 - DNA, 561 bp, Homo sapiens
  misc_feature (423)..(423): n is a, c, g, or t
gggttttgctatattagccaggctggtcttgaactcctgacctcaagtgatcctccacctcagcctcccaaagtgttgggattacaggtgtgagccacagcccctggccttaatcctttttttagagacagagtctcactgtgttgccaaggctggtcttccgacttaagcacaacaaccaagcctcttttaattttaaatacaatcttttccttattattctataagatgaacccagaatatttttcatgggcctggagatggtggaatggaccacacttgggacaaatcaatttatttgcgcaatatgcgcttaagaggtgagtaacccacggggcgtatatatatatatatatatatatatatattgagagagagagtttctctgtgacacacactggtagtgacagtgatataacctgntctctgtgaactctccatcttctgggtgtagacgcctacatcttcttgtttccacgagagctgagactacaggcatgtgccaccacagccagattatttttgtatttttagtagagatgatgtttcaccattgttggc

SEQ ID NO: 727711 - DNA, 349 bp, Homo sapiens
tgttttttttttaaaaaaaaaccaaaaaccaaggggggccttgtttgtagagggggggccggccccaaaaggtatttttcccaacccccaaaattttggtttccccccaaggttttttaaacccttccccggggaaaagcaaaaaactttttttttcccctttcccattttcctaaaaaggggggcccaaggggttccgttggcgggattgcaacctttttttttgaaaactttttttgtaaaccccattcccctgttccgtttttttgttaactgccctcccctaaaaagccccgttgaaaaaccctttttaggggggttttttaaaagggttaaaataaaagcttta

SEQ ID NO: 727712 - DNA, 128 bp, Homo sapiens
  misc_feature (97)..(97): n is a, c, g, or t
cttcctggtggtgccgctatactgaattttttgttaatcaatcccatgcatattctactattcttactagatatatacttattcatatgcactcacntaaacatatatatattaagttggtttcaaaa

SEQ ID NO: 727713 - DNA, 836 bp, Homo sapiens
gatccacggaagggtcttgtggccggtacacgagcgaccgtgtcgatgatcagtaccccctaagagcccaaagtgcgcaaggccaagactcatctgatcacttgtcggcttggacacgtagattcgggcaagtccaccaaatatgggcatctgagtctataaatgcggtggatcgacaaaagaacatggagaaattgagaaggaggctgctgagatgggaaagggtccttcaagatatgccgtgaggtcattggattaagagcgtgaaaggctgagcgtgaaagtggtatcgaggcattgatatctccttgtggaaatttgagagcgagcaagtactatgtgactagtcattgatgccccaggaccacagagactttatcaaaaacatgattaccgggacggtctcaggctgactgtgctgtcctgattgtgctgctggtgtggtgaatttgaagctggtatctccaagaatgggcagacccgagagcatgccttctggcttacacactggtgtgaaacactaatgtcggtgtacaaaatggattccactgagccaccctaaagcagaagagatatgagggaaatcgttaagggagtcagcacttacattagaaatgggtacaacccgaaaagtagcatttgtgccaatttctggtggaatgtggcaattgttggagcaagtgtaaaatggctgtggtcaagggatggaagtcaccggaggatgggatgccgttggaacaggtgttgaggtctggaggttctacacagttgtcaatgacaggctggggctcttcggatttacaatggggttggacgtctctggcgggggagtgtta

SEQ ID NO: 727714 - DNA, 241 bp, Homo sapiens
ccccccccagcaaggatggcgctgttaacatagccccccctgttctgggggccctgggaagcctagataaggccgtgagcaaaaaaaaggggggggtcctcctttgttgtttaaggaggggctagggggggaaacttaaaactgatttattacaggggggttgttcaggtccccccaacccccgtcagattttatgattttctagcagggctttcaaaaataaaaaggtttcatgctgtga

SEQ ID NO: 727715 - DNA, 725 bp, Homo sapiens
  misc_feature (170)..(170): n is a, c, g, or t
  misc_feature (304)..(304): n is a, c, g, or t
cacaccaagctgtccagaaaaggccattcagatacgggataatccatattgtattacctcaagaagttattggttcttcggcatggatttgttcgtgagccttatgaccacgtccatgcctagctccctcagcccgccatgcgtagcgagggagagctggcaccctcaangagtgcatcacgcccgcctaaacatggccacctagtagaggtccacacatcactagaaccacgagtcactctagttgatgtcgccatcgaggaggtatcaagtcacactggagtctcgaccgagtagatctacntagattcatatcaacccgacataccgaggatatattcaagcgactgcttcattacaagtatgactggggtctctattgttagcctcactacagagcgctcagaggtagcttcgcagtcgtccctgtcaccagtgtgtccgaacggtggcatctacgacatcaacgattttatatgtaggccgagcagtgcttccacggtgacttcgacgttcattgattggactcgaactttcctcactatctgcttgcagtccagtgcaacgtaagtatttcagcttgtactgtccaacacatcacttagggcttcgagagcgcgccagctgatactggcagtttggtcagatcgtggtctctgactattatctgtattgtctccatctagttgatgagggtcttaaaacaaaacacactgaacagggca

SEQ ID NO: 727716 - DNA, 420 bp, Homo sapiens
cggcacgagctcgtgccgaattcggcacgaggaacacttttacactgttggtgggactgtaaactagttcagtcattgtggaagtcagtgtggcgattcctcagggatctagaactagaaataccatttgacccagccatcccattactgggtatatacccaaaggactataaatcatgctgctataaagacacatgcacacgtatgtttactgcggcattattcacaatagcaaagacttggaaccaaccgaaatgtccaacaatgatagactggattaagaaaatgtggcacatatacaccatggaatattatgcagccataaaaaatgatgagttcatgtccttcatagggacatggatgaaattggaaatcatcattctcagtaaactcttgcaagaacaacatggacacaggaag

SEQ ID NO: 727717 - DNA, 127 bp, Homo sapiens
catcagtacacaaggagaataatagatggggtttattaaagcgagcaaagtctgcattttacctggtgcgcctgagtggggtctttaagagtaatggggggtctcccatgttttctatgaaccatgg

SEQ ID NO: 727718 - DNA, 691 bp, Homo sapiens
ggagcagctggggagtgctcttgccgagatggaccgacagctcagtgaggctggcagacaccccgtgtgctctgccagtcctgcatgagcccggcgacgaagagagtgtgatgctggatcttgccaagcgcagtcgcagtggtaaattccgcctcgtgaccaagtttaaaaaggagaaaaacaacaagaacaaagaagctcacatgtatgcctgggagccccggttcacctctgggtggacagaggaggttgctgcctggctggagtcacctcagtctctgtgagtataagtgacatcttcacactggtacgactatccggtggctctgagctcctgcacctggagcggagggacctcatggaccttggtgcgtgtaccaaggtggtgccacatgtaagaggatcctgtgtgcgcatcaaggacgcttgagccggcagcgtccctcgtgcgtcgaggcctagcctcatgtcctcttcaagctctgtggctctccactatccgccgtcacgcctgagtgccttagccatcctgccctctcagtcgctgtggcactctgcagtcctcctgcacactgaggccctgggctagatgctgtcagcccgtcccccttctcattggtgctacttcctctgtcagctacagaaagcctccgtgacaaccgtccagcagagctctggggtctcgaacata

SEQ ID NO: 727719 - DNA, 605 bp, Homo sapiens
tggtcactgcaacctctgcctcccagttcaagggatctcctgtctcagcctcccaagtggctgggacacaggcatgtgcaccacgcctggctaactttttgtatttttagtagagatggggttcactatgttggccaggctggtctcaaactcctgacctcaggtgatccacccaccttggcctcccaaagtgctgggattatgggctgagccactgcactcagcctattattagtttttgagatggagtctcgctctgttgaccaggctggagtgcagtggtgtgatcttggctcactgcaaactccacctctcaggttcaagtgattctcctgcctcagcctcccgagtagctgggattataggcgtgaaccaccatgtccagaagatttttgtgtttttagtagagatggcgtttcgccatgttggccatgttgatctcaaactcctgacctcaggtcatctgcttgcttcagcttcccaaagtgctgggattataggtgtgagccaccgcacctggccccatgtgtataattcttattaccctctctgttggctctgtgtcataaggggtataacatttaaagctagaggggtctatgtgc

SEQ ID NO: 727720 - DNA, 933 bp, Homo sapiens
agagtggaactagagtaaagttggtacgagttcagtggaggagaccggaagtggagtggaggaggcagggggtaggggccccggaccaggtgcctcgcatggcaggcgtctgaagagctggggctcctgggaagacacgcggagggtcctagctgccgttccttaggcgtggtgaggcttgccggggtctcctgttccaactccacctagaagccctgaccaagaagagccaaccagacttcctgagccgccttcgaaggatgtcgttcccatgcatccctggggcgaggagctagccccgctcatgagtcccctcggatcttgctctctgccctatccggagcccatgctatggtttagagcctggcccagctactccagacttctagtgctttggtggcccagcggctggaacagctggtccaagagcagctgaaatctccgcccagtccagaatgacatgggtcccccatcgacagagaaggaagccatactgcggaggcctggtggcccctgctggaggaggaggcagaagtcattaaccacgagagctggcctcggaccccgtcctgagcagcaagctggtgccgcctgtactccgacatctttcgcccgcctggtggagctgtcctgtagccgggatgacagctctcgaccatgtcgaggcatggccctggggccctcgctccttccccggagcccctgtgccgctggtcctatgccatggagctgagccgtgtgcgtggccggggctggggggcaccctggccaggactcagccgtggatgaactgtgtcgcagcttcacgccctggatccatggcccacctggggggctggggagggcatcttggctatgttccacctgtgaacatgtaattgccccattggactgagctctttctcagacgctggtaccatacatgcacctcag

SEQ ID NO: 727721 - DNA, 673 bp, Homo sapiens
tccctttgtgcttagttaggaaggcagtaggatgtggcctgcatgtactgtatatacagattattggtcatgctgggattcccaaccctcgaattctgctgtgaaactttcattcccttcagattgggcttgacaaaggcaggaggtacaaacagaagggctggtattgtcctcacacgtggctctgctgtcgctctcagttcctcgataggctcagagcagaggtggaaaaacagcattgtacggattttcagttacttaattcaaacacctcaaatgtcgaggtgcttttaactcttttacacctttcatacactagccttggcctcttccctcagccttaaggaaaccatctgccaaaaattactgactcctcgcatgatggcacgccatagtgccatagctactaaaactcagtgcaccttgaccattatcttagatggggagcctcgggaaagaggtacgaggagctcacgttaccattcacttgttttcacacgaaagaagtgtggggattctccactgaaacggtctaggaacatctagaagtactccttgcaggcacagcaaactaagactcttcacccatatgcttcgcgtaaggactccgaggactccaagcttacacagtccctatggcaacagatgggctctcaacaaccgaactagatct

SEQ ID NO: 727722 - DNA, 436 bp, Homo sapiens
  misc_feature (322)..(322): n is a, c, g, or t
taaactcggaaacacaaggggggaaatatattcttccccagggattataaacaatcttttcctttttttaaagtccttggggcttctagagctcataggaaaagggactggattggaattgggagccagagttaactggggtgggttatctatccatcagtttccggactggtcaagagaatactttaaagagaaaatagggtttttaaatcctaaaaatttttcttccactaaagataaccaagggtgcttacttatttgtaaacccatctatttaaaggcaagggggggtggaggtcagtttacatagcagaaaggtatncattatcctctaaagatgggtccgcgaaaacttccatgggtttagaatttcaaaatttcacctggtacaggggccagcccctaaagcgggaaacatttatatgggttctctgga

SEQ ID NO: 727723 - DNA, 219 bp, Homo sapiens
cagcccttgcttgcaccaggttggttttagaacatgcagaatgtggagcatgttccgctgtccttggcagaccatgcggctggtaaagatgttttcatttttgcggctagaaaaatgtgtacactggggacgcactccggatttgcatagtgaccaaaaaggctcagggaggaaatgtttcctaaggaaagaatgttttgtgtgtttttttccaccatc

SEQ ID NO: 727724 - DNA, 394 bp, Homo sapiens
ccagttgtgtgccttgacctttctcgcccctttctgggtgtgttcgcacatcctgtgtgtgcacagatgtccctccactggatcccctttacacgtgacccgtggggcagccagtcctcccagggactacataacaggcacctttgacagagcatgggagaaggtggataaaaggatgctgctcagtgcttttctcttccactttcctgccactccccactaccctcggagagaggtggtgggatgggagtagacccctttcaaatcctgtgtggatttgaagagccaacggcttggtctacctcaaaagcaccaccaccaggggccatgtttttatgctgaaagtgaaagctgccaaacctagatttggctgtgcccaaacatcttttgtttt

SEQ ID NO: 727725 - DNA, 188 bp, Homo sapiens
agtgctactccacaaacagagtgctactcccaaagtactgggatgacaggcacctgcaccatggctggctaattatttgtatttttaggtagagacaggttttcaccattgttggcaggctagtctcaaactcctgggctcaggcgatccaaccaacccgggctcccaaagtggtgggattaaagggt

SEQ ID NO: 727726 - DNA, 175 bp, Homo sapiens
tgtataaaaagggaaaaagtcagagactgattaactggagtgagaaaggcaagtaacaatttagttaaacaacctgctggcccaaggtcagtatgatatcataccttattaccagaatagttaagttcctgtaaagtccttaaccactctcgctcccattactagttcatcacta

SEQ ID NO: 727727 - DNA, 186 bp, Homo sapiens
  misc_feature (8)..(8): n is a, c, g, or t
  misc_feature (21)..(21): n is a, c, g, or t
  misc_feature (34)..(34): n is a, c, g, or t
  misc_feature (176)..(176): n is a, c, g, or t
tttgtacntcaaatattgaanttttattcaaaantctttataactttattacaatatagattttgtgttggatagttttgcccactgtaggctaatgtaagtgttctgagcatgtttaaggcaggctaggctaagctatgatgtttggtaggttaggtatattaaatacatttttnacttatgatc

SEQ ID NO: 727728 - DNA, 172 bp, Homo sapiens
gcgctcgggttataccgaagtgtgagcaggacataccggacacacggattgcgaaatgaacagaggaggggggcagaaccactctggttggggtagacgcaaggtcctgctgagctcttaaagaaagggcactgtatgcccggtgcggcggctcgcacctgtaatcccagca

SEQ ID NO: 727729 - DNA, 421 bp, Homo sapiens
  misc_feature (343)..(343): n is a, c, g, or t
gagactgcagaggtgggactgggcagtggggagacagcagctgtggccttgaggttgaatgtgccgttcggtggtggcggcggctgggcggagggacatcagagctgttcttgtgtctggtaccttcccctcagcccttccaggggcattggtgacaaagggcttactctgttaagcccagagacctcgaggctgaccccagggtagtcctgcccacccctccactccccatcaccatttccgcccacctggtcaccatcaccgtaccgcagtttccgtaacgagcaggcgcccctcggccccatcccaatgagtagcgtggacatccgcgatttgcacggcngagtgtgaccttgggcttctttaccaccccagatacgacgactaccaccacgagcgctggtagagggtccgtgcgcca

SEQ ID NO: 727730 - DNA, 421 bp, Homo sapiens
gggctcagaagagccagaccacgcaaaccaggagcacccttcgtagagatggaaactcctgccgtgagcagtcttgtctttcctatcagtccagcaactagcttaaaagtgacaggccacagcaagtgtctggcacagcacttgagatgcctgaatcccacactggagtcctggctcctccacttccaatcctgcttcctgcgactgtgctccccgggaggcagcaggaggtggcccaagtagttgggtccctgtcacctacatggaagacctggatggagttcctagctcctggctttgtcctggttcaaccccagttgttgtgagcatctggggaatgaaccagcagaggggagctctctgtcacctctctccctcaaattaaaattaaatgaattggctggcactgcagctcacttgg

SEQ ID NO: 727731 - DNA, 416 bp, Homo sapiens
  misc_feature (267)..(267): n is a, c, g, or t
  misc_feature (284)..(284): n is a, c, g, or t
  misc_feature (289)..(289): n is a, c, g, or t
acagaccagtaccagtccgtggcactggttaggaaccaggccacacagcagggggtgagcggtgggtgagtaagcacagcttcatctgtatttacagctgctccccaaagcttgcattactgcctgagctctacctcccgtcaggtcagcagcagcattagagtctcatgggagtgcgaaccctgttgtgaactgcacatgcgagggatttaggttgtgcactccttatgagaatctaatgcctgatgaatctaatgcctcatgatntgaggttgaatagattngtgcngaaaccatcccccacccccatcccgctaccccgagtccgtgaaaaattgtcttccgtgaaaccggtccctggtaccagaaaggttggggaccactggcttaaaataccaataaatttttgaccctta

SEQ ID NO: 727732 - DNA, 321 bp, Homo sapiens
  misc_feature (207)..(207): n is a, c, g, or t
actataccatggagggggaaaggccccaaaaaaaaatggctgggggttttaaccccaaccagggccttaacaggcttatgctggctgtgcgcgacattatggccaacttccccctcaacgacctggaggccccgcccaaggaccacccttagggggagggggagtgggacttagcgtccccaaaggtgacccaaaaaccgtataatnatgttccccatttttttgttggtcggagtcggccagttgccttaagtagggaaactgagtgtgtcgctccctggtcccctgtttttcctataaatgtaaatgggtcccccccca

SEQ ID NO: 727733 - DNA, 187 bp, Homo sapiens
cattaattgcagttctattgttattgacaatgttccagtgcatcaattgctcagcagtctgatccaattcacatttggggaaggaatagtctttgctattaagtctttgagtatttgttctagatctgacagagggctcctcttgagctaccgtttccctgaattctctctgcatgaactagtatgg

SEQ ID NO: 727734 - DNA, 402 bp, Homo sapiens
  misc_feature (83)..(83): n is a, c, g, or t
  misc_feature (109)..(109): n is a, c, g, or t
cagaaaggattgggacaacttgaaagtggggtgggggcttcccagcttattaggttagatttaaaaattctttctgtttgacnaattggttgagtttatataaagaccntgggatcaacagaaaggaatatcttgggcttaagataaagaattgtgggactgggccatagtgctcaggcctataatcacagaactttgggaggccgaagcaggcggatcacgaggtcaggagatcgagactatcctgactaacacggtgaaaccctgtctgtactaaaaatacaaaaaattagctgggcgtggtggcaggcacctgtagtccctgctactcgggaggctgaggcaggagaatggcgtgaacccaggaagcggagcttgcagtgagcggagatcacaccaatg

SEQ ID NO: 727735 - DNA, 123 bp, Homo sapiens
ttgcgtgcatgttgctctaaggatccccgcgctagcggattaagtgaacggatcaaataaaattatgagacagtttgctaatgacatgaatgtagcacttgcgttcacttaatgccgctagcg

SEQ ID NO: 727736 - DNA, 409 bp, Homo sapiens
taaaattagtttattatgacaaaattgcctacagatggacataaaactgtcttgaggaagggcacctggtttggactgaatcgtgtccccccaaaatcaaatgttgaagcctaatctctaatatgatggtatttggagatggggcctttgggagataactaggtttagatgaggtcaagagtgtggggccttcctgattagtaccctgaaaagagaaaacaccagagagcttgccctctctccctcttaccccacaggcacacaaagaggtcatgtgagtacacagtgagataacaaccacctatgagaaaacagaagaggcttcagagtgaaatctactttgctggtactgtaatcttggacattattctctagaactgtgagataataaatttatcttatttaagcc

SEQ ID NO: 727737 - DNA, 117 bp, Homo sapiens
ccgctagcgggcattaagtacggcgctagcggattaagtgaacggatcaaataaaattatgagacagtttgctaatgacatgaatgtagcacttgcgttcacttaatgccgctagcg

SEQ ID NO: 727738 - DNA, 169 bp, Homo sapiens
accattggatacataggtatggtctgagctatgatatcacatggcttcctcagggtttatcgtgtgagcaccacatatatttaccagtaggaatagacgtagacacacgagcatatttcacctccgactcacataatcatcgctatccccaccggcgtcagtatagata

SEQ ID NO: 727739 - DNA, 737 bp, Homo sapiens
  misc_feature (142)..(142): n is a, c, g, or t
  misc_feature (150)..(150): n is a, c, g, or t
  misc_feature (188)..(188): n is a, c, g, or t
  misc_feature (244)..(244): n is a, c, g, or t
  misc_feature (249)..(249): n is a, c, g, or t
  misc_feature (293)..(293): n is a, c, g, or t
  misc_feature (332)..(332): n is a, c, g, or t
  misc_feature (405)..(405): n is a, c, g, or t
  misc_feature (457)..(457): n is a, c, g, or t
agagacagagtctcactatgttgcccaggctggtcttgaactcctgggttcaagtgatcctcccacctctatctcccaaagtggttcagattacaggcgtgagccactgtgcctagcccctagtcattttctctacatatanacacttanccacaataggattctactggatccactgtcttataacntactttttctatttaatattatactggtgacatcttcgtggtattaaatattcttnaacantgccccaccccacccatcactcccacagctgcagtatactcttntgtacctcacttctcaaaaggaggaaaagctcttactcntggcttaaagtgttctctttaataataataccaataatattcactgaaaattaaggtatcaattccaaaggcncggcacataccaatttctcaagaatcagcataagcatactctagaattcaangtcaacatgggaagttcagctccctgtagatgtagttcaatccaagagccacattcatttatcttctggtgttaacaagtgaggaggaaatacagtctgaagcttaaaaaccaagttactgacaataattacggctgcatccaattgtcacacacaatgcatgaagcacaaaaggaatgagagcaaggaggagaatacaaagtgaaatgattcagtcgtgctttttctttctcttttgaaatgaggtctcattctgttgcccagactcgagtgcggtggt

SEQ ID NO: 727740 - DNA, 468 bp, Homo sapiens
atgtaacctgtgtttaactaggttacccaagaaacaaagaaacccagacccaggctggggagcacagccacccccccttctcagctccaaaccaccttgtcacagatggcggtttcttcagctcccagctcctcaaacaaagcccatacattcctgccagattcagcttgcaatctttcattctgtccaagaagcaaatctgtttaccatattgaaaagctagaggagttgcaaaaaaaaaagtggagagaaaaagctgttttatgaattataaaaggtgagcttgaatttttttaccaggggattcatttctgtatctccagaagggaaaacaaaagatagtcgggatacgtgtgtgtggaccatttcaatttggaaaagttacagaaggagtttcgtaggtgaaccttttcctctggatcttagaggagggaaaattgggggcttatttttcaagaaaaagagtag

SEQ ID NO: 727741 - DNA, 1037 bp, Homo sapiens
  misc_feature (1037)..(1037): n is a, c, g, or t
ggctctgcgcaagcgcgaccgaccgagcagctccgaaggagtccgaccgggaaacaaacattcacccagggtcaatgtcacgacttgggtctgcccgaggagccagtcagaaacgagtttacgtagatgagtgctaaggcccgcgttaagaaagtatgataggttggaggcgaagatattctcagctttgccatataatcaaatagctccggtcgcgtttgtgaccatctggtgtgctaacagtaacggagaaactgccatttgatatgtgcaccgatccgggtacagacgaagcttaagaatgggacccctgcgagaagtgtgtcttccctggtaggtaagacgtggagactactaagacatggcatgattgcaaggccagcgagctctcctgcggaagacccaggagagaacgctgtgcgttctccgttccctcacacaacgatgggagacgtatcgtcatggcatgcgctgtggttgaccaatggtgcttttaattcggcattgcacagggatagcatttggattaaacttccaattacgaaggggttttacatatgacccaggaagcttccacggccccagcccgacatccctgcctgaaagttcacaggatgttattccagtggtgccatcctggaccctattaatccctgcaatccacaaagggttcccatgaaccaaggcatcttacgttccacaacagtcactgggtcaacgcgttctgacacttaacatcactactcttttagaaggtaacacacaagacctcttgaaaggaccgggtggtccctttcatccaagactcacagggcgaacctggagcgtgccatcacctttggccaagttgttaggcgtgcgcccttatcaactcattctgtgggccacaccacagcaccgagacccttttggacgggttccagatttagtccttcaatcggatcgtattcaagccatcctctctgacaagaagtctctccctggacagcgtccatccacagcgcgcgtaaaagccaggttctagattctactacgan

SEQ ID NO: 727742 - DNA, 255 bp, Homo sapiens
gggctaacgaacctagatcaggacggcggtgtatgaatactcccccttaaggttacaagtaactacgttaacgtgactactagaaatagactcaacagactacttaagacggacaacatcctcaggccaaaaagcatcaatgtaggtttgacactagatataatgctaatcagcaaaaaatgacatgtgctgggcatctgaatttttttttttttttttttttttccccaccaaagggtcaccccggggtcccca

SEQ ID NO: 727743 - DNA, 134 bp, Homo sapiens
cggtgtctagaggatccggtttcatccccttcgtacggttagcagtgattttgcaatgctgcttataacacatcccaagtgcaggccgcagtggtccacgtacatccagccccatcaagtagacttatggttga

SEQ ID NO: 727744 - DNA, 105 bp, Homo sapiens
actcaggaggctgaaacaagaggattgtttgagcccaggagtttgaggccagcctgagaaacataagagagacctcatttcaaaagacaaaacaactgtcccccc

SEQ ID NO: 727745 - DNA, 486 bp, Homo sapiens
ttaattttaggaacttaaaaggagtctagaaaatccagcagaaaggaaaatggaaggtcagaattcccagagtcctcaatgtttcaaaacatgctcagagcaaaatggttatgttctcacattggcaaatgcacaaccaggtctgcaatatggtaatccttatgcatctcaggaaacaagaggttattacagtatttttggtttgggattagctgcatctggagatttttttatggtttatattttcatggattagcaaactgctgggataatcaaccctaatacaaacattaattaatttggaaaattggcaggtttaaatattaaacactgggaactgggtttatcttagaagtgatgcacccatgagaagagtacctttattttacttaatggcataaagtgtcacaaaattaaaaaatacccccggggttaaaaataaaaacattctatttttttcacaatgccaaaatggggcctataaaa

SEQ ID NO: 727746 - DNA, 144 bp, Homo sapiens
cgacactcttggttgataaaccacaaagatgtgcaggaagtagttcctataaaaatgggaatggtggttgcctattggaggaggaggtggcagtgggctgaggtcgtgccattgccttcccagcgtgggcaaccaagagtgtcg

SEQ ID NO: 727747 - DNA, 106 bp, Homo sapiens
aacttccttttaaaaaaaattaaggggaagggggggaatttccctttttatgttggggggggccaatgtttatcaaaagggccaaataaagttaatgatgattcca

SEQ ID NO: 727748 - DNA, 100 bp, Homo sapiens
atctcatatagttcggccccgaagttacaaatggagataagtcgatacctaaacagaatgtgcttaacagaatgtgaccaattttatcactcccaaggac

SEQ ID NO: 727749 - DNA, 372 bp, Homo sapiens
  misc_feature (61)..(61): n is a, c, g, or t
  misc_feature (170)..(170): n is a, c, g, or t
  misc_feature (201)..(201): n is a, c, g, or t
  misc_feature (207)..(207): n is a, c, g, or t
  misc_feature (359)..(359): n is a, c, g, or t
cccccctatcctcctacaaaaaattttaaacattagcctgggccatggtggtatgtgcctnacagctcctagcctacctcaggaggctgaggcagcaggatcacttgagtcccaagagttcaaggtagcagtaagctacaatcacacccactgcatgcccagactgggtnacagagggagacttcatctcttttaaacatnataatnataattacagactcaggaaatgcagtgaaagaaaaatacaggttggccaggtgaggtggctgatgcctgtaatcccagcactttgggaggccaagatgggaagattgctttgagaccagaagtttgagaccagcctgggccacatagtaagntcctgtttctacc

SEQ ID NO: 727750 - DNA, 707 bp, Homo sapiens
  misc_feature (1)..(1): n is a, c, g, or t
naaatgcgcccaagtggccatttgcgtacttcgcctaagggttcccaaatatttctaagaaaaaaggggccaccatattgtggacctcttcctgaaccaaaaggatatgcttggggctttaatcatatcaacggttggtccttgaacaagtttaggtgtgttgcatgttaaagtcacaagttatttacaaatctcccctaatactgcacaaatatctttcgtaacaagtatcgcatgctgttcagctgtgtaagttgatgaacaatatgttcgcaaagagtttaatattaaaacattctcgttccgtgcagatatatgaacgctttctgaaaagtccgtcaaatcaaatatcttttgctcttgttgacgtgttttcacaagcctatgcagcataagagccagttaaagctgttatggatgatttcgcagcttttgtacacaagtgctgctagtctgcggatatgatgacatgctttgcagaggagggtaaatacctagttactgcaagtctagctaccttagtcttataacatcgcgtttataagcatctatgcccaccatgtgaataagagaaagagtttgtagatcacacgctgattcatgtgtttatgatgttagttggtgcacaaccaacaccctgttttttatacatcgatttcttcaatcatttcgcggcgtttctctgggtgccattaataaaagattga

SEQ ID NO: 727751 - DNA, 286 bp, Homo sapiens
ggacggctcttacagctctcttgtactcactgatgtccttcttatgcttgcgtcaaacactccagccactaaaatggttgaccatatcggttgtcaaaatcttctcccaccaagtgggtgtctccaagctgtcgacttgcacatcaaagcttcccatcctcaatagcgaggattgaccacatccaacaagtgcccactcccaggtcaaagatgagcacgtttctttctgctcccaactttttgtctcacgccgtcagctatagcaaccgggattgaaagacggcca

SEQ ID NO: 727752 - DNA, 914 bp, Homo sapiens
gagatcacaggactggagagtgagatggagtgagatggagtcctggagagaaaaagaagagaggtgaacttaatgcttgtcatatggtggccagaatggtattcgtggcgcagggcatggatgctgctgcgtgctggctcttccgtgctgctgctcttcctgctgcccaccctggggttctgcagccccagtgccaagtacttcttcaatgatggccttctacgatggctggatcctcttcctggctgtgctcgcgatccctgtgtgtgccgtgcgaggacgcaacgtcgagaaccatgaagcatcttgcgtctaatgctggatccacatctaaactacctgtagcgggtatccgagtggaggtgctgaggggctctgccaattccctccctcgctagcgcctatgttgttgtctccaagcactcatgagctctctcgaatctgcttgtggtatgatggcggtactgccatggtcgtgtgtggccattgccaatcgcgagctactgtggggtggttctgccgggactggcctgttgtgctggcgaggagtcatgttcatcgaccggaagcgtaacgggggatgccagtcagagtcatgtctgaggtcgtccagatccgtgagtaaaccaggacgtgagggtctgcggtgtgaacctgaggggaagggaagaagaccaacaagcgtgatccatgctgggctttcacatcgtggcgcacttaccattcttcggcagtgcagggccccagggtgcccattcgttccccaatagttcatgttctccttatcaaggagtttttactgtcaatgcaaagacgcggttcacttcacctcggggacaatgttcaggtgggggtgcttgacctcaggtgccacggaagggtggacccaggatgagtccatttgggtgaaaagc

SEQ ID NO: 727753 - DNA, 378 bp, Homo sapiens
  misc_feature (74)..(74): n is a, c, g, or t
  misc_feature (77)..(79): n is a, c, g, or t
  misc_feature (81)..(82): n is a, c, g, or t
  misc_feature (86)..(86): n is a, c, g, or t
  misc_feature (88)..(88): n is a, c, g, or t
  misc_feature (95)..(95): n is a, c, g, or t
  misc_feature (112)..(112): n is a, c, g, or t
  misc_feature (119)..(119): n is a, c, g, or t
  misc_feature (121)..(122): n is a, c, g, or t
  misc_feature (167)..(167): n is a, c, g, or t
  misc_feature (171)..(171): n is a, c, g, or t
  misc_feature (218)..(218): n is a, c, g, or t
  misc_feature (352)..(352): n is a, c, g, or t
  misc_feature (354)..(354): n is a, c, g, or t
ggggaacaagcgtagcatttacgaatggcccagcgtcctcttaatcatggccacagctcccagccagaatcacngcnnnanngaanancccctgntgacaagaactataatnggatggntnntaaactaaaactaaatatttcttctgttaagttacaggaaatgtntctngcatagctggcaagaaacgtgtaacatatcatataactgccctttanggcagactcaggctcatagacacctagctagggaaacagcaaaagcaaggttttctccctgcactcccctcagtcacaccccttgtgctgggtactctgaaccactatagagagtggctcccactacttcattngncactcctttaaaatagactgtttg

SEQ ID NO: 727754 - DNA, 477 bp, Homo sapiens
  misc_feature (5)..(5): n is a, c, g, or t
tttanagcagctcaaatttctagtgtcttctttgacatttctgtagaactttatccactcagacttttctttcttccttccttccttaacacatttcttgctgttttttccagctaggccattattacttggctttcaagattttaaatgattaaaaggacacacaattagaatttgatgtgaggggaattagtattttgggaaaaatacctatttaatgagatgagaggaactgtttctccactagagagctgagcagggcagcagtagcagtaagctcctgaggagacagaacaggctcttaactgacctatgggggtggaatacagatgcacagctccaggtattgtgtgccctctctctctctgatagatatggctgttggctgtaacattccacagtctgtgtaatgaacgtttatttggtattgaatacaaaatacatttttgaactatgcattacttgtaaaaaaaaaaa

SEQ ID NO: 727755 - DNA, 213 bp, Homo sapiens
tgaggttccgtatgacatgcgctacgcggctaagtcagttcgcgcgttacggcgccgcctccgggggttggtccccggttcgttatggccgtcgccggaacaggtgcgggagctggaggccgaagaacgcgattggtacccggagcctggcagaccatgcagtgagtcgctgcgtggtgaagcagcttggccagaagagcagaacgcgttcgg

SEQ ID NO: 727756 - DNA, 875 bp, Homo sapiens
gaatttgtgtggccacgggtgcaactgttgtgttcagggggggcccccacagtttgtatggggggcacaaaagaggggttccagtttcggggaaaaatcgggttttttgttggcccacgacggtaatgctgtccctaagtgggtatttcatcggaatcgtatagcgccatcggtggttttaaggtgcaaaacaaccccagtattaccatggcgggcatcatcccaccaagactactggctggccgcccaagttgttgctgtgccattttttgtccgccgcgccaaagcatgcgctgttgcgtggtccaaacgtggttagattgttcacggattaccaccatcagggccgcttacgttgttttatgaaggtcccgcgaaagtacggcgcaagcacgaggatttctgttgagtgaccaaacggcactaattatgcaacgattgtaggagaagacaccacccgtagagtgtgtcggtgcgaaaactgaacacaagccaagcgctccggcggttgtgtgtatacgactcgccccgcccgttatgcaacgacgcgctggtcaagccttgtgtctttgtctccaaagagcgggggacacaagatccccttgtatcacaaaggaagagagagcattttattacaaaatataaggagggaaaacaaaaatgtgggtctcggccttatcataatggagtatgtagaataattgtctactactgtccacctatgcgagtgtaaaggaggatcacagcaacccccgcagtcaacgcggcacgcccctcttcctcaggcagtgattagctgtttcccaccaacgcacccttcgcccaccggacttgggtcccctctcgggctcccaaaaagcccaaaaccccacata

SEQ ID NO: 727757 - DNA, 183 bp, Homo sapiens
cctctagaatgctctaccaggcccactctggaacctacagaactcaaccattttcctccctgaatcccccctggggaacttaatcacagccatgaaggtttaaggcaccagtgacggcctgcaggcatgctcccccaggtcagtgggcagcaggcaagggatcgtctataggtctagctgcag

SEQ ID NO: 727758 - DNA, 222 bp, Homo sapiens
gttccccccccccctttttttttttgggagggcggcccagtttggccccctacaaccacagactggtaaataggaggggcctttcccggggaaaacaaggaaaaggttcccttgacccccccaaaaacccccccaatttgggggggggccttccctttggggaaaaataaaaccaacccgggggttttttaaaattttaaaaaaaaagggaattttttccga

SEQ ID NO: 727759 - DNA, 286 bp, Homo sapiens
tcgacctggagtgcaatggccgatctcggctcactgtaacctcctcctcctgagttcaagtgattctcctgcctcagcctcccaagtagctgggattacaggctcctgccaccacaccggtcagttttgtatttttaatagagatggggtttcaccacgctggccaggctggtctcgatctcctgacctcaggtgatccacccaccccggcctccccaagtgctgggattacaggcatgagccacccatcttcctttcagtgccgtgggtcgacgcggccgcaagt

SEQ ID NO: 727760 - DNA, 380 bp, Homo sapiens
tgccattctttatactacttatcaggcttttcgaaaaagcaggggtgggggcaaggtgcggtagctcacacctgtaatcccagcactttgggaggctgaggctggtggatcaattgaggtcaggagttcaataccagcctggccaacatagcaaaacaccatctctactgaaaatagaaaaattagctgagcatggtagcgggcgcctgtaatcccagctactcgggaggctaaggcgggagaatcacttgaacccctgaggtggtggttgcagtgagctaagatcacaccagctactcaggaggccaaggcaggagaatcgctggaacccataaagcggtggttgcagtgagctgagatcgcaccactgcactccagcc

SEQ ID NO: 727761 - DNA, 127 bp, Homo sapiens
tagcttctcagattttcaggtcatgaaacaagacaccattaagaagcccaaattctagaatatagtgagacatcctctccataaaataataataataattagccgggcgtgttgggcgataacatca

SEQ ID NO: 727762 - DNA, 141 bp, Homo sapiens
ggctagctggctgctcgtgttgtcaggtccccgaggcatctggctagtgtgtgacgttctggcggtccgttctgtccgcttgcgctccaggtctacactgagtggctcctgggggaagaagccctgtaccaggcatgcgag

SEQ ID NO: 727763 - DNA, 861 bp, Homo sapiens
aaggattttatttctccttcacttatgaagcttagttggctggatatgaaattctaggttgaaaattctttaagaatgttgaatatggcccccactctcttctggcttgtagagtttctgccgagagatcagctgttagtctgatgggcttccctttgtgggtaacctgacctttctctctggctgcccttaacattttttccttcatttcaacttggtgaatctgacaattatgtgtctggagtgctcttctcgaggagtatctttcagaaagttaacaaggatacccaggaatgaactcagctccacaccaagcagacgtaatagacatctacagaactctcctccccaaatcaacagaatatacattcttttcagcagcacaccacacctactccaaaactgaccacataggtggaagtaaagctctcctcagcaaatgtaaaagaacagaaattataacaaactgtctctcagaccacagtgcaatcaaactagaactcaggattaagaaactcactcaaaaccatgcaatacatggaaactgaaaactgttctgaatgactactgggtacataaacgaaatggaaggcgaaattaagatgttctttgaaacaatggaaacaaagaacaataccagatctctgggacacattcaagcaggtgtagaggggaattttagactaaatgcacagagaaagcggaagatcaaatgaacctagtacataagatgaagagagaaatcaagtaggagctgatattattggcgaagtgggtggaaaaactaatagatcggggttgggcacatgggggggcgaaaaaaaaaagtggggcataaaggggcgaaaagaaggaggttag

SEQ ID NO: 727764 - DNA, 340 bp, Homo sapiens
ggagtgcaactatcagtcttacatgtcacccctttagtcttccctgaccaccctatcaaaagtgggtttctggccaggtacggtggctcatacctgtaatcccagcactttgggaggccgaggcaggtggatcagttggggtcaggagttcgagaccagcctggccaacatggtgaaaccccgtctctactaaaaatactaaaattagctgggtgtggtaatcccagctactcggggggctgaggaaggagaatcacttgaacccaggaggtggagattgcagtgagccaagatcgcaccactgcactccagcctgtgtgatagagtgagactctgtctc

SEQ ID NO: 727765 - DNA, 181 bp, Homo sapiens
ctacaagtcatacgaggcggcagcaggagcgaccaactgatcgcacacatgcttggttgggatatggagtgaacacaattatgtaccaaatttaacttggcaacctttctatggcctgtcccatgtgcatcttatttaaaatttcccccatggaattcacctcctgatttccaccttgcca

SEQ ID NO: 727766 - DNA, 563 bp, Homo sapiens
tatggaactgttgtgaatacacttagatctttgctgtactgagaatcatatatttcccatagtgatgctggtatgtactcgaatgtagctactagtttacacttccagtccttatcagccaccacttatagatatatatattaattcccaggacacacaaactctaacttatgttcaccacattccatactataacagtcgaactgacacccctgcgttctgctttccagcttccactctccagtcgtgatgtgctactaccaccctgcgcggtattgctgttcaagttgaccaaaaaaagaaaaaaaaaattctacagtaaaaatcagtcctaaatgtagaagggaagatcatttaataacaaatcacaaaccactcttcatctctatttgctctgcattttcagaaaccatagaactttatattacaagttaatcaatccacatcacatctctggagagaggatcagcataaaaaaacaaacaaaatggaaaacaggagccatgtgtcagaattaggctagtgtcacaggatcttctatggaggtgacgaagcctcttcat

SEQ ID NO: 727767 - DNA, 707 bp, Homo sapiens
  misc_feature (18)..(19): n is a, c, g, or t
  misc_feature (31)..(31): n is a, c, g, or t
  misc_feature (327)..(327): n is a, c, g, or t
cccgccaatgaggagagnngggacggggggnggaggaggaacggggcagactccaacaaaacattacctctatgcccagttagtaatattagggttggagcaattcaagcactgaacggaggtgagggacctctccgcccaaccaaacgcagaaccaacgaccgacccccccacccccccactccccccctcccacaactccacccctcccaccagacaacccgcgccgcccccacgccggggacaagggaatgtatactataccccagcccacgcgcaacgcaagccgaaaaagacgcgtggtgagaagagtgggggtgctccttntcgccattttctcccgcttttctataatgttttattatgttgggtgtagtcgacgcgcattgcttaagagacgatgacgtctcgagccgcgccgcggagaacccgaaagatacccttcatatccaagtgaactagttagtcgactctctgatgaggtctcgtgcctgtcaatcaaccaaaccactcctcgaaccaaactcgaccccacacaaccacccaccctgcaccaaaaatctccagaggataattgttgaatcagactctgcgcattaaaacagtatcaataacacaagaatggcgtcaactctccaagaaccgccgaattaccatcccgacaccacgcgacagtccccacccccaattctactattctagatcca

SEQ ID NO: 727768 - DNA, 229 bp, Homo sapiens
accaaaaaaaaaaaaaaggtccaattagctgggttgggggactggcccttgtggccccagttgttgggggggctgagggggaaaaattgttgggccctgagagctggggtttatggggagaacctgaaatgccccactgacttgcaccctgagggacagaccgagcccttgtctaaagaaagaagtttgggaagggtttttaaaagactctattttaaaacaaggcggg

SEQ ID NO: 727769 - DNA, 282 bp, Homo sapiens
ggacattggaacactatactctattattgcggtcgtgcctagcagtctcgcgcatgtctcctcagcgcgcacagtctctctcagagagctcttctctctttatatgcgcagacccgcagactgggagacccagacccagggcaaactctcttcttaggtatatcgcacccatcatatctcacacatcgtgtatgtcgtatcatcagacccccatagagcatatatgctaaattaatgctctctttcatcagtaattaccccatatcataaaatgcgggcggg

SEQ ID NO: 727770 - DNA, 378 bp, Homo sapiens
tggtcggcttgggtttggctattaggagacaggtctcacggtggccaaggcgggagtgtagaaatgtctactttattgggcatctctctcagtaggtgagcatgaattttttttatatgcttatttacatttaaaatttcccagggcctatgatttccttggtacacatatctgtggagatctggaggtatttatttctacacatctgaaaaaaatagtacgggtatggacccttttatcatattggtcattctcagactactatcttctataattttattttccaataagaaaatattttaacatttggcatatttaggtggacaaaccttttccttggtgatttcttcgggtttaaaaaagaaagttatcattcct

SEQ ID NO: 727771 - DNA, 187 bp, Homo sapiens
gtaagactgtgctagtgagtaaactgcaggagagtacttgagatgaggcaggagaggaaggccaggaccccggatcaggtttgaacgggtcttgagccatcaggtgaaggcgttagactgatttgaggcggactggtcctttttgtatagtatgtgagagaagtggggacaaggtggggagtgggca

SEQ ID NO: 727772 - DNA, 263 bp, Homo sapiens
cgtttttacctgatatttgaggtattccccctttgatccctttaatggccactgttgtctgcatgtaactgctcacctgccatcagaatgcgatttcccactgtctctcacttctttgtatctagaagatgtatctagatgtatttagaagtgtctgtacttcacaagctggaggcagggatgagggcctctaatactttagacaatgctaggtaccagacggtttaaccagttttactaactgggaatgcgggctgtatagt

SEQ ID NO: 727773 - DNA, 196 bp, Homo sapiens
gaaggaaggtagacgatttacacatttgtttcacagaaaaatgcccaggcaagtctacataaattatgctgagatgtcttcaacttaaagcttttttttgagacagaatctcactcggtcactcaagctgaagtagtgcagtggcataatcacagctcactgcagcctcaacttcccaggcacaggcaatcaagct

SEQ ID NO: 727774 - DNA, 496 bp, Homo sapiens
tatcgtcgacccacgccgttcggcatccatgcccaccggatgggcatggtagcagttcccgagcgcgccatcacctactcagacagtcagcgagcccctagacacgccttcaacgccctaatgggctgagcacatacactacggcgcgggcaacatgaatgcctacgagcgtgcatcaggcatagctgataggggcccggggactgtgaacggagcgtgcaccccccgagcgcgctggccccctgtggccaggttataacaactcccagtccatgggtccccctggtggccagccagggaggctccctagccggccagacatagcagctgcagaagctcaacaagcagtatttcaaccatcacccctaaccccacaaacactacatgccggatatgcagccctgctgcaggccacagatgaacgggacaaaaccagcacttaccgagattgcaaccccaagcacagcggacggcagcaagcacccccggagggatc

SEQ ID NO: 727775 - DNA, 107 bp, Homo sapiens
caaaagtccttccaagttacttgctaaacagcatgatgatgaaaacaatgaaaaacaatggcaataaaaagaggagagaatctagctcaacaagatatacatttttt

SEQ ID NO: 727776 - DNA, 462 bp, Homo sapiens
  misc_feature (311)..(311): n is a, c, g, or t
aaacttacgttaagagacacagcatctggtcttacagtcggtttacttttttggttggttggtttttatgttttcctcagacggggttttactctgttgcccaggctggagtgcaggggcatgatcttagctcactgcaaactccacctcccaggctcaagagatcctccagcctcagctggactacaggcactacgggtacgtaccaccagggcgtgccagttttttatttttggtacagatgaagtttacccagtgtagcccaggcgtgtctggaactccgtgactcaaagggatccaaccacccgggnctcccaaagtgctaggattacaaaggtgagccatgacaccggtcccaagtcggtttttaaatcaaatcatttctccaaaaaaatttaactaccggggattactgggacatcctctccctccttatctaccatttgcgtatcaatacttatt

SEQ ID NO: 727777 - DNA, 364 bp, Homo sapiens
tactgtgttgcctggaaatgtatgcactggaaacttccagccagtccactctgattttcagctgcctctaaagaaaggaggcagagctgggcgtagtggctcatgcctgtaatcccagcactttgggaggccgaggcgggtgggtcacaaactcaggagttcgagaccagcctggccaacatggtgaaaccccgtctctactaaaaatacaaaaattagccaggcgtggtggtgggcgcctgtaatcctagctacttagtagagtgaggcaggagaatcacttgaacccgggaggtggaggttgcagtgagccgagatcacaccactgcacttcagcatgggtgatagagtaagactctgtctg

SEQ ID NO: 727778 - DNA, 272 bp, Homo sapiens
gtcacaggatgtggtcttcggcctatatagtggcccacagaggaccgcatgggtctggggaccaaggggtagaggcaggagtggccgcccgagtcaccagctcccagtgacccactgacaaggctgtgcttcctttccctgcaactcttaagctgtgagggctcagaggtcctaaaacccagccacctgggacagagtaaggcactgccccgctcgatggctgtgggtcacccggccggggccactcctgttccagcggaccagcaggcaga

SEQ ID NO: 727779 - DNA, 477 bp, Homo sapiens
  misc_feature (96)..(96): n is a, c, g, or t
agtgcctggcagagaggcacagagtaggcatctcattgatatttgttacttggatgttgaaagaagagaggttggattccattcgctccattcctntcaggttggattccctcctcggtcaccagcagagctgagagcaggagctgggcttgactcagaccttcccctcagcactcacacatccacctgcagctcccaggtgggggccccaccttcccggtcctctcctgcctgctgtctctcctcccatctagagcacattggagaaggtggagtcctccacaagcattcgagccagcccccagagaaggacacatcggagcggaggccagagaggtgaggggccataacactagcacctgcgttgttcaagagcagcccccagggttcaggggtgtttccgtctcctccaccttcagagcagtacctgattccgttccgtaaaaactcttaataaataaagccgtcttccctgaa

SEQ ID NO: 727780 - DNA, 278 bp, Homo sapiens
gtcgacttccactctggttgattccattcctttagattccaatcgaatacattccctcctattccactcggatcgattccattccattccattccattccatgccattccattccattccattccattccatttcgttccattccattctattccgtaccattccattccattccattccattccattccattccactcttgttgattccattcctttccattccgttcggtttgaaggcattccattccattcgatgatgattgcattcggtcgacg

SEQ ID NO: 727781 - DNA, 703 bp, Homo sapiens
tgtgtcagagataacctatagagagagctctagaatactatgttgaactgctctgaagctatcatttaaactataaattactgtggtcaaaattttatataccctggtggcgaattagaatgttctaaaaatatctttaacacgtgaaaacaattggaacaaaatcttaccccatctaaaaatgatagtgtctagttgaatttaagttaagctctttagtatatgaccatatgaaggggtaaagtttaatctttgtgtatttacatgtgaaaatacagaaacgtaagtgattgaatcacatcctacacgaaagttgtggagtgctccaggcgaatatcatgtgaaatacagaggtatttatatcgttctttggcaccaatagttcttgcttcagtaattcaccagtaggttttcattcatcgataatatatcagtttaaggctaaaataaaacactacatttcttagggcttatcattctatatagaaagaggaaacatcctaatgagtattggcgtgcagtgtttgtccacagagattctgaagcaaaaaaatgtgaactaacatctatatttgttatggagctagttaccttgcttaccttagatgctttaaacgtttgagtagatcagccatgatgtgataagcaggttggatgcttactgtgcttaggaggtaggtgtattgtgtctcttgaagaaaga

SEQ ID NO: 727782 - DNA, 258 bp, Homo sapiens
cttggccggctaaattgatagaatcatcttgtgaaaagtttgatattacctatcaccataaggatccaatactctaagaacacctcatatttctacacctaggtaaatattaatattttacaaactttacatatgtacataaagaaacacatgtgaaaatacttatagcacaaaactggaaataactatgtccactgatgggaaaaataataataacggcatgacagacctgctagaaaataacaacagtgtgtttat

SEQ ID NO: 727783 - DNA, 1645 bp, Homo sapiens
  misc_feature (75)..(75): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcaga

SEQ ID NO: 727784 - DNA, 937 bp, Homo sapiens
  misc_feature (50)..(50): n is a, c, g, or t
  misc_feature (87)..(87): n is a, c, g, or t
  misc_feature (112)..(112): n is a, c, g, or t
  misc_feature (139)..(139): n is a, c, g, or t
  misc_feature (165)..(165): n is a, c, g, or t
  misc_feature (170)..(170): n is a, c, g, or t
  misc_feature (178)..(178): n is a, c, g, or t
  misc_feature (186)..(186): n is a, c, g, or t
  misc_feature (266)..(266): n is a, c, g, or t
  misc_feature (273)..(273): n is a, c, g, or t
  misc_feature (276)..(276): n is a, c, g, or t
  misc_feature (297)..(297): n is a, c, g, or t
  misc_feature (299)..(299): n is a, c, g, or t
  misc_feature (302)..(302): n is a, c, g, or t
  misc_feature (307)..(307): n is a, c, g, or t
  misc_feature (310)..(310): n is a, c, g, or t
  misc_feature (314)..(314): n is a, c, g, or t
  misc_feature (317)..(317): n is a, c, g, or t
  misc_feature (326)..(326): n is a, c, g, or t
  misc_feature (334)..(334): n is a, c, g, or t
  misc_feature (337)..(337): n is a, c, g, or t
  misc_feature (343)..(346): n is a, c, g, or t
  misc_feature (348)..(349): n is a, c, g, or t
  misc_feature (352)..(352): n is a, c, g, or t
  misc_feature (361)..(362): n is a, c, g, or t
  misc_feature (364)..(367): n is a, c, g, or t
  misc_feature (413)..(413): n is a, c, g, or t
  misc_feature (491)..(491): n is a, c, g, or t
  misc_feature (493)..(493): n is a, c, g, or t
  misc_feature (519)..(519): n is a, c, g, or t
  misc_feature (524)..(524): n is a, c, g, or t
  misc_feature (550)..(550): n is a, c, g, or t
  misc_feature (561)..(561): n is a, c, g, or t
  misc_feature (568)..(568): n is a, c, g, or t
  misc_feature (574)..(574): n is a, c, g, or t
  misc_feature (577)..(577): n is a, c, g, or t
  misc_feature (581)..(581): n is a, c, g, or t
  misc_feature (590)..(590): n is a, c, g, or t
  misc_feature (668)..(668): n is a, c, g, or t
  misc_feature (689)..(689): n is a, c, g, or t
  misc_feature (767)..(767): n is a, c, g, or t
  misc_feature (772)..(774): n is a, c, g, or t
  misc_feature (777)..(778): n is a, c, g, or t
  misc_feature (780)..(780): n is a, c, g, or t
  misc_feature (798)..(798): n is a, c, g, or t
  misc_feature (843)..(843): n is a, c, g, or t
  misc_feature (937)..(937): n is a, c, g, or t
ggagcaaaaattaagcatgaatggggggtgtgggggggggggggggacanaaattttttaaatttcacaaagccattatcgagtgtngcaatgaaacagagactgtaaattntaggtagctaagattctttctgaaacnaatgttaagtgaaagaaatataaagnagggnattacacnaagtttcnggatctagtacactaaaaagagtgaaacctaggaaaagttacctactgttttacagaagaaataaagacctgcaaaagcngattttnggntgtatatattttacacactgngnggngtggnggnatcngcnaattgaagnagagatgngcngtattnnnncnnggnctgtatcgnngnnnnctccctccccacccccaacaatctactaccttataccaagtattgnggatatgagcgcaagtcatcccagagaatccagtgaacaagtgagtgtaatgcactggtgtgaagtgtgagagataananagtgcctttcaatcttcatcaaagtnctgcngtagaagaaaattggcagcgaaattntcattcttctnacaagcnaaatangcntgtntcacaagtncttcaggaaatcctaatgcctttaacctttctatagcttctttttcctgaggtgttacttgaatgtagttcatatgancacttccagcttctgcaattnctccactgccacctccacctcctcctccttgaccaccagcttcttgaactggttcatttaacatctgaataaaatgcncctgnnnttnncnaatttgctgaagtaattnaggattctctcgacctatctgctgtagtaacgctggaagcaaggnaggattctgctgaataatttgtctcatctgttgaaactgaggctgattccgtaaaaattcaaggggatgtcctccagaacttgttgttgtagtn

SEQ ID NO: 727785 - DNA, 904 bp, Homo sapiens
  misc_feature (51)..(51): n is a, c, g, or t
aaaccaaccacctccccctgcacaaataggctaggtcgaggctcggtgttnaatcggccgaggggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcaga

SEQ ID NO: 727786 - DNA, 761 bp, Homo sapiens
cacgagagagagagagagagtagagagagagagagagttagagagagagagagagagagagagagagatacagagagtgagagagagagagtgtgatagcgcttgacatacatactctctctctacccttttgtaacgtttatcatcattctacccgcttcttgtccttctcccagagacttatctcttgctctccagatcccaccctttcttcccacctcctctttccccatattttcttctacacttaccctgtccttttgtctccctttcttacatattctcctcttgtgtcgccttatccttttccacttttttttcccttctgtttccaacccctatatctgtctatctcacctttattctccctatctccttgctgataatcccttcttttcctgctccgtgctttcttctcctctgttcctacctctatcctttcttctttcaccctcttgttcactttccctccctgccatcgtcctctgcctcccttcttcctacttctcccctccctttcttctactctctccctactctttttactctcttttctcttcccccctctttcgtttttgtctttcccttcctcctctttcccctttttcttttctctaccccctcctccttcttattctccccctcttttctcgctctcccctttccttcctcttgtcccctcccctctcccctcttttttcccctcaccccttctttgtcttctttcttcctcttctttcgccctttctcttctttcctcc

SEQ ID NO: 727787 - DNA, 109 bp, Homo sapiens
ggtgttccttgtctcagaagataagcttcagtagacatgcgcatgagtctcacagcactggaggcacattacatcccatctgacatcgcatttccatagaaatgggcca

SEQ ID NO: 727788 - DNA, 1014 bp, Homo sapiens
  misc_feature (51)..(51): n is a, c, g, or t
  misc_feature (878)..(878): n is a, c, g, or t
  misc_feature (880)..(882): n is a, c, g, or t
  misc_feature (886)..(887): n is a, c, g, or t
  misc_feature (908)..(908): n is a, c, g, or t
  misc_feature (914)..(914): n is a, c, g, or t
  misc_feature (919)..(920): n is a, c, g, or t
  misc_feature (930)..(930): n is a, c, g, or t
  misc_feature (941)..(941): n is a, c, g, or t
  misc_feature (948)..(948): n is a, c, g, or t
  misc_feature (953)..(953): n is a, c, g, or t
  misc_feature (956)..(957): n is a, c, g, or t
  misc_feature (965)..(966): n is a, c, g, or t
  misc_feature (979)..(979): n is a, c, g, or t
aaaccaaccacctccccctgcacaaataggctaggtcgaggctcggtgttnaatcggccgaggagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggtcctgntnnnaccnncctgtgcatccatactctggngaccanctcanngcagttcagngctttggtgcncatgccnagggnggnnggggctgnnggaaatggggggntggggcccgaatccttcggtgatagtgaggtgtag

SEQ ID NO: 727789 - DNA, 840 bp, Homo sapiens
  misc_feature (304)..(304): n is a, c, g, or t
agcggagcggcccccgcaccctgaccgttgcaactgtagcataatcacttgttccttaatctcggacctgtctcattggatcccccagatttctctggtgctctctgagcttcctgaccacgctgcaaactttgcatcctgccccgatgatactaggcaggcccgatatgcagcgagacgagaagagcgaagcaaggacctcatactgtaggcgtaatgacaactttagtgtacagtgccacatgcgagtcactcgtaaggcaaaccgcacatgcgtctctacatatctacacaacagccgtgncacttaaaacagtttgcgtgttgcgtagctgcatgctcgtggaagcgagaacgcgcaagcctgccgagtcattggtagcgatgctaacgtacttgcaccagctcgaacaggcgatactacctataggcgtccacattgatccgagtcagacttggacctaaggggaacaagcttacccgtaagggacttaacagctgcaagtccgtattcgtagcagtccattagtatacccgagataggcgtttacggacccgtcgacttgttggcatcatggacattgctcaactggatgcgatgccgcgtacttaaaaggttcgatgtatgtttcaacggattgaaagttcctaacgtgatctgcagttcaggacctggagtaatccaggtcggtttctagtctacgttcaaattaccgtcccatgtaccgaaaggacacacgagaaataaagcgcctacttgcacattaggcgcccttcccccgtaacatgagtatcattctcagggctttaggtactttaataccctacgaaaccacctca

SEQ ID NO: 727790 - DNA, 2140 bp, Homo sapiens
  misc_feature (75)..(75): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcagaaaaaaaaaaaaaaaaaaaaaaaaaaaaaaaaaaaaaaaaaaagggggggggggtaaaaattcccccgggggggcccattttgggttccccggtttttttggtacaagggtgggccccatattatagagggacgtcggtatataattaaggccaatagggagcgtggcgcggtgggttaacaacaaaggtcgttggtgatcgggggacaaaccttggcatacggctgggggaatctgttgggggaagagggagcccataatcttctggtggggggggggcgattcacttggtggccgcaaacctacctcttacaggaagtatttaacgcgctctaggggtgcaattattacaactttttctaacggtcgtattatgtgggttgtaaacactaccttggaaaatattggctaggcggcggtaggaagatagtttgtggtaacagggagttattcgttatttgagaaatttttattcaccggggagctgtgttatagc

SEQ ID NO: 727791 - DNA, 180 bp, Homo sapiens
atgcagtggttggagtacaggacacaaccgggacttgggcgtctgaagtgggagcagtcttacgggactgaacccttcacctgcaggacctgatgcttcctctgggtagatagtgtcagaactgagttgatacccaattggtgtctgctggaggatttatggggaacccccacccccaca

SEQ ID NO: 727792 - DNA, 2548 bp, Homo sapiens
  misc_feature (75)..(75): n is a, c, g, or t
  misc_feature (1704)..(1704): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcagaaaaaaaaaaaaaaaaaaaaaaaaaaaaaaaaaaaaaaaaaaaaaaaaaaaaaaaaaaanaaaaaaaaaaaaaaaaaaaaaaaaaaaacaaaaaagaaaaaaaaaaaaaaaaaaacaaagcggggcggcggcggccaccattaaattctttttctcccacggggcgacgcccgcccccccgccccccacactcatgtgcacgcacagaggcgcgcgcccccacgacgacagacggggcactcgtctaaaaacaaaccgacgagccgcggcgcgccgcccgggacaagacacaacagacagcgagcagcgcgagcaggacgaaaaacgacgccacgcgcggaagccgcgcgcatgacgaccacgagacgccagcaccaaccaaacccgccggatcaacggagcaccacacaaagcaacgaggcacacggcacaccaccccacaaaacatagacccaagagcggagcgcgaggagctaaaaaacagcaaaacaacgcacccgggcgagtcacaacataagaagaatacaagcaagccacaaacaaagaatagcagaactaggtgatcgtgagcagtgaaaaccacaagcacagcgcgacgaccaagcgcggacaagcacccgtcagcgacgcaaacatatactaccaccccgcggcgcagcaggaacaaagacagaaaacgacaagcaagccacaaaggaacagagagcatagcacgcacgagcaacaagaccacacaagaaccccgcacaacaagacaaggagagacgagatgcaggccgcaagcaccacccatcagtaccacccgacgcgagcagcgacgacgcgaacgagcgcccgagcaccagcgacgtaccgcagccacacacagcagcccagagccaccagacacccaccgacacacgcc

SEQ ID NO: 727793 - DNA, 2172 bp, Homo sapiens
  misc_feature (75)..(75): n is a, c, g, or t
  misc_feature (2172)..(2172): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcagaaaaaaaaaaaaaaaaaaaaaaaaaaaaaaaaaaaaaaaaaaaagaaggggcggcgcgcgcctcatagaaatatttcccctcagggaggggcccccattttagcgctgttcccccgatttttttgtggtacacagagggtggcccccctatatagggggagcgcgtttattaaaactcagaggcaggtgggccggcgttttaaaaccaccgctctggagcgcgggacacaaccccgagcacccgtgaagacactcttttgacgagagagcgcccctttaacttccgcgggggtgggaccccaatattttggggcccaacatatctacctatacgagagagattttataaaacggccctaagagcagcaaaaaattattacacattttacacagggtgacatcgtcggtgcgtagccacccacccccggagaaattcgctcgtcggcgtcgctagagaacaagtttcccgctcaacccggcgatatagattctcgaccaattttttttccacggggcgcctggcaatan

SEQ ID NO: 727794 - DNA, 115 bp, Homo sapiens
  misc_feature (98)..(98): n is a, c, g, or t
cactacagcagctatacaagctttatggtacttgaggtacagttttgtggctgctcttagtgtatttcagaaaaaaagcagataggacgaagaacgancttacagacgtgggttt

SEQ ID NO: 727795 - DNA, 145 bp, Homo sapiens
acacccgctctgcatccacgacccattatggacaccctgaacatggcacctcctactctcccgagacatcccaacatgggtggactggactgtaggctacccctaccccccccctaccctctaccatgatatcacagcgccttct

SEQ ID NO: 727796 - DNA, 1586 bp, Homo sapiens
  misc_feature (75)..(75): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgctgccgccgccgccagggcccggactcggacgcgtggtagccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcaga

SEQ ID NO: 727797 - DNA, 1929 bp, Homo sapiens
  misc_feature (75)..(75): n is a, c, g, or t
  misc_feature (1662)..(1662): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcagaaaaaaaaaaaaaaaaanaaaaaaaaaaacccgggggactttatatgggggggggggaaaaaagcgccaggaaaggggacccgggcgcccatagggtgctcccggaaccccagctttctggccacccaggggggacaactcggacgggctcccccataagagagacgccgcaaaacaattccaacaacgcccgggggttaccacggatatagacacgtggcacaaacgccggcacgcagtccccaccgagaccaccacaatctcaacagacacagacacacaacc

SEQ ID NO: 727798 - DNA, 1746 bp, Homo sapiens
  misc_feature (75)..(75): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgccgccgccgccagggcccggactcggacgcgtggggcccggactcggacgcgtggtaggctgtagctgctgctgttgtgggggaagggctagtgatgggtctggagcgaaggccaagagtggggcacctgggggatagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcaga

SEQ ID NO: 727799 - DNA, 829 bp, Homo sapiens
gggtaccactggaacgtggtgctgaactatctgagctaccagcccaagtaggggcacgaaacgtccccgggatgatgaagaggaggactcagaatgatgcggtcgtgaaagcgaaacgtgggtactcgagagacgcagtccgcctaatcgggaagaagaaactgactgtggttggatcgaacgcggctgtacctgactgaagcaagcggcatgctgtcggacttagtctgacatgagatggtggcctgcccggaagtagcatacatagtacgcgcagacaatggggcatgagatagctcagggtagagggtaaggaatgactgcctcatccatattcggaggataagactcaatggtagaagatgctacagcaaattgccaagggaataaacgatggcacaaggacacactacaagagcatacgattcagtgagcacacttgcagaggccttgagaccctagacaattgaacctaatcgaatacaaagggaacgcaatggctcctattcggcctgtgcggaacacgatttgccacagattcgacgtgggttaccctaggaccagctttcgtgcgcctggggtagagcttggaagatgcgttgctaacaagggcggggatgacgtcgggtcctgaggcgtgagggaacgatcggattaacttaccaggaatgctggtcccgataacgccgtgctgtggatcgcgacttcttggcctatctacagcgacagtttacaccagtatatatcagtacgaaccgcattccgagtggcaagacgttgcacggcagtggtacgacagcaaagtggcatcacttcagaattgtctcat

SEQ ID NO: 727800 - DNA, 819 bp, Homo sapiens
  misc_feature (496)..(496): n is a, c, g, or t
gcagctacgaggtgctgtcctggactatgaaaaggtccctggggagaagggctgtccaggcagacctacactacgtctcaacacgctttatctgagacccgtggtgcagtcgttgtgatccacctagccactcagtcgtgtacacggaccgcacggagaatgctgaggttctgatgatggaggggcccggcagacttacagcatccttcgccgcctagtcgaaccgaggacctgggtcctccttggccacgctgaagtgctggactccctgtggtcagtcacatgtcaatccgattgagctgcatcaatgcactcgtccgtctaccatatggtggggacagagcggtagtccatgactgatgagctgaaacacggcatgaacctcgagctcttatgtaccagaattccaacatccagatccaccacgtatcctaattgggattgtagctgtgaactgtgcccggactgcatgatatagcgctgagcagcacactgntcaacaaacggggtggtgcacctcgatcgtataaaggtcgatctcgcaccattctaccgaactaatgatccgacgacagagtccatctgtagatcgtaggactaccgttatgaggaggccttcgggactgcgtgtggctgcattcagggggcgtctaacgacgattgcttgaagggtatacggccatgtagcgacgcttttttggcccgaccatagtgaggccttcgtcgataggatcacctatgtgatgactttgaaccagtagttctgggcgaacgaggaaggcccgtgagagtacctggtgaaacaatacagatcattga

SEQ ID NO: 727801 - DNA, 1580 bp, Homo sapiens
  misc_feature (75)..(75): n is a, c, g, or t
cgcgggttcagacctgccgagcgcccgccgccgcgggaggggcttgaggccggggcggggcggggccggggcggngcgtcccctcgtaggctccgggccgcgcattctcagcgctgggagccgccgcccccgcagctgccgcgcgccaggcccggactcggacgcgtggtagccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcaga

SEQ ID NO: 727802 - DNA, 348 bp, Homo sapiens
gtaattaagcttacagttattaaatgagaacgttttggacaataatgcagttgacagtattaaagtagggccaggcacagcggtcacgcctgaatcccggcctttgagagaccaaggaggacggatcacttgaggcaggagtttgagatcagcctggctaacatggtgaaaccctgtctctactaaaaaatacaaaaattagctgggcatggtggtgcacacctataatcccagctactcaggaggctgaggcataagaattgcttgaacccaggaggcaggggttgcagtcagccgagatcgcgccactgcactccagcctgggtgacagagtgatgactccatctc

SEQ ID NO: 727803 - DNA, 1555 bp, Homo sapiens
gtgtattctgtttcttacttggttttggggtggtgcggtggtcgcgtttgttgtgttggtgttgcttgtagtttgtggcggtttggcttttatcttctagtttgtgcttgtggtttttgtttttcgtgtctgtcgtcggtgttctgagtgttttatctcttgtttcgcttgccgactcggatcgtggtcatcccacgtcgcccgtctgtctagtcgtactgggttagattgtcactttgtctcactcgtctcctcttcctttcgcgattcctgcagcctgcttcgttgcacctgtgttctgctgtattctctcgtagtttggggtggtggtgcgtcattcgtggttttgctggttgtgttgttttggtgttggtgggtctagagtgctgtggatctcttcggggctgtggtgtggtctgtgcgttggttgttggtttgtgttggggtgtgcgtgttgtggggttgtgtgggtgtgtttgtttgtcgtgtttgtgtctgtctggttgtggctgtgttggtgtgtggttggttgtgttttgctgtttgttgctttgttcttgtgtcgttgggctgttgctggtgtggtcttcgttttgtgttctttgttgttgtcgtccgtccttgttgcggaaagaaagaagaaaaagaaaaaaaaaagagaagcggtgagagatgtgatcgtggcgctggggctccgggctcggagatggggcccaaaggttcggttctctcgagacggcggttgtccccgtgtttcccccccggccggtggactttgacacaggacccgtggacccaccgtgttggcagtttccgccggcgcccctggcaacggcccgctccagaagctttgggttggagctgggccgtcagagtgccctccggtttctggctaaaactctatcccgttccgggttcttaagagtccagttcaatggccgagcccccacgggaaaatgaggcttttcggggtggtttgacccgcttacctgagagcacacgtgttcccttccccgatgacctgggatggtggcaccggccgtgcccttgctgttgctgggccgtgtccttttggaaagggagctgcccccggctttagtgcagctgcccaccctcgttaggcctggccttcttcgaggcctcttctgacctcaagggtcacaccccctccaagagtccttctcacccctggtagttgctgctcgtggttctgtcttgtccgtgcacccgagtggcacaccaccgcacccccacccctgtacatctgaaattggcgagatgagattgagagcccagactctgcggggtccatcacgccagccctggttgtgcctgcccttccatggtggtctttccagggtatcttggccaacacattagtaaccattgcttttatatttttttcttttttgctttccttgtacagtccgtactataaaatttctcttttgagattttataaccctttgtagccttttagatagaccttgtgtttgtactttgttgtgtagagtggaagaattgtgttgaataaaccccagatccggaatgccca

SEQ ID NO: 727804 - DNA, 659 bp, Homo sapiens
ctcttctacttatctccaaaaaaaaaaccacactaccacacaccaacacccccaaaaaccccacaccaacccacctacaacaacacttcccaattaaaccaccccaaaccgcgcccaaacccacgcactaccacatccaccaccatcaccagcaaaacaccaaaccccccccaacccctcccaccccaatctcgaccccgccacacccgacacgccagcacactgccacgaactaccgacccctcaccaaccctccaataccccccccccccctacccccccaaacccccaacacaaaccacatcgaacaccctcgcacacaccccctcacacccttacccctaccctaccactccaccccactccccccgccaaatcaccaactcccacccgcaacccacccaacaaaacaaaaaagcaccacccatactctccccccacaccatcccgcccacaaccctccccacacaacggacacaccctcactacacacccacacacacacccaccacctccacccaacaccaaccccaacaacccctccgcgccaacccccactctaacccatcctaccacgccaaaccgcccactcaataaactccacataatcactccctatcaccacacgtcccacacacccactaacacacacaccgccg

SEQ ID NO: 727805 - DNA, 498 bp, Homo sapiens
attagtcggtgtcatctgggcagatccatagctggtactgcgatggaggtctcattatgcgccagtcacagtgcggaataatctgacgagtataatcgtccaacggaaggactctgaaatattagacttgtcctgaaataagcttacctaggatgataccacttcgcttaatcagaatttcccctttccaactattgaacagtggcaaatataaaaaatctggtagttaaaatacacagcagtcacttcatattactgccgtccctcaacccactcaccttctgaagaacagggcttattcaagtttggttcccctttaagttttaatagaaacaaaaacgttttaagtcatgtggtaccattatatccccagaaagaatggcaatttaccaaggtttccacgtgtttggcgagaactcttactgaaagactagtgatgtccattttccagtaaatactgagcgaacacaattttataccccaatctgaggtctaact

SEQ ID NO: 727806 - DNA, 496 bp, Homo sapiens
  misc_feature (338)..(338): n is a, c, g, or t
acattgtgtgggcttagaaaccgtgagccttgggaaggaccatcttcctctgagctctgggcgtgttgaactgcggaggcttaccacttcctcgcctgtggtcatctccagcctgacccatggtggcgtgatcctctctcatcatccgtcacagtttttaataaagaaaatatgttccagaaaggccgagtccccatgccgcatcaggtcagtgatccaagtgcattatagtgaaagtcagaggaaatagctgcttttaggacacgctgaacttgcctaagaaagttattagtgggaataaatgagggggaagaaagcatgctccgactaacgagaanagtatcagcctgacattttgtgtcgtcctaactttgaaaagctatttatacccacttgctagcagtttctatgagaaattagatatgaggagatgtacagaagagaagagtgggagctgggtgactgtgagctcctcctcagaaactcttccaggcgg

SEQ ID NO: 727807 - DNA, 370 bp, Homo sapiens
gtttccgttagtatgagctcttagaaggaagcagcaccacatcattacaattccccaaataacaactattatccatttacgtctttagcagcatgagtagggcagccagcctcatatcggctctggaatcccagtcggacagtgatggcaaaactcgggctttggtgctggtgccacacactttggtgacccagggctgtcccacacaactccagggggcactgttcttctccacagcccacgaggctggcttctgtcctccactcgcaccttgcgtggccctccgtggccttgggccgtcagaaaagcgctttactatcaggagctcatggggcaagggagggggctcggctcgagacaaagggaaaca

SEQ ID NO: 727808 - DNA, 857 bp, Homo sapiens
  misc_feature (1)..(1): n is a, c, g, or t
nttccctctgagtggtctcacccccttgtagggtcgtgatttcacttcccaagggtgctgcataatggtgccattctaatgggaagatatattgaattaccgctcctccccgtgggggtctacacatctcaccggcgcttagaagctaaatgtttatgaactctcttgttcacggctggacgctctctaagggggctcggtctcgctcgcacagatgtcgcacaaatgcttagcgctcgctgataagaccctcacgtctgctgtataccagggggaggcctccttacccattaaggggtttgctcacgcacacaaaggtgaaaaagctcactgttgcgagctggacgggttttccatgggccggcataactcggtccttggataacgccccgtgcgacgtccggacctcgcactcgcactatgtttacaaacgcctcgcgcggggagtgaaagactactctcgtctttcttcggttaaggaaaagaactcactcgcgctattttctcggcgtgtacccttacatagtagcacttgttgcactggtttcactacaggtgagaccggacacacactcacgttagggtgaggcacctcacgctaactaagacgcgcctacgacatattttttctccccgaactacctcggtgtgcggcttgcgattcacgctcgcctccaccgtgtcttgcccaacgactaagagacgcggctaccgcacgctgcagggtaccaccacgctacactatggtatgtagagcgcccttttaccccccttacgtgacgcccatatgtctcttgcgcccccccgacctacaatagcatcggggttgtccttcgtttaaaaaaaaacatagacga

SEQ ID NO: 727809 - DNA, 304 bp, Homo sapiens
  misc_feature (5)..(5): n is a, c, g, or t
  misc_feature (20)..(20): n is a, c, g, or t
  misc_feature (45)..(45): n is a, c, g, or t
  misc_feature (94)..(94): n is a, c, g, or t
  misc_feature (100)..(100): n is a, c, g, or t
  misc_feature (119)..(119): n is a, c, g, or t
  misc_feature (139)..(139): n is a, c, g, or t
  misc_feature (191)..(191): n is a, c, g, or t
  misc_feature (195)..(195): n is a, c, g, or t
  misc_feature (206)..(206): n is a, c, g, or t
  misc_feature (214)..(214): n is a, c, g, or t
  misc_feature (234)..(234): n is a, c, g, or t
  misc_feature (250)..(250): n is a, c, g, or t
  misc_feature (255)..(255): n is a, c, g, or t
  misc_feature (261)..(261): n is a, c, g, or t
  misc_feature (263)..(263): n is a, c, g, or t
  misc_feature (286)..(287): n is a, c, g, or t
gggcncaaccaccaatcccntttttaaaaaatgtgaaagtcaaanaattaagttttagttttgactcatcccaaaaggtcaaaagtatttgttnctgtancattcaattcccatttganaatcagggtaaaaaaaactngtatttcccttcccatcatgatcctactgttgagttaggaaaaaatggttanacanactcccattantttttttnaaaggtaaactttaaattantgggtcaacccaatantattnggccananaggtaaaaactcccaaataaaannggattttgtggtttcca

SEQ ID NO: 727810 - DNA, 378 bp, Homo sapiens
gaatttattttattatttttattttggttaagggcgggggccttcgggcccctcttttaatcttttaagggatttgtttgccattttgggggaagactttttttatggggcctttttctttgaagttttagcgggccatttgcctttttaatgaacatgggaagttatactgggggtatgcaccagctctcccccacgcgggtttttctttgggttagtgccctacccgccccctggatgttttcttttccccctttggggtgcccctcttgtttccccctagtcccctttttgttttaagggcctttagtttttcccgttccctttttcccgggcttttttctgaagttttttttttaatatgcctaaaatacttta

SEQ ID NO: 727811 - DNA, 487 bp, Homo sapiens
tgaggtataatatcttatgttactctaacttttccacctctagatagacaaactacttgccattgtgttacagtgcctacagaattcagtacagtaacctgctatacaggttgtagcttaggagcaataggctatcccatatagtctaggggtgtaggaggctattccatctaggtttgtgtaagtacactcgatgatgttcacacaatgacaacatcacctgacaactcgtttatcagaacatacccccctcattaagtgatgcatgattgtagatgacattctggaaaaggccaaactatggagggagcaaaaagaccagtggttcccaggaattaggggaaagcatgagacaaacaaacagagcacagaggatttttagggtagtgaaagtattctgtatattactacaatggtggatacatgtcatatgtttgtcaaaaaccaaagaatggacaccaaaagtgaaccctaaggtaaatgctgc

SEQ ID NO: 727812 - DNA, 377 bp, Homo sapiens
cacgaggatggccactctcaccctcgccgcggccactgttgctatggctgcgggcgttggcgttgcgcacgccgcagatgtcatcgacaaccagaattccgtgaacgcgaagggcaagccgaactccggccccggcgtgcagggtgcgcctgatacgcgcacaggtcccgcgacgcgcgcccccggcggcgaggagagcggtaccgcaaacgaaggagcgtcttcgggcgcaagcgggtccggcgcaacgacgcagccgagccaggattcgagcggcgtggaaggtatgccgggcaacaagagcggcccggccgcgaagtcgccgtccaccaccaactaacggcaaagcgcggaatttccgcgcgatccccggctga

SEQ ID NO: 727813 - DNA, 572 bp, Homo sapiens
cacacctaacagccctcactacgagacagcagagggtggccagcttctgcattttcttttaccttttttaaaaaattctttattttattatttatttatttatgagacagggtctcattctgtagcccaggctggagtacagtggtgtgatcatagctcactgaaaccttgaactcctgggctcaagcactcttcccaccttagcctcctgagtagctaggaccacagacacgcatcatcatgcctgggtaactttttttttttttttttggacaaagagttacacattttggtggcccaggttgaaatgcagggccactatctcggctcatggaaacctctgcctcccgggtccaagcgattccccgctaatttgggatatctcaagaagatggggtcccccatgtggcccaggttgatctcgaactctgtgaccataaggtgatctacccactgtggcctctcccaaagttgctagaattacagaggtgaccccattgtgctccagcctaggtggggaggtattaaaaggtagtccttacaagtcctatgatttttaaattccacacaat

SEQ ID NO: 727814 - DNA, 295 bp, Homo sapiens
tcgagtttatttttatttttttttagtaaagatgggttttggccatgttgaccaggctggtcttgaactcctgagctcaggtgacccgcctgcctcagcctcccaaagtgctgggatatacgggtgtaagccaccgcactcagccatgcctgctgtttctcaaaaccaagaaccgtgggggaatgggagaaagagtggagttgtttgggaaactgaagtggtgctcaagaaccaatcaagaagctgatgctgcaggtctcagaataggtgcgctcgtccacaccctagatccgcg

SEQ ID NO: 727815 - DNA, 151 bp, Homo sapiens
  misc_feature (61)..(61): n is a, c, g, or t
cttcaggatctaagagcaaaacaccaaagaaaacaagacgccagagacagcacataagaanggcgctgctgatgacagacgtgcaggaaaggaaagggcgtgctgcacccgaggaagttgcaacccccattgcatcactggcccacaggca

SEQ ID NO: 727816 - DNA, 140 bp, Homo sapiens
  misc_feature (39)..(39): n is a, c, g, or t
  misc_feature (63)..(63): n is a, c, g, or t
aagagaattgactcacacaatcacaaagcaaagtcccantactaggccatctgcaagctgagnaagaaagaagccaatagtagatcagtccaagtccaaaagcctcaaaagcagggaagctgacagtgcggacttcagtc

SEQ ID NO: 727817 - DNA, 950 bp, Homo sapiens
  misc_feature (15)..(18): n is a, c, g, or t
  misc_feature (24)..(24): n is a, c, g, or t
  misc_feature (30)..(33): n is a, c, g, or t
  misc_feature (61)..(61): n is a, c, g, or t
  misc_feature (102)..(102): n is a, c, g, or t
  misc_feature (114)..(115): n is a, c, g, or t
  misc_feature (127)..(127): n is a, c, g, or t
  misc_feature (130)..(130): n is a, c, g, or t
  misc_feature (180)..(180): n is a, c, g, or t
  misc_feature (202)..(202): n is a, c, g, or t
  misc_feature (215)..(215): n is a, c, g, or t
  misc_feature (669)..(669): n is a, c, g, or t
  misc_feature (692)..(692): n is a, c, g, or t
  misc_feature (760)..(760): n is a, c, g, or t
  misc_feature (872)..(872): n is a, c, g, or t
  misc_feature (908)..(908): n is a, c, g, or t
aggctctggcatgannnnccctcncagggnnnngcccaccctttcctccgatggggctacnccccatgagtcagagaccaccagctatcccccccatgccanctggcatcctgnncccaatgcttcnacnaatgggggcgccaccaccattcacacagataccaggaatggtacctccgntgatgccaggaatgctgatgcnagcggtgcctgtnaccgcagcgacggctccgggtgcggacaccgcgcgagctctgctgtggctgggacaggccctccgagggccgctatggagtgagcatgtggccccagatgggcgcatctactactacaatgctgacgacaagcagtccgtgtgggagaagcccagcgtgctcaagtccaaggcagagctgctcctgtcccaatgtccgctggaaagagtacaagtcggacacaggcaaaccttattactataacaaccagagtaaagagtcccgctggacccggcccaaggatctggatgacctagaggttctagtcaaacaagaggctgcagggaaacagcagcagcagctgccacagacacttcagccacagccacctcagccacagcctgatccccacctgtgcctcctggccccaccccagtgcccacaggcctcctggaacctgagccaggtgggagtnaagattgtgatgtgttggaggcncccagcccctggaacagggttcctgcagcagctggaggagggcccagcagttctggacagcatcagcnacagcaggaggaggaggaatcaaagccagaaccagagaggtctggcctcagttggagcaaccgggagaaggcaaagcaggcattcaaggaactgctgagggacaaggctgtnccctccaatgcctcatgggaacaggccatgaagatngtggtcaccgacccccgttacagtgccttgcctaaactgagt

SEQ ID NO: 727818 - DNA, 341 bp, Homo sapiens
  misc_feature (263)..(263): n is a, c, g, or t
ctaggcctttaaagagaagatgagtctcaccaccttccacatcccccctctcctatctctgtttctagcatgcaactatgatgagttagttttactaacaacttacatgagattttatattccaagtaaagtttttcagaatctctcccagcaccaaagaccacccaaattaaggaagctcataatagtctaggaagctctttgtccacccagatggtcagctttttcagaactgaaaactttcatgttttcattttagagtncatcctgtgcagtttgtggcaatagctcagagcccataccttttatcaaatccccaggaacgcttatttcccatcctt

SEQ ID NO: 727819 - DNA, 366 bp, Homo sapiens
cgagcagtgtgcataccaggtgggaaggcagtggttgcgatactgggtatcatttagcaagagtagcagccaaaaggataggctaggaagggaaaggcaagcacaagcagcatccgtccacaggagggccaccaaggtatatagcctgaggcactgacgaacagactgagatggagcaggcaacaaacatcattctcagctgccatgcgttggatgcatattaactctgtctctctctacgtctctgtctctcgctctccactttatgcattaatcctgccctcacctattttcagatgagaaaactgaggctgagacccaatcgagatcacacacatagtgaggggcagcgcctggaattgcatg

SEQ ID NO: 727820 - DNA, 549 bp, Homo sapiens
cgagttgaaatgtgtttgactatgaccaacactctaggcagcgcaaccaaatgatggaaaacaactggatcacactgcaaatgtcccacaaaagaaagcacaatgtacaaaatgtgcatgtttcagttatacactatacgaaacatagtataaaatactttccaggtaaacattgtaacacttaagaaatagtactcagtacgaaattggcactacaaaggcaaaaatgcaacaagtattttcaactatgaaaacacaagacagtggaattggaaactttcgggataaaacactgtaacccagttagctctgtgggggtgtgcggggagagatgggccctcaacatatctgcagataacttttttttcccctaaattcatctcaattacctatcattatcccaaccaggcacttcaaactattaaactaaaacacagactcttaatctagttatgactatccttcaagaactcatgtgagtatctttctttacaaagaaagtttcctttcatgacagctatacagtttcacataacacacatcattcac

SEQ ID NO: 727821 - DNA, 96 bp, Homo sapiens
ccaccggccgcccacgcgtccgagagcagattaacaaagatttgcataacacactggaggatttgcgcttgcggcgggaatcaccagaatccgagg

SEQ ID NO: 727822 - DNA, 469 bp, Homo sapiens
actagagacccacgagtaataagactcatctagatttcataattacagtaagaagacaatctgcccaagttaaaaataacaatgcaggggacgggctgtggtggctcacgcctgtactcccagcactttggaaggctgaggcgggcggatcacaaggtcaggatatcgagaccatcctatgtatgtttttctgcctacttttgaatgaatgtattatttactatcattcaatttaatctattcgtaagttttttagctacgatactttttactgcttggggattggtatatgtatgtgcatgagtttaataaaagggtttgggtggttgctctagggcatataacatacagtatatgcctttacttatcatagtctgtcttcaagtattatatcactttgcataatgtgtaaaaatcttttaatggtatactttcatatccccactcctgagtctgtattaactgcttg

SEQ ID NO: 727823 - DNA, 104 bp, Homo sapiens
ctttgcctttttccagccgcttcgactcagcttcggtggcctgtccctattcgcccaggccacgccattttcaagggcaggaaggggcagtgtcctgaagccca

SEQ ID NO: 727824 - DNA, 398 bp, Homo sapiens
  misc_feature (305)..(305): n is a, c, g, or t
  misc_feature (397)..(397): n is a, c, g, or t
ttctgtaacacagttgatgtagtttggatatttgtcctctccaaacctcatgttgaaattggccgggcacagtcgttcacgcctgcctcgacctcccagagtgctgggattacaggcatgagcatcgcacccagcctttatcattgagttctaagagttctttatatattctggttacaagtccctttatatgatatatgatttgcaaatattttctcccattgttttagggtcatcttttgttggacagtgtcctttggatggcacagttttaaatttttatggaggtccccatttattttttncttttgtcacttgtacccttgtgttatttcctaataattcatggccaatccagggtcaggaggattacccccaggtttcctacagggtggtna

SEQ ID NO: 727825 - DNA, 1539 bp, Homo sapiens
  misc_feature (1)..(1): n is a, c, g, or t
  misc_feature (842)..(842): n is a, c, g, or t
  misc_feature (1096)..(1096): n is a, c, g, or t
nccttttgtgagagatgatgggggaaaaatattactcttatgatttactttttttggggcgccgcactacacaaaatcaccaaacatcataataatgtttttggggcagtgcgcccacgtactgctgcgcaacaaagagtgtaccgttgaaaataagtttctttttttgcttccattagacgcacaaattgtgcgccccaccaactagggccgtcttccccctttaattttgtgaaaacacctcttgctccttattaacagggttttttcttcgagaaagttttctttctaataaatccccccccaaggcccctaccaagggggttttttaataagtcccgcccggacaccaacacagtgttgtggtaaggagggggtattttctcacaggcgtgtttcccccccgcaacaagtaggttttatataatagaggcgtatagatataagagcccccctctttatataacagctccttttttctaacacacaaagaggggggggtttttgcgctcgccgctcgtcctccatctcggggtattatgtaggatatccccagctatgttgtcctctccttaacgccaccctccctggtagttgtgaaaattgttcttcgccctcgctgtgttttgtggagacacgtgaccactgtgtgtttgagaacaccccaccccggggtgaacacaaaaagttgtgtttgtgggggtgtcctctttaaaacagcgccctcccgcccacgtggtgagaaagtgtgttctccacaaacagccccaacgagaccacaccttggcggtgttgtggagaaacacactgttgtgatacccacaggtgtatacacaaatagnctctgggagattcctcttttttgtgggccacacagtgggtgtgtgtctgctcacagcacctgcgggctgcggagtagttcttctgtgggtgatattactctgtgtgtttgagagataaaaagagataaaatagggtgaagccacagctggctgtttctctctcggggtgtccctctccacagagagagacttctgggagatttattaaaggagtgtgtatatggggagaaggggagactctgtgtttgcccccngtatattcactgtcactgcgagattgggggtgagacccactctgagactcgcacactcacacacactgcgggtgttatattctcatggagactctccgctgcgagaaggtgtcttaactctgcacgagactcttctctctcgcgcctctcctctccacaccccgagagaatgccacagagagatctcttggaagaaagaaagaccttggggttaacactccagatgagagtttagagatccaaagaccaaataggtgggacatgaatcttgccttggttggataccagagtggttgtgaagaaaagagtgcccaaagaggaacattttaaataatttgaccgggtagggaattgtctattcctgaaataaaataccgtgaggactcttgcttaaggcacagagatttcagaatttactgttggaattaaccccactcttcatg

SEQ ID NO: 727826 - DNA, 1294 bp, Homo sapiens
gggacgcgctggcggacgcggtggggtgtggtggcacatgcctgtggtcccggctactcgggaggcttgggcaggagaatcgctggaatccgggaggcggaggcatgcgtgtgagccgagatcacgccactgcactccagcctgggctgacgtgatgcgagactcctgtcgtcaaaaaacacacacgacgaacgcgaaatgggggcatagccgaactcgaaaacaggggactcccatagcacgcagagcaaaggcgcccaacataccaccttccagaagtcaccagaggacgtggtccacagaacacacaaaagcgcggtcatacgtgtaagtagcgagcgaccagcaccgcgcagcaccaacgcgcgacgcaccagccgccccgcgggcacgaacacgagacagcgctcaggccaataagcgccccgagaaaaccccaaacgagcattagcgggcccctatacagccacgcctcttgccagggacgaacccgtgacgccacaaccagcaaacagacacggcgcgcggcatcatcgggccagctgcaccgatagcgaacagggcacagcgcgggccatacgcgccgacaaatgacatgcgtgatccgccgccccagttacacgcggcggccaacaccgcgggcgccgcccacgaaggcaaccagcgtggcaccccgccatctatagcgaccacacagctcgcgaccgacccctcacgaaacggtaacgaccacgcacgcccagctctactcagacgaaggccacaccccggggcctcaccgacgcatcacacgggccccgacgtgcccgggaccgtgacggccaacgtatggccatggtgcggcgcggcccaaccaccacaggggctcggctcacaacgctgcgccccggcccacactgtgaaccgctatcgaccccctcagcgcgcccaggcacaccgcgagagaagaccactacacgcgaccaacgccctggacggccgccaccccgcgcgacaaccaccgcgacagggggggccacccacacccgacgccgttacgcgcccacaacttcgaccacgggcaccagctagcgaccagccaccactgccgcaccggctaccgcggactatacacagcgcgatcaaaccaccacaccctacgggtgccatcatacccacaaccaccacagtcgcgatcgcggccaccagacgcgcgacagcggcgacacccacaaccaccaggccccccgacgcgccgcacaccacagcagcacgaaccacgcccgcccgcgacactgttggcgcagcacacaca

SEQ ID NO: 727827 - DNA, 158 bp, Homo sapiens
  misc_feature (1)..(1): n is a, c, g, or t
ncgactctagagatccccttatttagtaatatatttgtgatcaaaagggagtttgaatttatgacccacaatatgaatcttacagattcagatattaagctatgtgagaagaaaacaagatttgaggtggtaggagctgaagaggtgggaggagagga

SEQ ID NO: 727828 - DNA, 312 bp, Homo sapiens
tataactgaagaggattgagaggtaccaacttccagttataaagtaaataataaatagataaatgtcgtgtacagcatgggaaacatagttaataatattgtagtaacttggtatggtgacagatggtagctggactggtcgtggtgatccttttgtcgtgtatgggaatatgaaatcactatgttgtgtatctgaaattaatatcatattaaaagtcaattatatttcaaaaaagggattgctgtgggtcagtggcgtcggctcaattttcccgggataccgaagctacgaacatctcgtaagtcaatggt

SEQ ID NO: 727829 - DNA, 868 bp, Homo sapiens
  misc_feature (149)..(149): n is a, c, g, or t
ggcattttcctgcataaccctttcaaataggagacaatttcctggcccgggcacgggggctcactcctgaagtcccagcgctttgggaggccaaggcccacgttggtaatcaccctgtggctctacggatgtttgggaccagtcctganccgagcattgatgaaatccccattctctaggctataatacacatagaaattagccaggtgtgagtggcgcatgccgtgttaattcgcagtcgttcgtgtgcagagacctgatgggcacggacgaagtcgcttgagcccaggagggcagaaggattgcaggtgagctgaggattgcaaccatttgtcactccaatactggggcgagcaacggcaatagactccgtctcagaaaaaagaaaaataaaagaagacaatttcctcagtaaagaaatggacgcttataaataataaaattatggatcagcttaccctagttatgcatgtggaggaatacattgtaaggtatattagttatggctacagtaaagctgataacaaaacccatcaagcacaatagtttacaacaacatgcatttattttatggttcaggtacatatatgctgatgagttatgctgtgtgctggctgagttgtggatcccagatagccaggatccagttaagcaaaaaccagtcacatggtctaaaccccaaaatcagtgggcagagatgtacacaacccctacttgacccactgtggggtccagaggggggacgggattgggaccatttcccttcactaacaagaaaatcattctcttctattgggggattcaagcggtcctcctgtttctcaggtgcattgcgaaaaaacggatcaatgataaaagccgtagaata

SEQ ID NO: 727830 - DNA, 793 bp, Homo sapiens
gcctttgaagaagagttgggaagagtcaagggtcacttgtggacctatcaacagtgttgccttccatcctgatgcaagagctacagcagcgggggaaatggtacgtccgtatccattacttcgacccacagtacttcgaattggagtggaggctaaagaagctgatctcctgccgggcgtgttgctcatgcctgtaatcccaccactttttttttaaaggcaggcggatcacctgaggtcaggagtttaagaccagcctgaccaacatggagaaaccctcgtctctactaaaattacaaaatttagccaggcatgtgtgcacacgcctatagtcccagctactcaggaggctgaggcagggagaaatcactttgaacccaggaggcaagagtgttgcagtgaagctgagatcacggtcatgtgcattccatcctgagccaaaagagcaaaatccgtctcacaacacacacaaggagcgagggggggtctccaaccggggcagagaagtttcccacagaggtttcgggacttcccaaagacacaccgtggcgggacacaaagtggcttcgtggtccaggggaacacaccagacacacaaaaaaaacacccttggtgggcggggccggcccaaagaatttcaaaccatctgtgggcgccgcccagagagtatgaacattggcacagtggtgccaaggaatcggccgcatggtgggtcccccaaaaaaaaggcggaccgggttcggaaccccaaggggcgggtatgggcacacgcggcagcctacccccccggcgt

SEQ ID NO: 727831 - DNA, 1086 bp, Homo sapiens
ggccagaacacaggtgtcgtgaacactacccctaaaagccacacatgggaacggccaagactcatatcaacattgtcgtcattggacacgtagattcgggcaagtccaccactactggccatctgatctcatcaacatgcggtggcatcgcaccaaagcacacccattgcaacaacatttgcagcacaggcaggctgctgcagcatgggcacacagggctccttcaagctatgcctgggtcttgcgcatcacactgacaacgctgcagcgctgcacccgtgcctatcccccatggatcatctccttgttggccacttggaaacacagcacagtatcatactgtgatcaatactacactgagagtgccccacgagaccacacgagacctttactcacaaaaccatgacttaccagggaccctctcacggactgacctgtgctgtccctgacatgtcagctgctggtcgttgcgtgcacattcgcacagctggtcatctccaagaacatgggccgcacccgacgcagcatgcccgttctgcgcttacacactgggatgtgaacccaagtactctgtcggtgtcacacacacaactggattccactgagccaccccataacacgcgcagcacagacgattattgacggacaactcgcttaccaggacacgtccatgcacacttccacctacaccgacacacttgggcttccaacatccacggcaccacacgctacgcactaatctgcacaccataccatggctctgagacactgagctgacacccaccattgactcggacgcgaaaagttggtgttacacggccttggccacggagttccaacggggaactgccaccaacgacgcacgccgcacccggcgaacgcggccaacggcacccgacgggaaacaccaacctcttgcatgtgagaagcatcataagaaatggcaatctgtccccaaccaacatcagcgtaacctgcccaagacccgattgcgtcgccgcaatctgccacgaactcatctaccgtcccttagcgggcaactcgttaatcgtaccgctgctgcgaccggcaggccacacacctcca

SEQ ID NO: 727832 - DNA, 276 bp, Homo sapiens
atggtcgccgggtggtacgcggtgcgtgacaagatcaagcctgacctgctcgacaacgtggttccgagcgacgaagggatgtaaaccatgcaaacccacattctctacaccggcggaaccttgggtatggtatccactcctgacggtttggctccgggtgctgatctgacagggtggcttacccagttactatctggcaccgaactcgccggagctttcgagactcaaagtttcgagcatctcattgattcggccaacgccactcccgatgattgg

SEQ ID NO: 727833 - DNA, 90 bp, Homo sapiens
  misc_feature (61)..(61): n is a, c, g, or t
  misc_feature (81)..(81): n is a, c, g, or t
ttcctttacctacccaaatctcataaaatggccccacccgtatctcccttctgactctctntttggactcagcctgcctgnccccatgtg

SEQ ID NO: 727834 - DNA, 157 bp, Homo sapiens
  misc_feature (52)..(52): n is a, c, g, or t
ggctccaagtgatctcttgtaagacagaaaagttcacatgtccccgctcganccaggaagtcagctaggttcacctctcatttcttcagagaagggtgccttgcttctttctaaatcaggccttcctactgtctctcagaggggtgtgtgtgtctgt

SEQ ID NO: 727835 - DNA, 234 bp, Homo sapiens
acggtgtccttggtcatgagtgagcagctccatctccttcttagcaggtgtgtgtctttctctagcgatcaggaacttgcagtccttgtgcaaacaggtcatcgctctgcacacttgtcgtgcaggcggcggaggtggaaacgccagtgtacacagccgcaggactctggggcatgttgttcttcaccccatatgctgtggcagtggtggtggtgccattgggccagcgggggt

SEQ ID NO: 727836 - DNA, 437 bp, Homo sapiens
cgttggcctagatagccgaatcctcgctgatctggcggtgtatggcgtgctgcgtgtgatggaggggctggatgcacttcgatgacctgatgctagcacacgcacatccagccctggtacctgcggtgtgtagagggccatcaccgaggcctccctcagcgcactgaatgtccccgcgcagacgcagagtgtgaatggcagcgttgaacgacgccagctgccatgggcctggtggccactgcggccagcgcctggcgatactggttcgtgggcgcaggatcattctggccccttgtccactgcacccaccaccgagccctctcgcttctaacacagggcacctgctgggctacagggatcgcttaggctacgagttccagctcctgccacatgccctaggtgcgcagacccctgcctgtgccatgcctccctgctct

SEQ ID NO: 727837 - DNA, 1308 bp, Homo sapiens
gtaaggtattgccaacggaatgatgaagcctgaaacgatcgactcctattgatagctcttgcacctgacgtaccgtacatctctgcgacgaagcacagcagctagtgatgggacaaaaaggtggatcaagaaggccgatttacgcagacgtgagattgttcactcaggttgtacacacactgggagcaaagaagggccgagacgacatatgcgtgtgtacagaaacaaaggcacatgactagatcagtactgtagatccaatggctagttgtctcatattacaagtaacacataatccatgttccgatgacctagatgtagtcatgaaacctgacccggagcaaagtcacgacaactaatgcactcgtggaactgcctctcacgattaagcatcgagcagaagattccacgagcagagcactctacgtggtggaatgtcacatcatggcgtgactccctactcaaataacacccacaagacacgcgtcagtacgcatccaattgatgacaaagtccagaagagtggtcgatcttccatcacgcggtgtatgccttactacagcacaggtaaaggagtgtggacacagtctgctactgcgaggtgcgaaccttcccagaaatgctcaattctccgaagatctagggcgagattagtccacatgctcgggcaaaagggatattataccccatgtttcgaaattcatttcgaaatccatcagaatagcaatgagggttgtcggggctcccctgtgggcacctttatatgtcccctatgaaccaagatcttccccggcctcctagggttggtcaccaagacttgggtctgaaatttgggtcgtgggcctgccgccaaacagccagcttataggttctccccacatcctggaagaagcttagtgggtttggagcaaccccaaagaagcgggggcagcattaagagattcttccatacaacatagaagggggtctaccaaacacactgtgggctatctagatgttcacgaggaccagctccgtgtacaggtacaaatctcatcgtggtccgatccacgagagatccccgggtgtccggaagttttcccccaaagtgccgtgttgctacataacgccagtatcgtatacagtggcaggcataaatccttctaccacaagaggcatggacggcaagcgcagtggcaaaatatagagcaatacggaagactagttgtcttcgtctctaccgtctatatcgtaccgtacatcagcagcagacaaacatacactcagcatgtacactggactacaacgcagcatcgagacagcacagaa

SEQ ID NO: 727838 - DNA, 411 bp, Homo sapiens
agagttatatgtgtttcatttcgtttcctttggatatatacctggaagtggtattgctagttcatacagtagttctgttcttaactttttgaggaacctcctccgtacaattttccataatagctgcaccagccaggtgctgtggctcacgtctgtaatcccagcactttggaaggctgagacgagtggatcacgaggtcaggagttcaagaccagcatggccaacatggtgaaaccccgtctctactaaaattacaaaaattagctgggcatggtggcgggcgtctgtaatcccagctactcgggaggctgaggcaggagaatggcttgaacccaggaggccgatgttgtggtgagccgagatcacgccactgcacttcagtctgggcgacagagtgagactgagtctca

SEQ ID NO: 727839 - DNA, 612 bp, Homo sapiens
caccataattcacgatcctgtgcggaatttcgatataataagttgggggcattgagaaatgacctttccgagggggaaaggccttgaagggcactagacctgattaattatatagacggtgcccagcaagatgaaagttgccctttgttcctccggaggaagaatttattatgggagtttcccagtatggcataaaagtatcaacatcagatccataaaatgttttgcccaggcaagctctcttctttataatccggaaggtgtggttccaatacggtttgggggcgggaaaaaactttctggcttttaagaccccaaaagcaaacaattaggaaaacagcctgtggggttttagtgccacagcctgggacaagcccaaaccctttgcaagggtttatcccccgctttttgctttgtattaacatttgagaaaccctggatcctgccatcaagtagaaggccactttctttgaaaggtcagctgttttccaaccgcaaaggtgaaatgttatgccaaaaaagaaggtatcccctgctttaaatttttttaaaaaaaagggatggggaaaaagctggtcctttgttttttaaaaaggttcctttttccgtgga

SEQ ID NO: 727840 - DNA, 917 bp, Homo sapiens
cccctggtgtgatccgtcctgcgcgggttgtctctggagcagcgtctttatctccgccgccttctctcctacctaagtgtgtgccgccacccgatgaagatcgatggacatggacatgagcccctctgaggccccagaactatctttgcggttgtgaactaagggccgacaaagattatcacttaaaggtggataatgatgaaaatgagcaccagttatcttaagaacggtcagttaaaaggggctgtgcaaaaggatgagttgcacattgtgttgaagcagaggcaatgatttacgaagggcagtccaattaaagtaacattggcaagtttttgaaaaatgtcttgtacagccagcggttttcccctgtggggggcttggaaatataacaccaccaagtggtccttagggtggaagtcgtgggtcagggcccagtgcatattaggtgaccagcattgagtagcctgtggaggaagatgcagagtcagaagatgaaggaggaggcggaattgggaaccgtcttaaggtatatctggaaagcggtcctggccctgggtggtggtaagccaggttccacaagaccaatatgtaaaacttggtgctgattgaagatgtttgacgatgatgatgcagaggttgatgatgaagcttgatgatgatgagattggttgcatgaggaagctgagaaaagggccgggaagaaatttataggagaatcagggcagaatggcagaagcaatcggtggtagggtccacattttacccaggtcaagggagggattctagaaaggaaattctaaacaaagggtctttgtagattagcatgcaataaagggctccagggcgaaaaattgggagccgggagaggtaatggggggctaaaaagagcgctttgagtgttcaactgttttgagatc

SEQ ID NO: 727841 - DNA, 109 bp, Homo sapiens
cgatgaggagttggagagatgttgaatacaaggtgtgtggcttgcaaccacaacacttagggaaaaggttcccccagtcatttacgtctatgatgttgcttccatagct

SEQ ID NO: 727842 - DNA, 659 bp, Homo sapiens
tctgctctgctgctcattgttcttttccgtccgtcctcttgcttcgtcgttctgctcctggtctccatcttctgcctcgtctctctcgtgttcttcgtctgcttgctcttcgcccacacatggggcgccccgttttgccaccctaaaacccgtgtagtaaaggcggccccgggtctatcatagagaagttacttactcccgcccccttggggccacagacattctcaccacggaccagcgcctgtgcgaggagatccgcccattatcccccgccaaaagctcccgccaccaagatagccaggttatgtcacgcatctgatgaaccgaattcagagaggcccccataagaggtatcttcccatccagcttccggtaggaggagaagagaaaggagagcacccattatggtcctcgaggttctcaaccctggatcacagagattattgaagtagatcctcgaccctaaggaaatgctgaagcttttggagcttcggccatctgtcccaccctcaggtcaactcagcctaccattgggaatgaatttccaaacccctcggggacccgtttgaattttttctgtagtgctggattattttccataaatgcgggaaccacccaaaaaagaaaaaaaatacaagtcatcactcgtcgataatatg

SEQ ID NO: 727843 - DNA, 250 bp, Homo sapiens
ttccccccccccccccggggggaattttcccccctttttttttccccggggcccccccccgggggcccttttttttttaggggggggggggggggggggggggcccccccccccccccccccggggtttttttggttttgggttttttttcccccccggggcccctttttccttttttgggggggggggtttttgggttttttttgggggttttttttttcccctttccccctttttcccccccccccca

SEQ ID NO: 727844 - DNA, 258 bp, Homo sapiens
gatggtgttctcttttatgatgtggcccattgccggccagtaatgacgatcgaggagcggtacgatgacgataccgctgtgcgcgctgttctcaatgtagttgtgttccacccggttgttgcgggatccggccaacgcgataccgttccccgccatggtctcggtcgcgtagaacccggctgcttcatctttcaagccactatcagagatgacattgcccgccatgaccgtgtcgtggcccggcggatagcgctcgat

SEQ ID NO: 727845 - DNA, 1295 bp, Homo sapiens
ccattcacatctccgcgcccgttctccgagctgtcctcccgttccgctgccctgcccatgccaccatgacggaacaggccatctccattcgccaaagacttcttggcctggaggcatcgccgccgccatctccaagacggcctgtggatccgatcagagcgcggtccacagctgctgcttgccaggtcccagccacgccgagcacagcagcatcagccgccgcaccaagccagtcacccacagggccatcagttggcacctagccattagtccagccatccacccaaggcagccaggggcgatgacatggtccatatcgtgagacaggtggcaccaccattgtgccacaacgatcacattacagacatcactttaccacctagcatcaaaggcccacatcgaaacatatccgacacattacaaagcgactcaaggatacacacgcaaggagtacctctcaccatgagagcgggggcccgcatcggccaacaaacacgaccacacaacacgcccaggaataaccatagcagaacagcgataaacgctactaatggcaagcgagccaacaagcacattggcgcaccaatcacagtagacggagacatagaacagagaacacagggacacgaccgtcaaacacagttcccgccataccatgacaaatcatactcaggaatgaataacaccacacacaagacacaattgggagacacacttacactagcatcggccacaccaacaggaaccacaccccccacgggcagccagatggagaccacaacgagcccgggcacaccggcatagaagcgcaaccacaatgattccacccagagggccaacccacagagcagcgcacgaccagcaccgcgttaccacccgacaacgactggcaccaatgcgcaggagcaacgacaacacactggaccacacatgggcagctcgcaccaaaggcaacataccaactcccacagacaacgcaagtacactcccggaaacacgctagcacagccaatccgccgtacggcggcacacaccccatgaacatcaacccacaacaagggggtcagcgataccaccgcaggacgtcggaactccaatcaccaaggaaatcagccaaccagcgtggaccacgagctccaaatgtacgcacaactaccattaaccccactgaagtagcacgtctgcacaccagtcatcaacaagtcaccgcgaacggacaatgaaataacacagaacagtacacgcgagacacaccaagcagagggagacaacatagtccattccacacacaggac

SEQ ID NO: 727846 - DNA, 159 bp, Homo sapiens
gggtttttttttgggatgggcctgggcacggggccttttcttgtcagtgggggcccaccccccagagggcccccaacccccaggcagcccggcagaggaggggaggagaccagtcccccccccacccgtcccaaaaataaaggtttttgtgtttcttta

SEQ ID NO: 727847 - DNA, 147 bp, Homo sapiens
gggtagtctatcattgtcgggccgatcttttcgcactggagtcggcttaggttactgtcgtgtctacggccatctgtgtggagctgcgactagtagggctaggcccaccgctgcttcgcgggcggcaaagactagtatggccatagg

SEQ ID NO: 727848 - DNA, 370 bp, Homo sapiens
caccgctgcactctagcctggatgacagagagcaagactctgtctcaaagcaaaacaaaacaaaacaaaaaggcgggcgcagtacgtcacgcctgtaattacagtgctgcctataatcccagcactttgggatgccgaggcggccggatctcttgaggtcaggggttcgagaccagactggccaacatggtgaaaccccgtctctactaaaaacacaaaaattagccgggcgtggtggcgggcgcctgtagtcccagctactcgggaggctgaggcaggagaatcgcataaaccctggagggggagcttacagtgagccgagactgtgccactgcactccagcctggcgacagagcaagagtctgtctca

SEQ ID NO: 727849 - DNA, 81 bp, Homo sapiens
  misc_feature (70)..(70): n is a, c, g, or t
  misc_feature (74)..(74): n is a, c, g, or t
atgttccaaatacagcatttggcagaggctcacgaggcccagggaatcctctggaccatcagattaccantganagaggag

SEQ ID NO: 727850 - DNA, 513 bp, Homo sapiens
  misc_feature (203)..(203): n is a, c, g, or t
  misc_feature (232)..(232): n is a, c, g, or t
  misc_feature (244)..(244): n is a, c, g, or t
  misc_feature (327)..(327): n is a, c, g, or t
  misc_feature (377)..(377): n is a, c, g, or t
  misc_feature (388)..(388): n is a, c, g, or t
  misc_feature (404)..(404): n is a, c, g, or t
  misc_feature (422)..(422): n is a, c, g, or t
  misc_feature (441)..(441): n is a, c, g, or t
ggatctgcaaacaccgcaatctcaggaagtggagctacgtgatagtaaagatgatgatgacattgacctctttggatctgatgatgaggaggaaagtgaagaagcaaagaggctaagggaagaacgttcttggcacaaatatagaatcaagagaaagccaaataaacctgcacttgtatgccaagatcttccatacttactangatgtgaaaccttgggcatgatgagacangatatggcgaanattagacggagtgcgtcagcaagcattcaagccagacggcttatgtctggggctcatactaaactagttccagtggcgatacnggaattaagacaacttcaacatacagcgtgtatgattgaagatgataaangttggaacagnatatgctggaggagcnagatcactgcttttgagngactatgtgcagtccatgnatgtggctgctttcaacaagatctaaaatccatcctggatcatggcatttaaataaaagattgcggtgtttg

SEQ ID NO: 727851 - DNA, 213 bp, Homo sapiens
  misc_feature (18)..(18): n is a, c, g, or t
  misc_feature (23)..(23): n is a, c, g, or t
  misc_feature (26)..(27): n is a, c, g, or t
  misc_feature (34)..(34): n is a, c, g, or t
  misc_feature (50)..(50): n is a, c, g, or t
  misc_feature (77)..(77): n is a, c, g, or t
  misc_feature (88)..(88): n is a, c, g, or t
  misc_feature (104)..(104): n is a, c, g, or t
  misc_feature (122)..(122): n is a, c, g, or t
  misc_feature (141)..(141): n is a, c, g, or t
gtggggggattacgcggnaattntanngaaaacntttcacaatataccanttgtgtgttagtttgaagatgataaangttggaacagnatatgctggaggagcnagatcactgcttttgagngactatgtgcagtccatgnatgtggctgctttcaacaagatctaaaatccatcctggatcatggcatttaaataaaagattgcggtgtttg

SEQ ID NO: 727852 - DNA, 137 bp, Homo sapiens
  misc_feature (117)..(117): n is a, c, g, or t
  misc_feature (125)..(125): n is a, c, g, or t
ttaagtggttttccttttttttttttgtaagagaaaattaaaggtttttttttttaaattttgctttattgaggtttatattacaccattctaaggtgtaagggtttgatgagttcnaacatggncttcacttgtgt

SEQ ID NO: 727853 - DNA, 721 bp, Homo sapiens
ggcgggcacctgtaatcccagctactcgggaggctgaggcaggagaatgacttgaacccaggaggaggttgcagtgagctgagatcacgccactgcactccagcctgggcaacagaacgagactccatctccaaaaaaaaaaaaaaacctctaaatatatggggttaattcatagaaacaactggtaatttaaattacatattcatagtcgtggcctacgtggcatgagcatgtttttatggcttctaaccgggatggaaatctatgactttttataacagtcatggagtctgttccaaagggaactctggtgggtaagtattttggcatgatggtactcaagggtatcaaggtttaacaattggacttttttccattgggaaagcatatgtgattaactagcatgggatggcttctggacctggctggtcaggtggtaggtctttttcttctaatataataaccaggggattaatggaaaatcaaggttccatcctcagacaagaggtaaaggttcacacgattcttcccatggtctggtgccagaaaagaaacctattcaggatataagttaagctaatttagtaatcctataatggtcctctgagagatttagatggatgggccacttcacagtagcagccaactcacgggagcaccggggcaacgctagtgggactttttggtagtgagtgtgtgatcatagaacaatgtagatttc

SEQ ID NO: 727854 - DNA, 366 bp, Homo sapiens
  misc_feature (8)..(8): n is a, c, g, or t
  misc_feature (39)..(39): n is a, c, g, or t
  misc_feature (72)..(72): n is a, c, g, or t
  misc_feature (75)..(75): n is a, c, g, or t
  misc_feature (112)..(112): n is a, c, g, or t
  misc_feature (161)..(161): n is a, c, g, or t
  misc_feature (166)..(166): n is a, c, g, or t
  misc_feature (297)..(297): n is a, c, g, or t
  misc_feature (319)..(319): n is a, c, g, or t
  misc_feature (332)..(332): n is a, c, g, or t
  misc_feature (342)..(342): n is a, c, g, or t
tggccaantcctcccccacaatccgaaaactagtgcaanagagaaccatccttagtttaagttaacttacanaantggaggccgggcatggtgcttacgcttgtaatcccancactttgggaggccgaggtgggtggattatctgaggtcaggagtttganaccancttgggcaacatggtgaaaccccatctctactaaaaatacaaaagttagccaggtgtggtgcatgtgcctgtaatcccagctactcagcaggctgaggcaggagaatcgcttagaacccaggaggtggaanctgcagtgagccaagatcacgntactgcactccancctgggcaanagagcaagactctggctcaaaaaa

SEQ ID NO: 727855 - DNA, 1158 bp, Homo sapiens
gcagcatcaggggctcgggacggtaaaagtcgcttcgcacgtttccgactagtttggaagaactcgaagaaggccgggaaaggagtaggagatggcacgacgctgtacgctggggtctatgaagatagacgagagacgagtgacgacgttagcgaacgagtgggacacgggactgactagagtgtggcggcctccgaagaaacaagttgtaatgagaacagcacggaatatacaggacttacaagagtaaagatatgtggaacgtaaaatacgccagagaagcgaaccccgcatattgtaaagatttgtaacaaaatttcacagtatgcagactggaagtatagatacggttcgtagagtgggaaggtggattgggaacaccgagagggaggcccatattctagctggcttaggcacacaaatgggcgacgaaagtagccagttagtaagccgatcaaacagggagttgttctcttgcataagtaaggctatccgaggcggccttaaatcggatggtcgtaaacggcagttaaataaccgtagtcgtagatattcgttcacgccatcaatgttcaccgggtcccgaaaaggggtaccaagagtggtttcagcaaaggtcaagttataaaggtcgaaacacacgaggaagagaaaggctagcaagtggcaccccgttatccaaccattttgccgcccactacaaatgttgtccgtaatttaataaacatcagggtgttctgcccacgtatgtgtgtctgtaacgagtgtaagaataaaagagttttggcattagggagttaccgggttcgttggggtaagtaaaccgattaaaacaaggttaacccagtggacacaagggggatacgccttccccaaatttactagaagaggggaaagaatttttaagtgcatctgaatagtattaacctgtttaaagatatggaattgagcgtataagatttttgagttgggtgccacaatatttgtgggaagagattcattagctaaaggttaaggtatggcattagttaaaatcaagaatacttcggagtacgtgtgggatccatagggttggtgtaagagaccaacacttggattggcaaaccggttaagagtattggaaaagccttatacgtgggaggagatccacacaaaaaa

SEQ ID NO: 727856 - DNA, 336 bp, Homo sapiens
gaagcacaccctcgggctctgtctgtctgttagtagaacacctctctgtctttctctctcggtctctgtctgtctgttagtagaacacctctctgtctttctctgtcggtctctgtctgttagtagaacacctctctgtctttctctctcggtctctgtctgtctgttagaagaacacctctctgtctttctctctcgatctctgtctgttagtagaacacctctctgtctttctctctcggtctctgtctggctgctagtagaacacctctctgtctttctctgtcgctctctgtctgttagcagaacacctctctgtctatctctctcggtctc

SEQ ID NO: 727857 - DNA, 257 bp, Homo sapiens
gtacgacaaattagaaaaagttatatttatcacgaagcagcatacatatacacaaatataagagttacagctttcctgaggttggtttcatggacaagttattaggtcccatcgtggaatccaggattccagagtcttgggtttcagaggttatatcattggcttctagacctattgagcactcatgaaagcattgagaaatatctaatatctcttaatgccttagtatagatactcatatatcaaagtagactgtg

SEQ ID NO: 727858 - DNA, 286 bp, Homo sapiens
gatacagtatctctcacccagtctggagtgcaacagcgtggtctccgctcactgcaacctccacctcccagattcaaatgattcttgtgcctcagcctcctgagtagctgggactacaggcatgtgacactatgcctggctaatttttttgctatttttaagtagagacggggttttgccatgttggcccgaggcaggtggatcacttgaggccagaattcgagaccagcctggccaatgtggtgaaaccctgtatcactcttttaggcccttctgtcgtcttctc

SEQ ID NO: 727859 - DNA, 103 bp, Homo sapiens
tatgtgggacgtttccttggtcttcatggtccctgccagtcctgtgaactacaacttatgggtgtcggcatgacccaacatgaaatatgagctacagctggcg

SEQ ID NO: 727860 - DNA, 736 bp, Homo sapiens
  misc_feature (21)..(21): n is a, c, g, or t
  misc_feature (23)..(24): n is a, c, g, or t
  misc_feature (27)..(27): n is a, c, g, or t
  misc_feature (29)..(31): n is a, c, g, or t
  misc_feature (34)..(34): n is a, c, g, or t
tcaggctagtacgaggccctntnntcngnnnagngcggcgtgagaagccatgagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttcta

SEQ ID NO: 727861 - DNA, 514 bp, Homo sapiens
  misc_feature (1)..(1): n is a, c, g, or t
  misc_feature (74)..(74): n is a, c, g, or t
  misc_feature (118)..(118): n is a, c, g, or t
  misc_feature (135)..(135): n is a, c, g, or t
  misc_feature (143)..(143): n is a, c, g, or t
  misc_feature (174)..(174): n is a, c, g, or t
  misc_feature (176)..(176): n is a, c, g, or t
  misc_feature (193)..(193): n is a, c, g, or t
  misc_feature (195)..(195): n is a, c, g, or t
  misc_feature (204)..(204): n is a, c, g, or t
  misc_feature (211)..(211): n is a, c, g, or t
  misc_feature (315)..(315): n is a, c, g, or t
  misc_feature (336)..(336): n is a, c, g, or t
  misc_feature (340)..(340): n is a, c, g, or t
  misc_feature (346)..(348): n is a, c, g, or t
  misc_feature (351)..(351): n is a, c, g, or t
  misc_feature (368)..(368): n is a, c, g, or t
  misc_feature (381)..(381): n is a, c, g, or t
  misc_feature (385)..(386): n is a, c, g, or t
  misc_feature (390)..(390): n is a, c, g, or t
  misc_feature (423)..(423): n is a, c, g, or t
  misc_feature (427)..(427): n is a, c, g, or t
  misc_feature (465)..(465): n is a, c, g, or t
  misc_feature (471)..(471): n is a, c, g, or t
  misc_feature (486)..(486): n is a, c, g, or t
  misc_feature (498)..(498): n is a, c, g, or t
  misc_feature (507)..(507): n is a, c, g, or t
  misc_feature (509)..(509): n is a, c, g, or t
  misc_feature (512)..(512): n is a, c, g, or t
nagcggccggctctcctggcgccccgttctccctcccattctctaggtccctggaggccagacccctgggtgtngcccatcctagcagtggttctggctgggtctgtcctgggcaggngaggagggtccctgganaggcagtnatggctacaacgtctgtagggaactggggananttccggccaaccatganangcccaagcntgctcanctctgcacttctggggatccccttattcctgactctcccccctcccccacctggaatatacctaggccctgcaccctaatgatgaggatcggggtgaaggggtncaaaatgtcctgggggttttncgancgcttnnnagnggactcagcaaggggancgtagggcgggcntcanntctncagctccaagaggcaattgggctctaaaggtgngganccggccgggctggagctatgggcctcgcggaggtcctncaacanccggaaaaccgggcnaatgaatcctcngggactttncnaangc

SEQ ID NO: 727862 - DNA, 113 bp, Homo sapiens
aggatccctcgggagtagacttgaggaatgctggtgatattggtatcagcaatgcggatgtagcggacgagcatatcttcagttacgcgcgtgtgaaaggccccattttcaat

SEQ ID NO: 727863 - DNA, 784 bp, Homo sapiens
  misc_feature (21)..(21): n is a, c, g, or t
  misc_feature (23)..(24): n is a, c, g, or t
  misc_feature (27)..(27): n is a, c, g, or t
  misc_feature (29)..(31): n is a, c, g, or t
  misc_feature (34)..(34): n is a, c, g, or t
tcaggctagtacgaggccctntnntcngnnnagngcggcgtgagaagccatgagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttctagcaaagagtaagacaattgcaaggcattgtagtagggtgcggaaaacg

SEQ ID NO: 727864 - DNA, 733 bp, Homo sapiens
  misc_feature (21)..(21): n is a, c, g, or t
  misc_feature (23)..(24): n is a, c, g, or t
  misc_feature (27)..(27): n is a, c, g, or t
  misc_feature (29)..(31): n is a, c, g, or t
  misc_feature (34)..(34): n is a, c, g, or t
  misc_feature (678)..(679): n is a, c, g, or t
tcaggctagtacgaggccctntnntcngnnnagngcggcgtgagaagccatgagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcaaaacgtgcgggctctgtacatcaagagcaccanngcaagccccagcgtctgtattaggatgctccaataaacctcactgctgccactc

SEQ ID NO: 727865 - DNA, 163 bp, Homo sapiens
gttgcctcatgcagttggttggcctactgtgcagctcaatatgccatggctcagaccttggagcgccagtgccacacctttctccttggcccatgttgtgagcactcgtgaacccacttgaggcagacgcctgaggctctgtcaccgagtgccatgctctaca

SEQ ID NO: 727866 - DNA, 860 bp, Homo sapiens
agctggagagaaggaagtggcggagagggcagggagagacgtgtacggacggactctgcgtgaccgcgggacaccagcgggttgggtagggctccccgggcgtccccgcccggtggcggggcccatgggtacggtcccccgtgcgcgaaagaggagccccaaagtacacgggggaaaacaaagtggcagggataacaagagaaaatctggcttgaagccgaggggtccttgtggctggagaatcacgaggcaagtcgtgtcggcaaagcgtccaatgtgctcgcccgaaccctgaatctttggacccagcgggaaaaaatggctctcctcaagtggggtccccccatgtgggcgtggaaagagcggtggcccgctagcctttgggaacaaggagccacccccggcggtgtgagaaagtgaaagtacaccttgaccccgggcggcacgacagagtgcgttcggccccaagggagagatcccgtgtgggagaccagttaaaaaaggccatttctcgtctaaggtaattacaaggatctgaatcccccttcataaggtggttgatccacgatggagccctgccaccgacggtgggtggaacctactgccccagcgggaaacccccttatttcctctggcccccaattcttcacctttagacgtgcgaacccccctgcaccccccgtgttgtaagatatatacgaaaatagtatatctataagagagaaaaagcttcccgtcctctgtgtgaataagaccccccgcttctaatactaggccagccatggggacatttttttgaatgaagaacgtctttccttttttttttaaaaaaacttaaaaaaaaattcccccaacaaaac

SEQ ID NO: 727867 - DNA, 1121 bp, Homo sapiens
  misc_feature (21)..(21): n is a, c, g, or t
  misc_feature (23)..(24): n is a, c, g, or t
  misc_feature (27)..(27): n is a, c, g, or t
  misc_feature (29)..(31): n is a, c, g, or t
  misc_feature (34)..(34): n is a, c, g, or t
  misc_feature (216)..(216): n is a, c, g, or t
  misc_feature (232)..(232): n is a, c, g, or t
  misc_feature (237)..(237): n is a, c, g, or t
  misc_feature (565)..(565): n is a, c, g, or t
tcaggctagtacgaggccctntnntcngnnnagngcggcgtgagaagccatgagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggttggnaccgttctgatcccanccagncctcagtgcccccgtgcttgcccctcccctgcaggctcccgctgagccggaggcgggcacgtcggtactgatgtgctagggtagttcagaccctctgctccgggcaggcgcggcgtggacggatcccctaccctgtgttcttaaaacatgaggggaggcgtgggatcggcctctggcctgagcaccgcacggccagcctgagaagccaggcatggatgctggtcgaatagtgaacgcgtccaggtgtaaggctacggttggctagcatagcggtcccatgaccacttcaccggacccttgaggacccaggtgctaggtcgtaacctgnttgagtgctgtcccaccgaaagacgcaggcacttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttcta

SEQ ID NO: 727868 - DNA, 797 bp, Homo sapiens
atccccaggctggagtcaggctcagcgtgtggggctgggagcatgggctctcaggctgctgctgagtggaggaattgggccgcctggcgagtgtgtcctccagcctctctgtgatgctccatggagtgggggtctgggagtggtgagggaagggtggctgcatctcgatgagctcgctctgacaaatttctcggtccatgacaatgtgggggtgtagtgaggcgcagctgtggtcagggccatgcttgcatgggtgccagtggtggccgtccttcctcagtcctgtctggcctccctctgcagtggtgcttcaaggatgaccggatcgtcttctggacttggatgttctccacctagcttcatgtggcgaaatgtggctccccggctaggaccggagcatgcttgttcatatgtgacgcctggaagcgtggcgtactccggctagcgaagagcggtgcgagactgggacggaacggcagctgagtcctgaggtggacggtggcaggtgtaccgagtcgggactccaagaagctgccaggcctggcgatgacctgacatcgagctgggagtgagagcgtctgcctgagtctcatcctgcagaaggctggactacatggtgacctgtgcgtgtgtggcacaccgtgctgacggctggggacattcacggtccgtaagaagaaatctcagcaagtgtacgcgtccccagtgaacaccccgatggacgagaagggggaggagtcccaggatcagctaccgccaacatcgttcttccatgattgacgagcttcgagggcagt

SEQ ID NO: 727869 - DNA, 195 bp, Homo sapiens
ttgcctttctaattgatggctccagcagagttggggatagcaatttccgcctcatgcttgaatattgtattccacacatagccaatgacttttgaaatctcggacattggtgccaacgatagctagctgtacacgcttactatatgatcagccgcacggagttcagttttcacctgacaacggcgtgtacccgac

SEQ ID NO: 727870 - DNA, 1465 bp, Homo sapiens
  misc_feature (560)..(560): n is a, c, g, or t
  misc_feature (576)..(576): n is a, c, g, or t
  misc_feature (581)..(581): n is a, c, g, or t
  misc_feature (909)..(909): n is a, c, g, or t
cgcgggtgagaagccagtgaggtgagttggtcctgaaagcgctatccgcgttcatccgcgccttcaggtgccccggcgagggttcggatcctgtaggccgcggccgcggacccttggcgccagctgcgtccgcggggcatttctcaaggcggggtcggcctgcgggtcgcccttcctaccaggtccgatcactgagagcctcccgtcttccaccggggcttgggtctgggtctgagtcgtcccgtgcgctctagcttggtgtccggaagtctacgggggagtccgcgcgtgggcccggccgcccgtcgtcggaagcctagacctcggaggcttcctaggcagtccgagcgtgtggactccggcgggccgtgagcgcccggtcggcttctctcccgcagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggttggnaccgttctgatcccanccagncctcagtgcccccgtgcttgcccctcccctgcaggctcccgctgagccggaggcgggcacgtcggtactgatgtgctagggtagttcagaccctctgctccgggcaggcgcggcgtggacggatcccctaccctgtgttcttaaaacatgaggggaggcgtgggatcggcctctggcctgagcaccgcacggccagcctgagaagccaggcatggatgctggtcgaatagtgaacgcgtccaggtgtaaggctacggttggctagcatagcggtcccatgaccacttcaccggacccttgaggacccaggtgctaggtcgtaacctgnttgagtgctgtcccaccgaaagacgcaggcacttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttcta

SEQ ID NO: 727871 - DNA, 766 bp, Homo sapiens
  misc_feature (21)..(21): n is a, c, g, or t
  misc_feature (23)..(24): n is a, c, g, or t
  misc_feature (27)..(27): n is a, c, g, or t
  misc_feature (29)..(31): n is a, c, g, or t
  misc_feature (34)..(34): n is a, c, g, or t
tcaggctagtacgaggccctntnntcngnnnagngcggcgtgagaagccatgagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaaggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttcta

SEQ ID NO: 727872 - DNA, 470 bp, Homo sapiens
  misc_feature (238)..(238): n is a, c, g, or t
attattttagtagtgttaatatttacctactttacacaactcaaaagaacatatatgttgactatatttttgtttaaaaaagataggaaaataggaaaacatacacataactacttggctatataaacacgatgaagataaaccagaaaacaatgatgttagttatctacaagggatggtgaggaggtaaagtgcaagcactggtatgctgctgtttatttgtactggcttgcaaganccaattgttaagtttccaggagttttgcaagctggctgacattatgttggtagtgtgaaattagccactgttgcgggtgtatttacaccatggaaatcagcaaatgttgcaaattgagacttttctgtcccaagtagcgcagcatccccaacagggggcgtaacacttctttgactacacttcaaaaaatacgtatttatcttttggaaagatttcaatgtttcatatatta

SEQ ID NO: 727873 - DNA, 377 bp, Homo sapiens
tggccgtgtcagtgatgaggaccccaagtatgcaggctttgcgtcacctgctggtatcatgtgctctcagctcatgagtagctttctaaggctgacaaactgctcagcaatgacacacagcccacatgctacagtctcttttcctgcaggctgtaggaatgagaaagtgcaaggataaatgacactaaataatgcagaggtgtacaccactcacgcaagagcataacaaagtacatttgagagagctgcacagtggaggggggcatgtggaaaggttagcactccacactgggctccaaatcatagctcttaagcttaaagacagcacccgcatgggtctccttcatgtctcaccagtccacctgcactgacaacgg

SEQ ID NO: 727874 - DNA, 289 bp, Homo sapiens
taacattcgtctcttctatagggtgatagcatgagtccaatatgggatgtgaggagtacagttatatgtttggcattttgtaggtaagtgagtgttgagacttgaacgctttcttaatgggtggctgcattataggcctactatgggtgtaaaattttttactctctctacaaggttttaacctagtgtccaaagagctgttcctctttggactaacagttacacttgtacaaggggatatagagggttctgtgagcaaatttaaagttgaactacgattctatctggg

SEQ ID NO: 727875 - DNA, 473 bp, Homo sapiens
ttcccgcaatggcatcatatcgcgagagtcgtatcccgtagaaagaaatttcttatcgaaagaaaaggaaaccgcaccacggtggtcaacaagatagccgacatcttgcccccaaagcttcaccttgcaagtaaacgtttcagcatgctttgccatacaaattacctctcaaactcaccatgaattcatcaaactaaccattagctcacaacggcttcgcccttcgacaagcgccttgcgattgaaaataatacgttcctttcggcatcgtaattaggtgcatgcttaaattgatcccatccaggcatgctggttttaaagtccggccagatatttccctttggcctcacaacctcaataatctttctgccatcaacgtgcagcaatccccacctttctggcaagtcttctttttcaatcacacctggagggcaaatgaaaaaccgatatatccccagaccaccttcagatcg

SEQ ID NO: 727876 - DNA, 778 bp, Homo sapiens
  misc_feature (21)..(21): n is a, c, g, or t
  misc_feature (23)..(24): n is a, c, g, or t
  misc_feature (27)..(27): n is a, c, g, or t
  misc_feature (29)..(31): n is a, c, g, or t
  misc_feature (34)..(34): n is a, c, g, or t
tcaggctagtacgaggccctntnntcngnnnagngcggcgtgagaagccatgagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggtggcttaatgtcacactcctccgctcgctaatgttctcttgtgttgtgtccgtgggcggacacatgcatgcacatgatgactgatggctagaggcccgtgcgatattcctcgcatcggtggacattcggatggcgtctgagttaaaacctcagcaagaattcacgaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttcta

SEQ ID NO: 727877 - DNA, 1292 bp, Homo sapiens
tgttcgatgtgcactctcgttcacgtgatgtgggtgtccctctacccgttttgattgtgtgctctgtgacttctccgcgctcctctgtcggttcggtgtgcgttccccccatcttgtttagtgcccactctgttggtgaccccgttcaacggctgctgctctttctaccacccagtgggttttccctccccgcgtgtttgggttaaccccccccggggttgttcgaccgacccttgtccccccttgttccccccccctctggggggatttccgtgacaccagccggttggccccctccaacataagggcgcataaataaggggaaacaccctgggtttaaatatgtgtcgctttgtgtcgcccaaggggcccgttgtctatttggttgaccccctgagccactttataaggagggggttccctagaaggctttttcccacacatataatgtggttgggaggtttcctgggtaccctgaagggttggggtatccaccaccgccctttgggttccccttcttggggcctttgaagataattaaggcaattaattggggaaggggcaaaacctcccctccctgtggaagaatttcccctgtgcccacgaggttcccccagacgatggtatacaataggaggggaaatttgcgtgctcggaccctgtaattctggcgcccgagcggaataggattgggaaatgaagggtatcaaaatggcacgcaattaccacaggcttagccgcgggggccaccccaaagaagtttctttctcctgggaacaaagttttgtcctctaagacgccaaggagtggaaaaactggggaccaccccaaaggtaaacgccaacagtggtgagcccctcgggtttggaccacagccccagaaggcccacgcgtctcccacgtattataagccacaacccaggccctccggggagcccacacacggaagaagtggaattaagagcacccaagtctggcctcacctgaagtggaaccaagaacctgaatgggcctcaatacacgggtgaacacattcacccccacgggcacagcctgaccacactcttggcccctcagcgcacttatcccactttggaaatgtgaaagtggtggcacaagtgggcacgaggaccccccctgggaacccttttccctcacgttagctggggagactagcaccctcaggtaacccaccactggcgtaatttatatctgaacccagaccagacgcttggatccggccctatgcttaaggaatatatttatttgctaatatatttatccccccaata

SEQ ID NO: 727878 - DNA, 147 bp, Homo sapiens
gagtggggcaaagaatagggatactgaacatgcttgaacttggagatgaaaaagtttgaagtgtagtgtgcttcttttggaagactcacatattcaagccaaatgttaacatcattattcattcaacaagtatttattggatatata

SEQ ID NO: 727879 - DNA, 168 bp, Homo sapiens
catcttctccttacacactagcagagtgttctcatatcttaggggccatcgaagtttcatctacaacaattatcaatataaaccccctgtgtgaacctcagttatccagacaccctcttcgtctgatccgtcctaattacagcagtcctacttctcctatctctccca

SEQ ID NO: 727880 - DNA, 450 bp, Homo sapiens
  misc_feature (127)..(127): n is a, c, g, or t
agcagggtgggcatggattacggtagctgcttcttgagaccggctggttctgtggatgccagtgccatggtgaggtgctttttgggccgtgacccgaagcagggggccttcctcttgagcagggggntgcgggtcgggggttgcgagccggagccgcaggtcttgtggggtagagcactggaccgcgcagtatggaatgagatgcggcggcgggggtgtttttgtccttggttcaggatggggcaggatctggttcgtgccgggctttggaggggtgcctgagaggttgtcctgagtcacgcccttgaacgcccctccccggttgagggcggaatgatttttcttattggcctacacgattttggggtcggtccctaacaaaatgggggggtggcctggccctattacatatccatccttcttgcctggcagttaatccccttcctccga

SEQ ID NO: 727881 - DNA, 1014 bp, Homo sapiens
gatccgaccgcttgcgccgcatggagtccgaatcggaaagctggggctgctgctgacacccccccactggagaccctaagcttccatggtgatgaagagattatcgaggtggtagaacttgatcccggtccgccggacccagatgacctggcccaggcagcatggcaagcatgtggcactttgcaggcacagcacagcaggcaggcaagcagggccaacgacagcagggctgcggttctcagcaaccccaggcaaggggctggtcggccagccatggcagggccccgactgatagcgaggtcacctttgcatttgcactcagcatctgtgttctcgtgtgagcctggaccccaagaccaataccttggcagtgaccgggggtgaagcatgacaaagccttcgtatggcggctcagcgatggggagctgctctttgcagtgtgcaggccataaagactctgtgacttgtgctggtttcagccctgactccactctagtggccacaggggcaccatgagtggcctcttgcacagtgtggccaggtggcacactcaaggcaggagcgtctggtcctttgcacacgcgggcagacctggcagtggcatggacaaggcaatcctcgacgcaccaaggtcctgtctgggcggcacacacgcctgacggcaaaacctggactgacggcccagtcccgcactgcagactggacagaacgtaccagggtccccaaaagccaagccacacgggggcccgagctcatacacatgatcgcgacacacagcaggggcgacggccactaaccaatgcggacccacccaagaaaacagggaacacacgcacccagcgcgaacgcccccacacgcgtcaccggcaacgggcgacgggacgggcacaccgcgacccacacacacagacgtgccacgacaccacagcctgacaccgaacccaccacggccccccggcagtcgcagccccacggtccaggcccaccaacgcacaggagagggaacacaacgaa

SEQ ID NO: 727882 - DNA, 1577 bp, Homo sapiens
  misc_feature (675)..(675): n is a, c, g, or t
tgagtgcctaccctttcgttgttttatgtactcgtacctttgtatgtgtgccatacgtacggtgtgtggcttcccccaccagagagcgacgacagaagtgctttatataatggagcggcgcctggtttgtgtggtacgtctgtcgcctccctcctgtgtgtagtatatttttgtcccccccgttgtccccacccccttgggggggggagcacaccgagccgcaccaaggggggcgcttttaattccccccacgtgttgtgcgcccaccaggaaagggcgcctcactactttcgtgggtagggtagacgtcttttggtggaaggcccccccttggtggtgtgtggccgccccgtggtagcacgctccgttttcgtgtgggaagggtttcctcgagccccacacgttgcgtgtttgttagtaagaggaagggagatgtcggccccctcgtctgcgagtgtttgttttaataagtgagccccccctctctccctctttcgtccaacaagtctcccacaagagggcgtgttcgcccgccacaaacaggcgggatgatctggggtggcgcccccccccctggtttgttcctgttcgtgtagatccgccactagaggccgttaaatagtccttctcttgggcgccgttcctcctctgttggcgagaagaagttcccccacncaggggagagaagagggaagtgtggccacacccctgctgttggccccctcctgggtgttgtccccccgcaccttctcaacttgtctctggtggtgtgagaacaccccccacctgcttaccccacatctttcgtctcgtccctcccacatgtgttgctcaacagcgagacgtctacagccgcctctcactagagactcacacacagtgtgagagacacacagtttctcacacgctcctctgtgagaggagagtgagatattttctctgtgccacaggcttgtgtggttgcgccacacgctgctccacactgctcacagggcgcgcctcacacacccgcggttttgagagaccctctctgtgaaccacatctactctctacacagggcacccttggcccctgagattgggagcccacctgtgtcactcggacgattttgtgtcacactctacagagagagaaaaataacgctcctcccacctgtctcacacaggagatatcccacacacacgctctctcgtgagagaactcccctataggccacgcgacacactctcctcgagaaccccacaagaccacacttacacacacaccacgcctataacacacaccacgccttccgcacttaccccctcagagtttctccacagggttcttctctcttgccccccccaccccagattgggggaaagaccccaggtgggctttccccctgggctcgctgccccgagccccagccacctcttcttaggacaccccacacccacacccaaagagttgttcccttaaagattaagggccagaatccacccgcggggccagactgatcacccaattcccagactgtgttaaaagagagcttaatgataatattgtggtgcccacccaattaaatggatttatt

SEQ ID NO: 727883 - DNA, 117 bp, Homo sapiens
taaatttctggccctacactattctgttcccactgctagagagatttttttcctctacctccccattcttaaggtttcagtttagacaaagggaaacaccgggaactctctagagtc

SEQ ID NO: 727884 - DNA, 1638 bp, Homo sapiens
cgtggtgatggacacctgtaattccagctactcaggaggctgaggcaggagaatctcttgaactcgggaggtggaggctacagtgagccgagatcacgccattgcactccagcctgggcaaaaagagtgaaactccatcttgaaaaaaaaaaaaattcacgatcatctgtagcaaaatttaaatctttaatgctttcctcccccatcctccccacctatgggaatcggacaaaggttatgtttacgtaaattagcacttcaaatcttaagggatgtaggaggacattttcccttaagtagcccaatttctcccacagtggcaggaatcccaggacagacaagtcatggaagccagctgagggtcaacacaatggacctatccctagagcaccagaaatcgggaagacccggatggacgtggtagctccaagcctgtaatcccagcacttggggaggccaagatggatgggatcaactgacggccaggagtacgagaccaacctggcaacatggtgaagaacccaatccgctactaaaattacgaacatagccaggtgtggcggcccatgcctgcactcagcaatgggaggcagagcaagagaacagctgacgggaggcaaggtgcagagaaagttgtgccatgaaccagctgggaaaaggaaccgaccaaccaagaacggaccccgaggccaactacatgggccagggacacgcggcggtcagcgtgcacacaaacgagacgactggaaccaaagaaagacaatacaggctaattgcgccacgtcctcttttcagccatgagcaaacagaacaaagcaccaccacacaacgaagcagcaaaacagcacaacagagcacaaagaaacacagcaaacaaccaaccaaaaacaaaccacaacacgacaagcacaacaacccaagaccaacgcagcgcagcagggcgggcaggaggcagacgacgggagacgagagatgaggaggaagacaagcgaagaagagagagagaagacgacgggagaaggagaaagaggaggaagcaaaagaaggagagagaagagaggaaagacgaggacaagagggcgaagaggggcaacggacaggaacaggaggaagggcagggaggcggaggcgacagaagagagcaagagagcgagagggagagaggaggaaagggaaaaagagaagcagagaggaggcgaagcagggaaggaggagggagaaggcagaaaggacgaaggaacagagaagagacgacgagagcgcggaggagcacaaaggaagcagggagagaggagacgacgagggtggcgagacgtgaggggagggaaaggaagcgaggggcggaggagagaaaagaggaccaagaagagacgagaacggcaaaagagacggcgaaaggcagagcgaggagaaggcaagcagagagaaagcggagaagacacgagcgacgaggagagaggagcaccgaagcaagaggacaggagaaggaaagacagagagaagacggagagaagcagagcgagaccgaaagcacggagaagacaaaaaggagacggagcgaggggacaaggaaagacgggcaggcggaaacgaagacgaagacaggcgaggaacgaaggaagagacaagcaagcgaca

SEQ ID NO: 727885 - DNA, 208 bp, Homo sapiens
ttttgtaagcccttggtgaactgctgacttaactcagttttaagatttcctctttccccccaacttttccccattttttaaatgagggggtaattttctgcaaacatggccctttaatataatattgctgttagattcatgggaccctttatgaagcaaaaacatgaaaaggaaacccccactttaataaactttaaattaaagatta

SEQ ID NO: 727886 - DNA, 975 bp, Homo sapiens
ggatcttcgtgctaggcagagtttacacttgctaactggactatagcagccttatctcggttatagtacaaaacaagaacacagaaccattcaggatgactccattgaaaacaaacaggcaaaaataatgtcagcatggttcctgaaatccattcttgtttcattcgaaaactattaataatattgtgtggtcgagcaggtgtaagagctggttgtccgtctgaccaactcgtattatgatcgatccgtcatttcaaccctggaggtctctacatgtagagatggatttcttgaacgcgtccttcctaccagcatgatatgaagtaatgatagcatatcatccgacaaaaatgtcgttacggtggctgcttgtcacgcttatgtagtgatatcatttgtagtgttgagacatcagtgcgcatctctatatccaatagcactatttgaacatctgagagataggagaccagcaagaatcattcacgcgtggcgacactgaaccgcgggagacgcggtcgaaacagaggcgataattcgaccaggagtggatacaatagttggtatacgtgattacgcccgacacgccagagatgactcctgtgacacgaatggttcagcaataactttctcgcgcggctgtcccgcactgctacgctgcgtactcgcaatcacatggtcagcgaaaaacaccgcccgtggtaaacccaggtcatcgaaaatgaccccgcgcaaaacaccgacacacaacgcatggtcaacggacgacccccccaccacacccccccacaccaccagccgaggaagcccagcgggtcaccatatccacgagcagccctcccacaccccagctaggacaccgacacgccacccactaacaaccgactgccaccagacaagaacgccactacaccaactactgacacggaccgaaccaaacaccagcacactctcgtaacataccacacccagcacccc

SEQ ID NO: 727887 - DNA, 162 bp, Homo sapiens
accgcccctcagacgccggcacgcgtccgatatatcatcgccaagggctggagcctgagggctggaaggcgactgagcctgacgctcggaaggcgtcttgagaccaccatctgcctgagggctggaagctgctcctgcagacgctcggcaggcgtcttgaca

SEQ ID NO: 727888 - DNA, 112 bp, Homo sapiens
ctaggacagccaggacagccaggccagcaacgatgcccacttatggggatggtgggctgagaagatggctccgatctcagggtgaggggctccggcagcccctcgtgctggt

SEQ ID NO: 727889 - DNA, 318 bp, Homo sapiens
gggagaccaaaagctaacatgtgattagtagccatcccagtgatgttcttgaccataatttgagagctcagcacattcctggcaccgaattgccattcatttattacctgatatcattctcacattcacaagctttatgagctcattttacaggtgagtgatttgttcagatcacacagctattattgcagagcttggctttggactttgtctttttgctcagacacacctcttttcatattccccacagcctccttgagatgcgagaaccttcaaatttgtgccttctggtttgagtctctatggcacagcatgaca

SEQ ID NO: 727890 - DNA, 1029 bp, Homo sapiens
gaggcattgaggcagccagcgcaaggcgtttctgctgagtgcgggcgagagtcggagtcattgagcgataaccgggagaataaggtgtcatcttgtcatcattgtgaatgacgatagagtattgaatgacaacatcactctgatgaaagatatcagatcgcaatcagtgttgacataggaatcattgctgttagcgattttaagtttcttaacgttatatgttgtatgtagcttaatgattgtgaagaagtaaaattatgaagtacattagaaagaacgtggacatgaaggcataggcatcctagcatcaaacaggtttcttagaatacatgtacgagaggttgcagattgtaagctctcttcatgtgagttagataacacatgttatttgaaagatgaaaatgtagaagagaaagggagctacagaggcactcgcgaatttaataaccaatagaagggcaatggctttgtgaggatgtgagaatgagaggtgacttaaatcagctttagagtttacgtttcaaaagttgtaggtgattaggaataatttgaaggcgatcttttgaacagagatgagattaaatccgaaggtgattaaaagaccttgaaatccagtgacgcagggagaattgcgtcattgtaagagccgtagttaagcgcagtttactaaacgctagacgaaaatggcaacagattaacttgggacgtgggtaggatgacacacaatttggagaagatagaacgtcatgccgtggaaaactggaagacagaaagtacgggaaggcgacgcacccgactcgagaacgatcgggcaactttggaccggaattcacacccatcctttttagaacgcacacctccagattccattttacagctctgacaccaggtaggcaaggccaggacagaagagacccgcacgcaggctagggaacctaacaaccgctgtaggggacaaaatgctacacaaccttagcaggaaaattggacagcactcgaaaaccaggattgaacgctggaaacaacttg

SEQ ID NO: 727891 - DNA, 117 bp, Homo sapiens
acccagaagctttcaacccggaacggttccgcgagaaggtcgggaccttgggtggaaacaaccttcaggtcttgaatggagtcgacaaagacgatccgatcgcaattgtatacggct

SEQ ID NO: 727892 - DNA, 148 bp, Homo sapiens
tccatttctgactcctgtgtaactggtaccacaggcgcctgccaggtcctggagaaatagtagcatggcaatgtttgtgggttatttttttttaccacaattttagaggaaacccaattgattttgatacccaatattgacacatttt

SEQ ID NO: 727893 - DNA, 735 bp, Homo sapiens
  misc_feature (666)..(666): n is a, c, g, or t
ttaacggtgctagaaatgaaaattctaacccaagacgatgacgattcttagctgtaacttaagctattaaggccttttccacacgcattaatagtcccattttgctcttgccaattgtagctttgcccactggtcttatggcacatgggtggacacggatctgctggggctctgccttgaaacacacactgcagcttcaacttcttctctttagatgttctgttgaaactaatacttaccgagtcagacttcgtgttcatttcatttgcagggctcttggctgcctgtgggcttccccaggtggcctggaggtgggcaaagggaagtaacgagacacgacgatgttgtcaaggatggtttagcggactagaggctcagtggtgggagagatccgctgtcgagaaccctagcgcaactcatgaacgtggtttgcctgaggctgtaactgagagaagagattctggggcgtgtcttatggaggagatatagacattctcacataagcccagtgtcatcaccattgtcctcctttagcctttcagtgcagtttcttttcacattaggctgtgggttcaaacttttgggagcacggactgtcagttctctgggaagtggtcagcgcatcctgagggtcttctcctcctctgtctttgggagaaccagggnctcttctcaggggctctagggactgccaggctgttcagccaggaaggccaaaatcacgagtgagatgtc

SEQ ID NO: 727894 - DNA, 1132 bp, Homo sapiens
  misc_feature (223)..(223): n is a, c, g, or t
  misc_feature (263)..(263): n is a, c, g, or t
  misc_feature (554)..(554): n is a, c, g, or t
  misc_feature (557)..(557): n is a, c, g, or t
  misc_feature (561)..(561): n is a, c, g, or t
  misc_feature (584)..(584): n is a, c, g, or t
  misc_feature (588)..(588): n is a, c, g, or t
  misc_feature (596)..(596): n is a, c, g, or t
gggggtggcttccgtcctcaggagttcggaactatataaagttcagaaagacagtgtctctgaagatgaagtgacatccgaggaccactatatttatttccagaatggtcgcattatacctaagttgaatattgcgcatggaaatgcttattggacatgctaggcagcgtgtatagggagttttagcaaatgatggtgtgtgggcttgcggggcaggagcagnacgtccaacatcgcacgaagtcttctggtgatggaagtcntgtacttgttctggaaaaaaaatttataagactcgaagtggagggacagtgtgtttgccagttgtggacaggcatgaactgtctggagtgctgaatgttctggacgtaaatggaactacaggggctcagtgctcagaaggtattctatgacagtatcaggagccgataccttgtgagcagtcgggttacagcgctcgtgtgatatcaaacaatgcttatacacacattgtggatggagaacgtccctttggtgtttcattgctgtacattggctgggataagcactatggnttncagntctatcagagtgaccctagtggnaatnacgggggnatggaaggccacatgcattggtcaatcatagcgctgcagctgtgtcaatgttgtacatagactatataagaaggagaatatgaccttgtaagtcagcaccttgctttagctatcaatagtactaaataagtactcatggtatgttagtaaactctctgctgtattaaagtggaaattgcatactacttacatagagtagaatggaaagacagtaattagagttctcaaactaataaggatagtggagcagttgtatcttaaaaacatgaggaagatagtaagcctaaaagtctgagcgtgtagaagaaagtaaaagaacagaaagaaaaggataaatagaatcagagattttattactcatttggggcaccatttcagtgtaaaagcagtctactcttccacactaggaaggctttactttttttaactggtgcagtgggaaaataggacattacatactgaattgggtccttgtcatttcgtccaattgaatactttagtgtaacgatgattagcgtaccggtatggacgtctat

SEQ ID NO: 727895 - DNA, 544 bp, Homo sapiens
  misc_feature (174)..(174): n is a, c, g, or t
  misc_feature (191)..(191): n is a, c, g, or t
  misc_feature (247)..(247): n is a, c, g, or t
  misc_feature (256)..(256): n is a, c, g, or t
  misc_feature (323)..(323): n is a, c, g, or t
  misc_feature (400)..(400): n is a, c, g, or t
  misc_feature (427)..(427): n is a, c, g, or t
  misc_feature (429)..(429): n is a, c, g, or t
  misc_feature (462)..(462): n is a, c, g, or t
  misc_feature (514)..(514): n is a, c, g, or t
tacggctgcgagaagacaggtgatttctgcatttccgactgaggttttagctaaagaagatactgaggcagctattcaatcaatattatacaaagaaaattctgtaattaagggaaatgctttatagaacattatgatccaaaagagtatgatcccttttatatgagcaagaangaccccaattttctganggctatattcaataaaggattcaaagaagttgagaggtttcagctgcattccagantcccacaanttctattcaggcacttataactccaaacgagtggctgaaactgcctacaagatacatagaaagtgantttgtagaggagaagaaacaagggtctccttctagaaagagaaccgctgtgctatcaggagggaaataatccagtgncaaagaggccatctctgaagggtattntnttcctggagctcagccaggaacgggaggaagancaggatgggtctccctcccgcgttgggatgctgaagctggggctataaggangaggagtttcaccccaggggcacacacctg

SEQ ID NO: 727896 - DNA, 157 bp, Homo sapiens
tcgcctgtgtcggcttgagtgcatgggcgatcttgatcactgcacttcgcctcctggtccgtgatctcctgcctcaacctcctgagtagctgggatcgcaggtgccaccaccacgctccagctagtttttttttttttttttttttttttttttttt

SEQ ID NO: 727897 - DNA, 945 bp, Homo sapiens
taccggctcggccaagtgcgcacgtaatcgcgctcgtgcccgcgcgggtgcgttgccagtcctggcctgcgcccctgtcctgccgctcccgctcctcgcctggctgatgtatgttgttggcctgatggggagctacgtagccgaggtttgcgctgccgccgccaggcccggtccggttccatgcctctgcccggacgctagccggcctggccatggctgaccgcgggtgcccgctggaggcggcgcctgttgcctgcctgatggtgcgggagagcctgctgagctgtagcttggagctgtcggaaggtgacatcactcaaaaaggatatcaaacagaaaagggcaaagctgcttgcacgttatataccgcgttattcaaaggaatagacccgtctctgcaagcagacgaatagaattccttggccctcacaaaccactggcgctgcaacccaatgcagcagaagtctctggcccaccggctccgagggatgagcgcttccggtcagattgtccacacttgaagcctgtgcgaagcagcctttgtgccaagtacaaaggagaggaagatgcctatgcccttccaaggagacggttcttgtccttgtgcattacgtctgtggaaacctacacccctccagaacacgtcgtctgcctcagaagatgagggctcattacggcgaacccgggcgactcacctccacgtccggtaccagagccagttccagcgtcgagccctgggtcgaccgggtcattcagagggtcgagtagcacacttcagttccctcttagatatcgtacagcctcaatatcacccccggtgaaagaaaaaaccaaacagcatgttcccagatagatgaagccaaccaccggagccagccgacaccactcgactcaggagccacagagaaggcccaccagaatgatctgagatatagacacaccgaa

SEQ ID NO: 727898 - DNA, 553 bp, Homo sapiens
  misc_feature (219)..(219): n is a, c, g, or t
agcgggggtgacctaggtcgcatggacctgcgaggaacgtagagcgtcagggcagcgcgtcctcctgatcgcactcctttgcctcgttggccggacgatgtgcgagatccggcgtggtggctaccggcatgtagtactactaaggacccctgcgcccgctacgcccggttgcaagcccaagtcccattcgtctacagtgatgaaagcgttcgacctcantcgtggacccgacccgttgaccctcgttgagagaaatttactagagcggcagccacgcaaaagaacaggtattactactaccaccggcaggtaccgccgcgttgccagacatcactgagtgcaagggaggaggaccatcatgttgcatgtatgaagccgaaatgcagtggaagagggactacaaatgtcgaccaagaacattatcaacattatgcaggatcggctcaaagcctgtcagcagagggaaggacagaactaccagcagaactgtatcaaggaagtggagcagttcacccaggtggccaaggcctaccaaggaccgctatcaggacct

SEQ ID NO: 727899 - DNA, 356 bp, Homo sapiens
ataggatcccaatgcagcggactcgagcacatacatcgagaagtgcgtgcacgccgcagccccatcccctgattcggaaatgtggacatcttgtcatttgaggagtccaaccgcgccatgcagactggtgtctccgggatcatgattgcccgtgtcgccctgttcaagccgtggctcttcacggtagatcaaggagcagcggcactgggacatctcgtcgtccgtgcgcctggacatcctgcgggacttcaccaactacggtctgcagcactggggctcgtgacacgcagggcgtggagaagacccggtgctttctgctccactggctttccttcctgtgccgattccgctgcatt

SEQ ID NO: 727900 - DNA, 237 bp, Homo sapiens
gggagtagtgtaggagagactctgactctgttgagacagcctgtcaggataccgtccatgtctcctgaatcatgttcatagttgttgcctgctagagataagtcatccgaaagttgtcctttgaacaactcaaaaccccttcctatgaaacattttcttaaaaaagtccttcagtacaccacaaggaaaagatatacacattcgtcaggtatggtggctcacgctctaatgctagca

SEQ ID NO: 727901 - DNA, 388 bp, Homo sapiens
taagacttatttcatgatccagattattgactttttttgctaatgttttgtgtacacttgaaaagaatgtgtattccagacagtgtggtggcacactgcttgtaatcccaacactttagaaggctgagtgtgggaggatccctggaggccagaagtttgagaccagcctgagcaacagccagacctcatgtctgccaaaaatataaaaatcagccgggcactgtttggtgggcacctgcagttgcaactactcaggaggctgaaacaagaggattgcctgagcacaagaggtcaaggctacagtgagccatgatcatgctactgtactccagcctgggtgacagagaaagaccctatctcaaaaagaagcgtatacagcagcagaaag

SEQ ID NO: 727902 - DNA, 261 bp, Homo sapiens
tgcgggaatgaaagactcggtacctttctgtctgggtcagtctgttctcccagggctcatgtctcagattgagaactctgtgctgtgtaagtattttgcatacacaggatggtctatgtatcggtccattttgatgctgccaataaagatatacctgagactgggaagaaaaggagctttaacttgacttatagttccacatagatggggaggatcatggtggagtgtgaaaggcacttcttacatggcagcagcaagaga

SEQ ID NO: 727903 - DNA, 4452 bp, Homo sapiens
tcttctcgctggcggaggtgcgcgtaggctaccagtcacagaacatctcctgcttcttccgcctggtggatcgcgactctgtgtggggctacgacctggggttgcgctcactcatccccgcggtgctcaccgtcagcatgctgggctacccattcatcctacccgatatggtgggcggcaacgccgtgccccagcggacagccggcggcgatgtgcccgagcgcgagctctacattcgctggctggaagtggccgcctttatgccggccatgcagttctctatcccgccctggcgctacgacgcggaagtggtggccatcgcgcagaagttcgccgccctgcgggcctcgcttgtggcaccgctgttgcttgagctggcgggcgaggtcaccgacacgggtgaccctatcgtgcgccccctttggtggattgcgcccggcgacgagacagctcaccgtatcgactcgcagttccttattggggacacgctgcttgtggccccggtgctggagccaggcaagcaggagcgcgacgtctatttgcccgccggcaagtggcgcagctacaagggtgagcttttcgacaagacgccggtgctgctcaccgattacccggtcgacctggatgagatcgcctactttacctgggcgtcctgacccagcccagggcccggtaaccgcaaagcccccagtcttcatgcagaccttgaaccctccgtcacacccgcaccatgtactcccaggaacctccacctctataccacccattaagtggctgctgacttaaatgtgctggaaccagctgctgaaggtggggcctagggagggggcactgaagcaatctcctgctccaacgcacaatccttactgtgccctttccacccccacactcacaccaatctgcagaaacctcttccctggggtggaagccagagagcttagaggaaaaaggtcagctctcttcctgttatacatggttatacatggttggggtttaaaagcacaaagagaaacctccccctcctggctttcgtggccatctttgtccatcttaggtggggacttgatcttatttaaggtctccaaatagcccccaccacacttagaacgtgtgttttcttagtgttagaagccaggccctgagtccccagcactcacctgaactgtggctgatttggtcccagtccagctggggaggtgtttggctgacaaggaggcaagagatcccctcccagggaacaggaggactgggcttagcacagagccatcatcatgttcccaatttgtgaagagactcctaacactgcactaacccatttgtgtacatacatgggctcagccttgggccaaatgtgcctgatgggaacagacttgcagggccatgcaggccagacttcgtgccttaactgaagagtgtgcgtgtgtgtgtgtgtgagagagagagagagagaaacacgcatcatgggtccctgatctatgaaatgaacacaacctctctgaggctggatgatctggaggaagggggcatggagcaaatttgaggctctgattgctgagccagcctcctcccaggcggtttccccaggactctcgtaggaaataaatagccctttcaagattcctcagctgcctcaccccctgcacatgtgcctggggtgtggcctagaagggagtgatgttcttactctggtggtctgtgcttctgaacacaggctacatgcacacactgacaactaccaataaacagacaggggaaggtctttcatctcagccattttctcttccccccgcccccccttagatggagtcttgctctgtcacccaggttggagtgcagtggcacaatcagctcactgcaacccctcctcctaggttcaagcgattgagtagctgagattacaggcatgcatcactatgcctggctttttgtattttttagtagagatggggtttaccatgttggccaggctagtctcaaactcctgacctagtgatgcacccaccttggcctcccaaagtgttgggattacaggcatgagccaccacgccagccattttctctttctaagaagagcaacctcagccggagtgagttttttctgactttgcagctgagtctggagaaaagtggcatgccagagcgggtcggtgggaaacagggtgaactttagcttccatcaacagctctggtagcaaaaccagtcccctaccccctagagaatgcatccgtttccccacctgatatggtttggctgtgtccccacctaaaactcatcttgaattgtagctcccataattgccatgtgttgtgggaaggacccagtgggagataattgaaatatgggggcagtttccgccatactgttctggtgatagtgaatagatctcatgagagctgatgattttataagaggtttccccttttgcttagttctcattctctcttgcctgccgccatgtaagacgtgcctttctgtcatgcttgtgaggcctccccagccacgtggagctgtgagttcattaaacctctttttctttataaattacccagtcttggttatgtctttatcagcactgtgaaaatgaacctatacagtaaattggtaccagtagagtggggcgctgctgtaaatacccaaaaatgtggaagcaactttggaactgggtaacaggcagaggttggaacagtttggagggatcagaagacaggaaaatgtgggaaagtttgggacttcctagagacttgttaaatggctttgaccaaaatgctgataatgattgggacatgaaatccaggctgagttggtctcagatagcgatgaggaacttgtttggtactggagtaaaggtgactcttgctatattttagcaaagagactggctgcattttgcccctgccctagagatttgtggaactttgaactcgagggagatgatttagggtatctggcagaagaaatttctaagcagcaaagcattcatgaggtgacttgggtgctgttaaaagcattcagttttaaaagggaaacagactataaaagtttggaaaatttgcagcctgatgatgagatagaaaagaaaaacccattttctgaggataaattcaagccccctgcagaaatttgcataagtaacaaggagccaaatgttaatcactaagacatggggaaaatgtctgcagggcatgtcagagacctttgcagcagtgcctcccatcacaggcctggaggcctaggagggaaaaaatggttttgtgggccaggcccaaggtccccttgctgtgtgcagcccagggacttggtaccatgcatcccagctgctctagtcatggctaaaaggggccaagatacagctcaggccttggcttcagagggtgcaagccccaagtcttggcatcttccacgtagtgttgagcctgcaggtgcacagaagtcaagaactgaggtttgggaacctctgcctagatttcagagaatgtatggaaatgcatgtatgtccaggcagaagtttgctacaggagtgaggccctcatggagaacctctgttaaggcaatgtggaaggggaagcccccacacagagaccccactgggacactgcctagtagagctgtcagaagaaggccaccgtcctccagacatcagaatggtatatccactgacagcttgcaccatgcacctggaaaagccacagacactcaacgccagcctgtaaaagcaaccgagaagtaggctgtaccctgcaatgccataggggtggagctgcccaagaccatgggaacccacctcctgcatcagtgtgacctggatgtgagacatggagtcaaaggagaccattttggagctttaagatttaactgccctgctggatttcagacttgcatggggcctttagccacttcgttttggccaacttctcccacttgaaatgggtgtattcagccaatgcctgtacctccgttgtatctaggaagtaactaactagcctttgattttacaggctcataggtggaagggacttgccttgtttcagatgagactttggagtatggacttttgagttaatgctgaaatgagttaagactttgggggactgttgggaaggcatgattgatttttaaatgagaggacatgagatttgggaggggccagggagagaatgatatggtttggctgtgtccccatccaaatatcaccttaaattgtagctcccataattgtgggagggacctggtgggagataattgaatcataggggcagtttctcccatactgttctggtggtagtgaataagtctcacgagatctgatggtttaataaggggtttccccttttgcttggctctcattctctcttgtctgctgccatgtaagatgtgccttttgccttccaccatgattgtgaggcctcccagccacatggaactgtgagttcattaaacctctttttcttcat

SEQ ID NO: 727904 - DNA, 1235 bp, Homo sapiens
  misc_feature (215)..(215): n is a, c, g, or t
  misc_feature (308)..(309): n is a, c, g, or t
  misc_feature (328)..(328): n is a, c, g, or t
  misc_feature (341)..(341): n is a, c, g, or t
  misc_feature (346)..(346): n is a, c, g, or t
  misc_feature (358)..(358): n is a, c, g, or t
  misc_feature (369)..(369): n is a, c, g, or t
  misc_feature (485)..(485): n is a, c, g, or t
  misc_feature (493)..(493): n is a, c, g, or t
  misc_feature (575)..(575): n is a, c, g, or t
  misc_feature (625)..(625): n is a, c, g, or t
  misc_feature (680)..(680): n is a, c, g, or t
  misc_feature (719)..(721): n is a, c, g, or t
  misc_feature (727)..(727): n is a, c, g, or t
  misc_feature (731)..(731): n is a, c, g, or t
  misc_feature (736)..(736): n is a, c, g, or t
  misc_feature (738)..(738): n is a, c, g, or t
  misc_feature (740)..(740): n is a, c, g, or t
  misc_feature (744)..(744): n is a, c, g, or t
  misc_feature (747)..(747): n is a, c, g, or t
ggacggcgtgggtcgacccacgcgtcggttgtagttcttcaaaagcatgtgcagtagccagccatactatgtgtattcccagtatcatgtacgcactaaaaaaaatgtgtgcttgctgctgctgtgagtgaaccatgcttaagataaaaaacttaactagatctgtaaatgtacagaatagcatcagatgtttctgagagattagaaaatgtttngaatttataaaattaatgtttttctttgtaacatttatatatattttttaacattttaagtttaacagattgtattcctttcaagttctatanntgcttaagcaatctgattngagtaagggtctngattngtgctatatgtnctgttagtttngcatgaatatactaaagctttttttttttttctctagcatgtgtttctctcctcttgggttcctcttggtatttactactttctcttttcctggggtgtttttttctcccggtttnggtttggntgggggtttggtgccctggtctccatgggttccgggtatttctttacccctcgggtattccccaggggctgggatcgagatnggtccagtttatgcccagttccttcctcctcctcctcctcctcgggtaanagcactctggcgatgctgacactggccaacctccagtatcctcaccctcgcagangatatctctctgggcctcttaaatcccttacctgggaannngagggntttnaaacncngntttnacnttgaagggccttattcaagtgctgtgtaaatgcttccatttcgggctgcttttggttttccatttttctttcagaaagaatttttctaacttagggtctgtctggcttgtattacacccagaatacagtgttgggaacctaaatctgttggtgcgtctgcatcaaaggaacattggcttcacggggtgataaccttggatgaactgagattatgtccaagtaacgttaccgggtgaagtttacccacagtagctgacttcaaaggtgcctgttctgtaattttattttaaacccgtgttaccatagttcttaagttgtatatgctttatcagattgcctatgttgaaagcttactattatgaagttaattctgccttatgaagaccttaagaagggttccatttcacagggctaatggttggtactggctaggtatgttaaataatcattgctgggttataaagcagggaaactctaaaaaaaaaaag

SEQ ID NO: 727905 - DNA, 275 bp, Homo sapiens
tcctagaggatcccccccggtatccccacccggctaatttatgtattttagtagagattggggctttaccatgttggcaggctgtctcgaactcctgacctcacaagatccacccaccgtggctcccaaagtgctgggattacaggcgtgaggcaacacgcctggctcaaattcctgaaaatttaataagccagcattagtgagccaatacacaccagcccccagcacactgctgtgtataataattcccatgtatgggtggggatacccagggg

SEQ ID NO: 727906 - DNA, 186 bp, Homo sapiens
  misc_feature (53)..(53): n is a, c, g, or t
cagggtatagggtgggaccccttctcactggaaggtatttagacccacaatcnagaaaggagggggaacattagagtcctgccttggaacaggtaaaaagagggcaggaggtcagaggcctgcccctgaggcccaacgcacccaacattataacaaaagactgtaacaggggcttttggggttatg

SEQ ID NO: 727907 - DNA, 287 bp, Homo sapiens
ctgtcgcgtaactgtctgaaagttactgctaaggctggaagggtgtttagctgtcgcagcaacattcttaagcaggctatgtcagagccgacaatccagaattatctgtactctttaaatcgtgcttcagccactttggttggccttgggtgtgtgtgctcttgttgtgaattgggggtgaaaggggggcgggggatccacaaaagggcggcggagactttcatagctgggggcgaggacgcgcgagctacacaaggcgaataggatgtaactgggtcagtcttaca

SEQ ID NO: 727908 - DNA, 954 bp, Homo sapiens
  misc_feature (204)..(204): n is a, c, g, or t
gactagttctagatcgcgatctatagatattgtactagcatttaccatctcactctcataggaagtacgtgaagtatatcgcacacagctcatatccgcccgtactatgcctagcaaggaatagatacgtatcgcgtgttcattatagctactctcataaacctcaagactccagtcccatcttagaccaatgatgtgcctatngccatactagatctttgccgcgcgtgcgaagcaggcggtgggcctagtccctactagtcgtcaattctgcgcaaaacaatatggcgctagactacgtacataacctaaaactactccaatgctaaaactaatcgtgcccaacaatgtatatcagcgtaccactgagcatgacttgccagaaaacacataattggaatcagcgaaacgaaccacagcctaataataagcatcgatcccgtctagctattttatcaagcatagatcgaacaacaacctatttagctgttcccgcgaatccatgttcctccgaccgcctaaataaaccgcaacgctcctaatactaagtacctgattccttatccttgtcataatcgtgggcaccgccataggcctacttatccgagtgaaccaactgatcacgaaagaaactcgtagctactgctatactaagtactccctacaaatgctccgttaaagcatcacatacacagccaagaagtaatcgtattcacatgcttactccgaagaacacatttatctcaatcgtgggtaatcatgaccgatgagggacacagtcagaactgctgaagcagggcatatgactgcctattctagaccctaactaggtacctagccctaatacaatcgagtaattgtacactgcacaaacgtagggtcacaaaaattctaatatccaatggcatgggcaaagaatatcaagtccggagcaaaacttaaatgatagctaaa

SEQ ID NO: 727909 - DNA, 211 bp, Homo sapiens
ggattgtccccgtggaaatgggcttcgaggctacgccaccatgcctagagtatatctgtatatatagtagagacagggtttcaccatgataggactaggctggtctcgaactcctgacctcatgtgatccaccgtgcttcagccttctctgaagtgctgtggattacatggcgtgaggttcacctgcgcccatgcctgaattttctatatt

SEQ ID NO: 727910 - DNA, 140 bp, Homo sapiens
cctgttacccggtaaatggtaaagtacaatgattcctgagatcctctccaaagaaccagtgtatcagtatgttcagctcccctgtgctttgtccttcattttaaagtttaaattcctagttctttatttctccttgcccc

SEQ ID NO: 727911 - DNA, 321 bp, Homo sapiens
gcttcataaattataaagtaatatgaatagctctctctcacaggacagtcctagccctgtgtttcttgggcttctcaaagatttttttttatctataaatcacagtgaagattcatgattaggcaagagctcttcctgtcaacatggatggctctcctaacacaatgtgtgaacaaactgttggaatgttttgtttaagctgagtatttggtacctgcatattcattatatcacttatactttcttttttgaggcataaaaacatgcagaaaagtacactcatcttaagtgtacagcctaatggacttttacatatgttta

SEQ ID NO: 727912 - DNA, 419 bp, Homo sapiens
  misc_feature (24)..(24): n is a, c, g, or t
tttttcctgatttcccctggggtnccctttggtccaaagcagggtcccattcagtcacttgaggggccttatgattttattcctgggtttacacaatccttaagtcaaaatagaaaataaggaaaaaagcccagacgcggtggcctcactccctataatcctcagcatttcgggaggcccgaggtgggtggatcacctgaggtcagaagtttcccagccagccctggccaacataatgaaaccccatctctactaataatacaaaaattagctgggtgtggtggcaggtgcctgtagtcccagctactaagctgctcgggagactgaggcaggagaatcacttgagcccaggaggcagaggttgcaatgagccgagatggcgccattgcactccagtctgggtgataagagcacaactc

SEQ ID NO: 727913 - DNA, 299 bp, Homo sapiens
taaagaactctatacatacagtgtatatataccaaatgcaccctgaagcatgacagagtttgtcaccagcttgtggaattctagttcaccaagtgctggatctaatctgctgtgcccctaaaatagcatttcagaagtttaggatatgaaaaacagaagagagaaaaatattcattattaaaagccgaacctacattgtaccagttattggatactaaatgaccgacttgtttatccccttttgaatcagcagaaaccatggattatattctttttttcccttcagtagtgagcagatg

SEQ ID NO: 727914 - DNA, 385 bp, Homo sapiens
  misc_feature (12)..(12): n is a, c, g, or t
  misc_feature (42)..(42): n is a, c, g, or t
  misc_feature (325)..(325): n is a, c, g, or t
  misc_feature (358)..(358): n is a, c, g, or t
gcccacaaaaanggatgagttccatggtcctttgccgggacncggatgaagcctggaaacccatcattcctcagcaaactatcacaaggatagaaaaccaaacacccacatgttctcactcataagtggaagctgaacaatgagaacacatggacacagggagggaaacatcacaaaccagggccttttagggggtgaggggtacaggagggatagcattgggagaaacacctaatgtagatgacggattgatgggtgcagcaaactacaatggcacgtgtgtacctgtgtaataaacctatgcattctgcacatgtatcccagnaaagtataattttttaaaaaagattaaaaaggnatatataatagagttcatttcctatct

SEQ ID NO: 727915 - DNA, 776 bp, Homo sapiens
  misc_feature (61)..(62): n is a, c, g, or t
  misc_feature (65)..(67): n is a, c, g, or t
  misc_feature (70)..(70): n is a, c, g, or t
  misc_feature (94)..(94): n is a, c, g, or t
ggctgaaggctgtggcgcgcggctgtccccattcccacgtgaagcgctacgctagcatcgnncgnnngtngctcccagctcgccgcggagcagncccggcagcagcgggggaccggaattggtctcgcgtaaggctcagagagctagtcccggagcccggtgtgtggcgcctcggagcacggttgactggctgccatgtccctaattctgtctccatctctatactgagattgcctgggagcacccatgtgtatcccctgtctctaatcatgtttattgagcggccggctcatacgacggaaagtcacattgcgagagtaatggtacctgaccccatacaacacacgcagtctctctccgaggagtcaagctcactacgatcatcaagagttgctcaccccgaaatccgggcccaaggcgctccctccgaggccaccagcatcccgggccattctgaaagctttgcaggatgagtgggatgcagtcatgctgcacagttcactctgcgccagcagctgcagacaacccgccaagagctgtcacacgctctgtaccagcacgatgccgggctgccgtgtcattgcccgtctcaccaaggaagtcactgctgcccgagaagctctggctaccctgaaaccacaggctggctcattgtgccccaggctgtgtcaagttccaaccaagtgttgtgggtgcgggtgagccaactggatttgggtgagctgttgggaatgacacaggagaattttcggagctcaagaaaggcatgtgaacag

SEQ ID NO: 727916 - DNA, 677 bp, Homo sapiens
  misc_feature (345)..(345): n is a, c, g, or t
taagggggctcttttttaaaggaaactaaatcactgtttacaaaaccctggaaaagcccttttgcccatccctttaaaagttcccttggttaaacctttcctgtttaacaggaactggaaaaaaagggggggggaacacccccccccccttcctttgaaccacaggaagggaaaggccctgggctccaaccctgggccttaaaagggggacagttttttcttccaaatcctttcccatggggcctggatttgcatggatgaggggggcccatgcccccatggtttttaggccccccttcaaaccagagggaaagggtgggaatgcccccccccaggggcccgttnttggttattctgaaagctttgcaggatgagtgggatgcagtcatgctgcacagttcactctgcgccagcagctgcagacaacccgccaagagctgtcacacgctctgtaccagcacgatgccgggctgccgtgtcattgcccgtctcaccaaggaagtcactgctgcccgagaagctctggctaccctgaaaccacaggctggctcattgtgccccaggctgtgtcaagttccaaccaagtgttgtgggtgcgggtgagccaactggatttgggtgagctgttgggaatgacacaggagaattttcggagctcaagaaaggcatgtgaacag

SEQ ID NO: 727917 - DNA, 376 bp, Homo sapiens
agaaaaggaaatggttgaaaaacaaaaacaacaaggaaatagctgcagctgcagctactggaggttctgttctttaattttgcttccctttttggcattaaggacaaaaggtaacaccctaatttggccattggcagttttaaattggcagcccttcaaggtaaaagttttgaaagacaaaggatatatctttcccggggttcctataccccaccctctttaaacccaataaaatttgctaaacaagaaaaaaagggaaaattcttggggcaggaaaagaaagggggaacaaccccaattctgctgaaatggggaaaattttgttttggggaaacaggcccaaattaaaattggggggaatttgggggttattagg

SEQ ID NO: 727918 - DNA, 501 bp, Homo sapiens
  misc_feature (287)..(287): n is a, c, g, or t
  misc_feature (414)..(414): n is a, c, g, or t
  misc_feature (484)..(484): n is a, c, g, or t
aacaggctgatgctgtgatgtggttgagatgattacgtgcataccatctttaattgccattccattttgacttttctttttgatggtcacaagtgctgaaaaccctaatgtgctcaaaagcaagcttccacaacttttgttctgttagttgtatgcagcctgtgctacaaacaccagaattctctaagactgagagctgagtggttcatgtgtgtcctgtatctttgaaagtcaataaggtcatctttgcagaagtctgcatcattcatacaggattgcaccatccnggatgtaaggctcacggatgcagaagaaggtgaattacagtaatacgtggagctcactctcctcctctgcagcaggaccagaagtgctggctagcatcacagacactctactggcatacagagcacnaacacctcgtccagcatgttttgcttggcttagacatgttatcatttaaaaaacactttcagaagaggtncataaatcttttttttt

SEQ ID NO: 727919 - DNA, 177 bp, Homo sapiens
acctgtctggttcccaaatatttccatcagcctaaaataaaacccattggttgagcacgggggctcacacctgtaatcccaatactttgggaggccgaggcaggaggatcacttaagcctgggggttcgaaaccagcctgggcaatacagggggacctcatttttacaaaaaattta

SEQ ID NO: 727920 - DNA, 225 bp, Homo sapiens
  misc_feature (2)..(2): n is a, c, g, or t
tnggcgtgctgcggtgcatctcgcggctcccccgccctttttttacacttggtcccttcggccaactttatgttgttttgttctgttttgtttgagctggcgtctcgctctgttgcccaggctggcgtgcggtggcgcgatctcagctcaccccaacctccgcctcctgggttcaagcgcttctcctgccccagcctcccgcagtagctggggggtcccgcagct

SEQ ID NO: 727921 - DNA, 968 bp, Homo sapiens
gatgacgtatgtcaagcaataatgacctcagatagagttccagtatgtgccataagtcaaaaagaggtataaccggaacatacgtctgcgcctagtaaactgaaaatagacagagctctgcaggagacagacccaaacttgcatccggtatgatgaacaggtaatatccacagaatctgtgcgtatgcatggaatctctggaaaagagaaaatagagagcgagttaacgagacaaaacattgttgaatcgattgtaacagagagtattgaggctcatcccgtgtgtccaagtggatcacccggcttggtattgataggacgcctacctcgaaattaagctcgtgtgcctgtagatgcttgaaagaatcctgcatatgttacgccatagaatgccctacatggctgaaggaaggggctgcattgcaaatgactgtactgattcctgagagaattgctgtgaaacgtagctgaatggctatacactgtcgtcttaagcagagagtgtgtggacagaattttacctgtatgactgtctcatactaatctttgggcctccaaattcccaaagtaggcaatacaagtttagcttataagccctggacataggcatgcttggggtacatcaggaagactcatttcaaatgcaacttaaagacagattgtgtatcagcccatagggggggtacggagaattcatccggaagaagggataggccgaatcgtacgtttgtcccttcgatttgttgggccaacttggtaccttttgggaaatttccatcaactggggctctttatagtgacggccctcggaagctttttaccattatgaatagggcactccggagtgtacaaggccaaaaaattggtagatcctagaaacgtacgctaatctctcaaggacaaaacttttaacttcattaccgggacattaggaaggcctttcagagtttcattaatggatctgagcc

SEQ ID NO: 727922 - DNA, 798 bp, Homo sapiens
  misc_feature (127)..(127): n is a, c, g, or t
  misc_feature (172)..(172): n is a, c, g, or t
  misc_feature (176)..(176): n is a, c, g, or t
  misc_feature (181)..(181): n is a, c, g, or t
  misc_feature (189)..(189): n is a, c, g, or t
  misc_feature (191)..(191): n is a, c, g, or t
  misc_feature (274)..(274): n is a, c, g, or t
  misc_feature (290)..(290): n is a, c, g, or t
  misc_feature (298)..(298): n is a, c, g, or t
  misc_feature (301)..(301): n is a, c, g, or t
  misc_feature (303)..(303): n is a, c, g, or t
  misc_feature (319)..(319): n is a, c, g, or t
  misc_feature (366)..(366): n is a, c, g, or t
  misc_feature (373)..(373): n is a, c, g, or t
  misc_feature (417)..(417): n is a, c, g, or t
  misc_feature (428)..(428): n is a, c, g, or t
  misc_feature (459)..(459): n is a, c, g, or t
  misc_feature (463)..(463): n is a, c, g, or t
  misc_feature (488)..(488): n is a, c, g, or t
  misc_feature (494)..(494): n is a, c, g, or t
gatttcttgtagatgtatccttcacgttgtaaatatgtttgtagagtgaagccatgggaagccatgtgtaacagagcttagacatccaaaactaatcaatgctgaggtggctaaatacctagccttntacatgtaaacctgtctgcaaaattagcttttttaaaaaaaaaanaaanaaatngggggggntnaatttatcattcagaaatctggcattttcaaaaattcagtggcaagcgccaggcgattggggtctaaggatacgattttgganccatatgggccgtgtncacaaatntgnanacacctgtttccacanttgcacctgatcaagagcagtgcttctccattggtttggcagagaantgttttncattccccgtgtgttcccatttccttctgaaattctggatttantccattttttnaggcccctctttatctcctttcttaaggccntgtngctatggccttttctataacctttncatccngtgtacagtagtttaaaattgccgtgattgagcataacctaaattgtgcggtgataacatctttggaaatctcccatatgggcccccccggtaaagacaggggcctttaaaaaacgtaccgtgctggggaacacggcactggtggtggctccaaaagtgacccaatcggatgggcgccaacaatattacaggggcatatgggccccaattcgaaaccgttggtctggtcgggaaaggagaaaaacgaggggaaccacgagctagttcacactgtgcaacatcaggaatactgaggcaaataaac

SEQ ID NO: 727923 - DNA, 186 bp, Homo sapiens
ggatgtggtgtggagcgacggcatcccctcacattacataggaccagggcatcgacttcagtaacgaaatcctatcataacagaacagtacaaaaaaatagtaggggtgggttttttttttttttttttttttttttttttttttttttttttttttttttttttttttttttttttttttttttc

SEQ ID NO: 727924 - DNA, 119 bp, Homo sapiens
ccgcctactactactactgctcgaattcaagcttctaacgatgtacggggacatgactctagttaagcgatgcctttctgtagaacttactctttgtattgaacttgaggtttaaaaaa

SEQ ID NO: 727925 - DNA, 135 bp, Homo sapiens
tggtgctctcgccggtcccctcccatcaggacacattggcagttttgctaccctgcctccaggtcttcctgcgttttccttacgggccttattcttggtgtttccctactgttttgttagactgtgggacgaaga

SEQ ID NO: 727926 - DNA, 314 bp, Homo sapiens
  misc_feature (1)..(1): n is a, c, g, or t
  misc_feature (176)..(176): n is a, c, g, or t
ngctgtggagggtgaaggaaaggtcactttgaaagtgtctgcagctgcattcatttttttttagagccactttaaatcagtatgttactaaaccagaattctgagcctgattggttttaaaaattcaaatctcgtatcacctttattgcttatctacaaaaaactgggcatcaggnaaaatgaggatctagccctaggtctgctgctcactagatctgaaggccctgggttaaagcttcccttcttcagcagggccccatgtattcatctaaaatttgaactgggatgggattattcccatctggtatgattct

SEQ ID NO: 727927 - DNA, 101 bp, Homo sapiens
  misc_feature (44)..(44): n is a, c, g, or t
  misc_feature (70)..(70): n is a, c, g, or t
gatccagtggggtccggacactgggccccgcagcgaaagcacgntccagccaccaggaggccacctattntttcaaaataaagactgcgttcctctcttgg

SEQ ID NO: 727928 - DNA, 1774 bp, Homo sapiens
taattttggcataacaagtttatttttttaaacaggcaaacaaaaaaaacaaaacaaaaaaacaacaaaaaaaaaaaaaaaaaacaaaaaaaaaaaaacaaaacaaaaaaaaaacaaaaaaaaaacaaagacgaggcggcccccccaacaccacccacctattatagtaggagcgccaccaatacagatataacgcagacacacaaatctgatagtggtgaataaagaaggcgcgcctgcacacatactacagggcgctcatatattaaaaaaaaaagaagcagagagggataggatttacataaacatcatagatcaagagcgagaacactaaatcccagcgcaccgaactgagaacggacgaaacggatagagcaacgagagaagacgacaacccaccaccacacgaggcggaagagaaaaagaaacaacacgaaacaagagagggaaagagaacaaacaaaccaaaaaaccacacaaaatcctcgaacccacacaccaaacaccacccttccacacgagagaaacgcactatcataaaaaagacaactaagatagactgagcgagctgacgtgatctagagatgaggctagtgacttctacactactacgagatggctgcggactaacgctcgtgacgcgtcagcgcgaccgctaaagaaagacaacaaacatagatgtgacgccgcagtcccacgaacggactagaaccagatcaacatatcgacgatacactaaaaaacagatcattgatgcttaatcacaaacgaggagcgaggaacgataagagcagcgaagagaagaagtaaaacacgagtcgacatagacaacatgagcagagccacaaacgagcgcacgaactaggactggaatgcaggcagccactacaacccgaagccgagcactcgagcagagaaccgacgatgcagagtacgcaatcgaagacactcatgatgcacagcacaggaatccgaccgcgtctacgcgacgtctgccagagtgtaggcgcacgcgaagtgaacagacgcgccgtcctcgatcaactataccgcaccaccaaaacgacgtctggaagctactgccgacgcatggatgagataggtagcacggagcagcgacagcttcccgcacgtccattgcacctagaacaccgccaacaccagtacgagacggcggtaagccgaacagatagcagcaacaacgatcgacagtacagcaagagagcggagcagagcgagacagaaaccgacaaaggcggagcagagagactccaaacacaacataacgctacgatcacgtagacaacaacaacgagagggagacgaagcgcgagctacacacaggcctaacgaaagacacgatagatggatagaagaaagcgaaggagtagggaacgagcgacatgaggaaatgaagaaaacggagacgtaagaccggcaggcaggacgaagtgcggaaagataggagaacgggaggcacagacacgtaagaggatgagtacagctggctgggatggagatagtgacgaagaagagccccggaggagtcacaccgacatcatacagagcagcagagtagagaaggacgggacgcatggacgagatcagtgcgaccagcgagagataagatcaaggcagaataggagatcctggacgacgatacgaaactcaggagcagaacgtcgcgtgccgagagcgaagaaaaatagacactgaagaagaaaagaagagaatcccgcagcaaagcataaagcagaaagcgacggagcacgga

SEQ ID NO: 727929 - DNA, 181 bp, Homo sapiens
  misc_feature (68)..(68): n is a, c, g, or t
  misc_feature (123)..(123): n is a, c, g, or t
acagatgaggaatagcattcacgtagacgctgttttttttgtaccacagggcatgaagtgctctcctntgtttcgtcctggggctttttatttaactctggatcacagttactgcatttatcnttcttcagagattgaaggccattttgatagaatttcacgtttgctccttcctagtttc

SEQ ID NO: 727930 - DNA, 230 bp, Homo sapiens
  misc_feature (150)..(150): n is a, c, g, or t
ggtacttagaggatcccggttaggcctcgtcgagttgggcaagtgatgctgtagatacccccagacagtgattcaggacgctggccgataccccccaagagtggctcaggacgctggccgatacccccagaagtggtgcaggacgcttgncgatacccaccaggcgatggtgctggacgctggccgataccccccatacagtggctcatggacgctgtgcgatagccccg

SEQ ID NO: 727931 - DNA, 156 bp, Homo sapiens
tggtgtagtaatcgattacagaacaggctcctctagaggaatatgaagcaccgccaggtccttggagtttaaagctggtggctcgtagtggtctgggcgagcagttttggtggattaaactggtggaggttaacgggctaagcatggggtaccgga

SEQ ID NO: 727932 - DNA, 280 bp, Homo sapiens
  misc_feature (64)..(64): n is a, c, g, or t
aaatgttctgcccttgggtgcagtggttccgcccctgtaatcccagcactgtggcggatcaccntgagccaggagtttgagaccaacctggcaagatggcgagaccccatctctacaaaaaaatttaaaaattacctgggcatggtggcacacacctttattctcagctactcaggtggctgaggtgggaggatcccttgagcccaggtggtcaaggctgtggtgagctatgatcatgccactgcactccagcctgggtagcagaacaagaccctgtctc

SEQ ID NO: 727933 - DNA, 498 bp, Homo sapiens
ctatttcatgggatttcagttaatatttattatgtggcctttaccaactaactgtgcccaattttgaccacagggctatttttaaaaatagactttgcttctctaaataaaatatatatacaattacaggactataagctctgttagttcttcgatggtgaaatatatctacttccaataagccgaaatacatgtcctgaaaacaaagctaagtacctcagcatttacaatttagttaaacttcctttctagggaatccagttcattataaagaagttgtggcacacaaaatctagttctatttaaaatatatgaatcccaggtagtaagggagagaaagaagcaaggtcaatcaatagagaggtgataacagtggaataggcagaaaacctgcagacggtccgtaaatagatggtggctgtagggaagtcttttatttatctcggtatcttcatctttgtacataatccatttaacgtttactgaacaatcaccatg

SEQ ID NO: 727934 - DNA, 930 bp, Homo sapiens
atatacctggaatttctctagaaacaatggaggacggcatggtttaacagtcagccttcaatcttgcaccacacttacttcccccgtccgtgtaacaaatgccacgctgcacgtgaggcaccagtgaggaagatgtgcacgaggccgttcaactggtccgttctgtcgaggaaggagaatcggtgcgctatccgtcaaggagctggtagacgctgcgtggtcctagaagtctccgcctggctgagtgttccacactcacgtggactactggtcctgcgcatgattacacttggccaccgacagacaaagcgtgacccatcttcctagatgcactgtggcgcggaagctgaagcccctggggtgagcatggattcgtgctggtgagtccttgtcagctgaagcgtgctggagtgcgagcgccggggaccgtgcgccttcgaacggcctgctatccgtgcctgggacatgcgctactactagtgaaccagggtggagtgagcacgctctactgcgtggaccacgaacctgcgtcaaggagtacttccccgtgcaggtggtcagctgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggactgtacccgcgggcaaggaaagtacggtgcacgcggctgtttggcctgcagccggctgcctgcggcaggatggagccgccaaaatcgcatcgcggcatggtggcaacttcaccaaagccaagcgagcgcctcgcgtgcagcatgacgaggtgagactacttccatgatttggccacgtgattgcccaagtcctgcccagggattggcatgtcaggggacccgt

SEQ ID NO: 727935 - DNA, 385 bp, Homo sapiens
  misc_feature (134)..(134): n is a, c, g, or t
  misc_feature (211)..(211): n is a, c, g, or t
gatatgctgttcagcaatgtgtggccataattaggtctgtaattatgtatccttgatgatcgcataactgtggtggtggagtggtggatggatttttagagttgcttctgaactgagtctgggttatgctattnggaactgtcattgatggtgagatagagatgatggaagaaaacccaaatataccagaaatgggtagtacacctccatngtctatttatattttattctcatcaagatttccaccaaggtgactcacaccactaatcttatcactttggggggccgagtgggaggattgcttgaggccaagagtttgagacaagcctgggcaacatagcgagattctgtctctacagaagtttttttttttttttctttggga

SEQ ID NO: 727936 - DNA, 941 bp, Homo sapiens
accatctcacttctaggaatactagtatatcgctcacacctcatatcctccctactatgcctagaaggaataagtactatcgctggtcagttatagctactctcataaccctcaacacccactccctcttagccaatatggtgcctatgcgcatactagatctttgccggctgcgaatcagcggtgggcctagcccgtagtagtctcaggtctccagcacatatggccgtagtacatacgtacataacgcctaaacgctactccaagtgctaaaacgtaatcgtcccagacaatgtatatttactacgcactgacatgactttccataaaaaccgacataatttgaatcaacaccgaaacacccagagctaattattagcatcatccccctactatgttttaacccaaatcagacaacaactatttagactggttccccaatctatttgcctccggacccacctgaaaaacccacctgctaaatactgaagctatcctgactgcctaacccctcacaaatcgatagggaagacaggaggcgagcttatccaagtgacagcactatcacgcaaaccacaaactctaccgtgctgtgatactgagatctcgctgacaaatactcgttaacttatgaccattcccagcgcaacagaaacgtaagtcattacttggactatctgccttgggaaaccgtactataatgcccagcctttgcttgtattcatcacgccgatgaaggaaaccagccagaaagcgccgtgaaaacagggcacattcgtccataatctatcaccctatgtaaggttccctttcccatacatcatacgatctaatttaagctcaacaaaaccgttatgttacttaaaatttttaatactcaccttaagtgaccagaaataaaacatctgagccaaataaatagtggtacagagaatttaaga

SEQ ID NO: 727937 - DNA, 151 bp, Homo sapiens
aatcaagacaggagaggacaaccatggccacccaccataaggacttacagcacgtagctcgtaacgaggagacctatgaggttatagtaaccttgttgaccgattatcaaactgagaccaacgctttagacccaggtgacgagccacgacg

SEQ ID NO: 727938 - DNA, 186 bp, Homo sapiens
cacgaggcgaagcgcgcggcgaagcggtacatcgtctcgcgccaggtccagaagctgtcggcgggatcggtctggcgctcggccagtccggccatcgcacgctggaaggcgtgcgagtgcaggttggcgatgccgggcagcgtccagcggccgtcggcggtggtggcgacaaggggggtggagggg

SEQ ID NO: 727939 - DNA, 224 bp, Homo sapiens
tacagttgaatcttcttccttagagtaatgattttcaacattttttttttttggagacagagtctcgttctgtcgcccaggtgggattgcaagggggtgatctcggctcacggcaacctcggccggcggggttcaagcgattctccggtctcagcctcccgagtagcggggactacaggcgtgtgccaccacatccagcaaattgggtattttaagtaaagagg

SEQ ID NO: 727940 - DNA, 515 bp, Homo sapiens
ggctactgctatcgtggattcatcggaatccttcaccatggcatccacgcccggcccagcgtcggcgagtgcaatgatcctctcacctccagccctgtgccgaagctccctggactgtactagatgccctcacctccagccctgttgccgtgaccttccaccatttgatgattgagtcctgaggggctcctaggcacagagtggcccctggatgtgaagaagatgtgattggagaggacgctcattggagatggcatggaaatggtgactacctgcgccatctccagagctgtatcgcctatgagagccgagggactgtggtctgggatagatagagagacagtatggaggagctagacggccacgtcacgagggcatggcatgcatgagctggagccatgcggcagagtgaccgaggagtgcttgggcctggagtgcctggggccgcatgtgccgttgggctcctgtatgaccagcgatgacgagtacgaggagacgcctctgtgcctgcaaag

SEQ ID NO: 727941 - DNA, 255 bp, Homo sapiens
gtttgcaaggactaacccctataccttctgcatactgaattatactatgaaataactttgccaggagagccaaagctaagacccccgaaaccagacgagctaccttagaacagctcaaagagcacatcccgtctatttagcagaatattggtaagatttataggtagaggcgacaaacctaccgagccttgtgtatttgctggttgtcctcgtatgaatcttagttcaactttcatattttgccctttctggtgt

SEQ ID NO: 727942 - DNA, 363 bp, Homo sapiens
ttgctgggcaaaacgagcccgtggagagatccttccagtcaagtagcttcagggtaacctatggctagaggactagtacctgcatacttgtctacgactggggaacgacaagtcaaaaagttgatcttaccagatgtcacgaatacttttctaaacatcaagatacagctcagaacacttcaataacaagatttggtctacttaggcatccggcttgacagctaaacactttagaccacacaaagttaacatcatgttacatacgtcttacagtgcacgttaccccaatctgtgaaaataaaccaacatgaaactcaaaaagcattactagctctgctttagtgcctaaggtatcacagcatc

SEQ ID NO: 727943 - DNA, 162 bp, Homo sapiens
cccaccttcccaactgggacattctcaagcttttcacaccgaaaaggaaaaaaaatgttatttttagacacattttatgaataacttgtgtaaggaatagggcgggaacccttggggaaggtaataaagaaaccaaatggtggggaaaaaaccaaaaaaccc

SEQ ID NO: 727944 - DNA, 160 bp, Homo sapiens
acagcgatcagtgtagaggtgatgtccagaggttgaaaatttagagtgggagttaagagagataaatagaagataagtataggtggccaaagagagaaaatgaattagggtcactaaggcagaaatctagatccacaaatatagagagccgagctgtata

SEQ ID NO: 727945 - DNA, 305 bp, Homo sapiens
  misc_feature (206)..(206): n is a, c, g, or t
  misc_feature (219)..(219): n is a, c, g, or t
  misc_feature (250)..(250): n is a, c, g, or t
  misc_feature (259)..(259): n is a, c, g, or t
gcgcgtaaccgttccggtttggggttggcatcttagtatgcggctgcagcactttcacacgaaatgtatgccgattggtgggtttacgctcgtcgtaatacctataagtacacaggtatatttgtatgtcgtatacggcggtgtctcttccactagggctggtatcctgttgtaataataacagtagcaccatgttacagtagtangtttacctacacnggatcaggtgtatcgtagactttactctccncttgctagnttagtcgcggcattaggtgtccggccccccgtgaccaaaaaaaaaa

SEQ ID NO: 727946 - DNA, 280 bp, Homo sapiens
tataccacgccgacacccagaccttttcagcacgggacgcccaagctgttgcagcgcgggcggcatttcagctgtgaggaagggcattgcattcatgtgttgtatctgcaaaaatggttgtcttaacttcttaacctcatattggcaagtgatcgataaaaattggtgggagtttcatgacatgtggacttctttggaaatagcaagtcaaatgtcgtgaccaaattgtggaagagatttctgtcaaataggagatgtgtaaggtcgcctcacgggggta

SEQ ID NO: 727947 - DNA, 128 bp, Homo sapiens
ggcaccagtttctgtccacagccacccccacacttttcttgtatttgtctgccaacttcagaagaacttccagataagaatttctgcctgcagctccagtatcaaggatatggggcagcacagccaca

SEQ ID NO: 727948 - DNA, 427 bp, Homo sapiens
acttcagggccctgttcaactaagcactctactcgtcagtattactgctaaatccaccttcgatccttaagttacatatgggctatcgtagcttcactagggaggagataatgtagtcccatgtcttgccacctcatggagtctatgcctggtatctaacgtctttactgtggctacttcgctcttaactatgtaaccttcatcaggttttgctggaaagatgcgtcggtatttagtctgagctagaggtggtgatgttgactcggggttttactcggttccagaacgggctcctctagagtgcgagtatcgaagcactaccgggtctttggctttttacgctgtgtcttccctgtgttctggcgagctggttagtctgttgtgctgtggatcgtctagggctgggcgttgtgggctgtctggtccc

SEQ ID NO: 727949 - DNA, 415 bp, Homo sapiens
  misc_feature (141)..(141): n is a, c, g, or t
atctgaataaaacctaggttttacagataaaagaaagcaaaaatgtaagagatgttgttgaaggtcacagaggtgactgccctaacttccagagcagggcttctgatccctttaagaaattacagggccagccgggcatgngtgtcacgcccgtaatcccagggctttgggaggccttggcaggtggatcacctgagatcgcacgttcgagaccagcctgaccagcatggagaaaccccatctctactaaaaacacaaattagccaggcatggtggtgcatgcctgtgatcccagctactcgggaggctgaggcaggagaatcacttgaccccaggagacgtaggttgtggtgagctgagatcgcgccattgcactccagcctgggcaacaagagcaaaatccgtctcaaaaaaa

SEQ ID NO: 727950 - DNA, 205 bp, Homo sapiens
cagtcatgtgcattatcattaaaattgttatggggttaggaaagcaaaaattgttaaaataagtgcaacaggcttgggtgcacacagttgcacaggccttgcgagaataaagtgtcagagcagaatctgtacaaacatcttgttacatgagagagagaccactagatggctatctcttacattcctatgtgcaaactgaaatgag

SEQ ID NO: 727951 - DNA, 313 bp, Homo sapiens
atttccctggtgacactcttagccatgaaagctgacctatcgcgcatggtgaacatctttattctagaaattggcatgtttggaaccattagcacagatttgcttaggtgaaggacacgtgtcttctagttctgcctttttaagtttttgtacatgatggatatgaacatccatttttctttatgtaccataactaaaataaagtccataaagaccattctgactacaaatttggatatgatcaggaaaaatggctaatacattttgattcttagatactattccatttttatcttgctgtacagtattttaa

SEQ ID NO: 727952 - DNA, 176 bp, Homo sapiens
gctttgagccattgttaaatccggtgctgtattgtgattaacagattcagggcttggagcagtggctcatgcctgtcatccaggactttgggaggccgaggtgggaggatcacttgatcccagaagttcgagaccagcctaggcaagacaactcacacacacacacacacacacac

SEQ ID NO: 727953 - DNA, 135 bp, Homo sapiens
aggatgctttggagacggcgcgagccagagcacggggtagcgttgcgcttgaccccgggcgtcagaccgtagggaagagagaagccgtcctcatactccgccggcagccagcgcacaagggcagggtgggaggcc

SEQ ID NO: 727954 - DNA, 1237 bp, Homo sapiens
  misc_feature (356)..(356): n is a, c, g, or t
aggtttttccccccttctgggccccaatttgttgtgcgtggtccccccggttttcagtgaccaccccttcgggtggtctcccctctcgggtttgtggtgcccccccgcgtcgccccctgtgaacccttctcgctcgacggctattttgtacccactgggagttgacgggcaagaaatcattgttgtggatactccccctctatagactctctccgccctcttttggcgagaggtgtgatagttctggggccccaccaccgcggaatttttgaggtgccaaacaagaccaacctgcgggtggcccaccaagcccttcgccgcgataataggctggtttgcaggccgcctctttttangtgagagagccccccgctacagagagttgtttttcgcgcgctttcgcacccatgaagtgtgcccccccgctaccacagttgcttagtaaacccacgcgcggtgtgtgtggtgccccccaccacaagaaacgcgcacggtttgtcgtgtgtgtgtaccctcttctctgcgggtgttgtgggcagacacatcaggcatgttcccgtagcgggtatacacttctaccggccgcccgtacgttgcgtgggtggcgctctccaacatatgtgggggagatatccacgcccccccacacacgaggtatccatcatcctcgcgcgttggtcacgcgagacacgcgggggcttaacaacacatgtgggctcttgtggggacaaaatttttccaccgccgttggggcccaccataaccccttcacggttccggcaccccctttaccaatgggcaaggacgtcactatggcgtttcccgtgaggccccccccgctccccacgcggttattgtgaatcacacgaagagatgacaccggcgggttcaccacagacacacagcgttctttttggcggctaacacaaacactgatacttgactaaggctctttatttataccacaggtccttctcccgccgcttggttggttgggatccaggacactggggggtatcaccaggccgcaacacaaagcgaagtggtttccccactcgaaagaacaccacgatttataggcccttcgccaagaccacaatagggtgattcctttttcttagagagaaagaatttacgcttggtggcaaaagataacatatcctgccccgggccccatcaaacaaaattttccagaattttcatttaagtttaaataaaactttcctttaccagttta

SEQ ID NO: 727955 - DNA, 453 bp, Homo sapiens
ctatctttttgatgatagatgatttaatggatgtgaagtggtctcttgtggttttggtttgcattaccctaataactaatatggttgagaatcttttcatgtgattactaaccaacctttctttgtctctccttcacccctactattcccagcctgtggtaaccatgaatccactctctacctccatgagatccacatttagctcccacatatgaatgacagcatgtggtatttgtctttctgtgctcagcttatttcactcaacataatgacctccagatccatccaagttgctgtaaatgaaagcattgtattttttatggctgaataatattccaccgtgtatatgtaccacattttctttatccatttatccattgatggacacataggttgattctatatcttggctattgtgaatagagtaataaatatgaaaatgtggatacgtca

SEQ ID NO: 727956 - DNA, 100 bp, Homo sapiens
gcaacatcctattttctaactactctgggaacctcatacaagaggaatcatacaatattgtgtcctttcgtgactggcctgtttcagcgcaacgtattca

SEQ ID NO: 727957 - DNA, 151 bp, Homo sapiens
tctagaggttaccgttcgacggaagcagcaggacgttcaggtggaagcagctgcaggcaggagaggaaggaggcccttactcttccttctcgtccatgggagcatctactgcagcctgcagctttgcgtgctcctccagcaagcggtcgaa

SEQ ID NO: 727958 - DNA, 692 bp, Homo sapiens
ggagagagagaactagtctcgagtttggttttttttttttccacaaatagcacttttaattggccactattggaagtctgaacttataaacaaatcctgggacggggggtccatatccatcagctcgtctcaactttagcaccggtctcgtccccgaggggctttcccagaactactggccttcaccatgaagctccatgagcttccccaattcaaacttggggcttcttcagcattttaacttttctaacgaagacttcatgggagaggataaatcagattgggcaacgccttttctatgtctttcccaatgctgtctgggaatcaatttatggaccacttctttcaagtcatttggtctggcacctctcgggtcatgattctccatcatcttctcccggattgggcggagacctgtgggtgctagagcataaaggaggtctcccgtatctagatggtggcgtttttaacgtaaaaccaaaacagaacagacgaagcaagtaaccatcggatagtctggacttcaagcggtgagcttcaaatcatggtctggccatttttggaccagggaacacttttggtcaggggtaagatccatgccagggaagttagtcaggcagttttaaccctgaacatcttcagtaatcagcttgaatttgctaaatgcaacttcatcattctgcaaatcagca

SEQ ID NO: 727959 - DNA, 670 bp, Homo sapiens
gctttccgccaaaagattgggtccccccgctataaagccgcacagaagagggtatagtctcccctcgccccctcttctctttaaagactgtatagtcccccatagccgagaggggtctttaaggcccccacggaagggggacgttgttgaaaaaggtggtccccacgcccccccctcataaggaaggaaagatttcccgccaccgtttacacccacccttttccggcggcccgcagatgaccacctggcgactcccgcgaggaccaccccccccattatttcctcgggagaagagcgccttccccgcgaggaaaccacacggcttgagacccctatgtggctattgcactcaagtgttccgcctgaccccctggaggttctgcccactgaaagaaagatatagaaagacccacccacacaccacacttggtgttcacttgttggagtgtttaaagcccacccagcacccacgagttaaaccacggctgtgaagaaagcgtgtattgaccacttgaatgtggcccaggctcaacacccctgagttcggcctgatggagagaaagaaggcataatgttcgactggctcctgattatcgagtgctttggagtgttgccacaccacaaaattgggagtcattttaaactgaggtccacagctgcctaattttga

SEQ ID NO: 727960 - DNA, 415 bp, Homo sapiens
ggtttctttaaagtgggagtgaaaactaagacatattttaaggtgttccaagtgtaggggtttttatgagtcccccttccacttacccacatgtgaattgacatatttttgccaatataaatttattcttcctttccaaagccattaacttaatattcataaaaagagctctgttttttcttttgcactcatatttcattggtttaagtaacccactttatcatataattagaatagtaagtacggtttatatcatcttggaatgcattagctgggcaacagataattcacttggtgggagtagaagtaaatggtgtactaccagctgtgaacactcagcagctactatgcactcatcaaagagtgttataaagggttacagagaattgggaacttagttaagggcagatttgtt

SEQ ID NO: 727961 - DNA, 406 bp, Homo sapiens
tagagatagggtcttattcggctatctaggctaaagtgcaggggtgctattatagctcacggtaaccttgaactctgggggtaaagtgactctccggccttagtactcctttggagtagctgagactacgggctggcgcaaccatgtgtggccaattttggtatctttggtagagaagaggtctccctatgtggcctaggcgggtctggaactccgggcctcaagccttcctcccacttaagcctcccagagggctaggattataggtgtgaaccacaaggggttttagagagcatctataatcctttttttctaggcaagagaacggaaagtggaatatagaacatgagtaaccagggcagagccagattggaacccatatcttctgactccgagttcagttcgg

SEQ ID NO: 727962 - DNA, 106 bp, Homo sapiens
acttagggtcttagggagtaagcacaatgaggttgtctgagaagaaacaggtttccaaggtcctgggaaacctgtttcctcccagaccctactccctaagacccta

SEQ ID NO: 727963 - DNA, 178 bp, Homo sapiens
tctagaggatccctgtggagacgggggttcaccattgttgcccatgcttggtctgaactccttgagctcaatgtaatctggcccgcctccacctcccagactggctaggattacaggcatgtgccaccatacccagctgtattagttcttgttctataaagctttttttttttttttt

SEQ ID NO: 727964 - DNA, 140 bp, Homo sapiens
  misc_feature (39)..(39): n is a, c, g, or t
  misc_feature (76)..(76): n is a, c, g, or t
agctgcaggagtaaaagctttttaggatcatgttatctntccttaaaatctggttagatggataatttcataaccnattttttttttaactcttaacttctttttgaaacaggcttcactttattaaataggggaggatt

SEQ ID NO: 727965 - DNA, 623 bp, Homo sapiens
gaaacccactccagcttactacgagacaagcttagccaaaacatttacctcaaaataacagtataggcagatagacattgaccacctggttcacatagatctaggaacccgaaggggacgatgaaacattataaccaatgcagtaatatctgcaaggactagaccacatattccttcttgcattgattgaacttaacttagtaaaataatgtttgccaggaggagcctagggaggttagacctcccgtagagaaccagtacggatgctaccataacgaatcccgcgtcagaaagatgcacacccggattagggtaggcaaaaatatgttggcgaaaggatacagagtgtaagatggctgaaaacactgtaacccgaagccacttggttgagtacaacctgtgtatggaatcaggacaagaatacgaacaaactatgggggcctaagagttagataggctatgcgcttccaatgaggaaatccccattcttgagacaatacgcacgacattgtgaaaaatgcaagaacgtgcatgaagggtacccatcagggagtggtaacagaaaacgaagttgggtcatgactacaggagacataaccgtggaaggaagaggagtacaagga

SEQ ID NO: 727966 - DNA, 361 bp, Homo sapiens
attttttttccaattttttttttcccaaaacatcgtttcagctcatttatcaagtaggtaaaatgagccttttgtgtacacacaaaggcacatgtgcacgcacacccaacttgtgaacacacatttttgttaaagaagttagaaaattaaagatgggttgggggctttaagtgcatcaaaggtatgaattttgtaaaactgtcaggaaatgtaaaattcctttttgaagtgttttttttgtgaaagggttcaaagcaaattttgcttactatgtagtgttgcccttaagaacaggggggtaattttattcaaaattgtgtttttttatcaaaagcctttggaaataaatgttccgggatca

SEQ ID NO: 727967 - DNA, 839 bp, Homo sapiens
  misc_feature (7)..(7): n is a, c, g, or t
  misc_feature (97)..(97): n is a, c, g, or t
  misc_feature (107)..(107): n is a, c, g, or t
  misc_feature (113)..(113): n is a, c, g, or t
  misc_feature (177)..(177): n is a, c, g, or t
  misc_feature (185)..(185): n is a, c, g, or t
  misc_feature (395)..(395): n is a, c, g, or t
  misc_feature (409)..(409): n is a, c, g, or t
  misc_feature (415)..(415): n is a, c, g, or t
  misc_feature (605)..(605): n is a, c, g, or t
  misc_feature (612)..(612): n is a, c, g, or t
  misc_feature (615)..(615): n is a, c, g, or t
  misc_feature (651)..(652): n is a, c, g, or t
  misc_feature (657)..(658): n is a, c, g, or t
  misc_feature (671)..(671): n is a, c, g, or t
  misc_feature (695)..(695): n is a, c, g, or t
  misc_feature (703)..(703): n is a, c, g, or t
  misc_feature (710)..(710): n is a, c, g, or t
  misc_feature (720)..(720): n is a, c, g, or t
  misc_feature (724)..(724): n is a, c, g, or t
  misc_feature (728)..(729): n is a, c, g, or t
  misc_feature (731)..(731): n is a, c, g, or t
  misc_feature (746)..(746): n is a, c, g, or t
  misc_feature (750)..(750): n is a, c, g, or t
  misc_feature (755)..(755): n is a, c, g, or t
  misc_feature (760)..(760): n is a, c, g, or t
  misc_feature (764)..(764): n is a, c, g, or t
  misc_feature (767)..(767): n is a, c, g, or t
cagccanccttggaaagcccaggcccagcagccatggcggtggaaggagaaataaaatatgtgaagatcttgctctacgtcctccagctggcctttngcgcctgtgnagtggnactaattgccgtgggtgtcggtgtacggcttgtcctgagtcagaccataatccagggaactacncctggctntctgttgccagtggtcatcatcgcagtgggtgtcttcctcttcctggtggcttttgtgcgctgctgcggggcctgcaaggagcactattttcttatggtcacgtttgccttctttctttctcttttcatgttggtggaggtggccgcagccattgctggctatgtgtttagagattaggtgatttcagagttttattaccacttccggcngcagatggagaatnacccgnaacacaaccacactgcttcgatcctgcacgggatgcaggcagttttttagtgctgtggggctgctcactacacagattgggagaaaatcccttccatgtcgaagaaccgagtcccccactccggctgcattaatgttactgtgggctgtgggattaatttcaacgagaaggcgatccataaggagggctntgtgganaanattgggggctggctgaggaaaaatgtgctggtggtnnctgcnncagcccttggaantgcttttgtcgaggttttgggaantgtctttncctgctncctcgtgaanagtntcannantggctacgaggtgangtangggtntggtntccncancctcctcatttgggggaatggaaaaggaacccccaggtttttcaaataaacggaatattttttcagaccgga

SEQ ID NO: 727968 - DNA, 201 bp, Homo sapiens
ccgcagctcgtgtcctggctttatttgagacagagttttgctctatacccaggctggtgtgcaatggcatgatctcggctcactgcaacctccacctcccaggctcaagtgattctcctgcctcagccacaggcaccaggctgcactcagcgaactctgcctcgttggctccgtatgcagaacacctacccagtagaaagg

SEQ ID NO: 727969 - DNA, 616 bp, Homo sapiens
gcacgcggggtagagagcgctacgaggtgaatatatggactctatgcgcaaaatataccatgagacgtatatgctgaccacacgtgcacgaggagaacgagccacagatttacacatagagcacgaatttatggttacaattaaaagaaacgtcttgtgaacacaccttacgtggataacttctataaaagggctggtggtggaattctggctacagtgggtgaacttctgaaaattgggaatgcgatggtttatagggtaccaaggtgggctggttaagaactcaaatggaaatcttttacctggataccttaaaccagaaacacatgggtatgaagtggaccccagaccctaacacagagaagtcttgggataaagagggtgaatatgccatggcgtggggtgtgtgtgggaaacaaacgcatgggtcgcgtataaagcgacgcgattatgcttcacatactggaagggcacagggtgccacaagagtgctcggtgggctttctgagaaactggtacacgagactctaaataacaagggttccccaagagggatcatatggtctataatatgtgacatgcgcactgtggggctctagcaccgctatgtgtgcgc

SEQ ID NO: 727970 - DNA, 621 bp, Homo sapiens
  misc_feature (1)..(1): n is a, c, g, or t
  misc_feature (29)..(29): n is a, c, g, or t
  misc_feature (42)..(42): n is a, c, g, or t
  misc_feature (77)..(77): n is a, c, g, or t
  misc_feature (525)..(526): n is a, c, g, or t
  misc_feature (587)..(588): n is a, c, g, or t
  misc_feature (617)..(617): n is a, c, g, or t
nttttacttttttttctacggaaacgcgncatttgtgttggntaaccccggggaattcggcccttaatgggcccggngggggattttttgaccgggcctcttggcggagaattgggggggtttcttttccttagagccgcgcggcttggggaaagttttctcccagggaaaaaacccttttttttatttttgggccgccaaatttgggaaccccacatggtgggagaaccccgccccggtttttttttcccccttttttcccaaggttttttgggggggggggaaaaaaaccccccgggggggtttttgggggggggtttttatcccccaaaaaaaaaaaaaaggggggggggggggaaaagaaaaaaatttttttgcgcccccccccaaaaatttttaaaaaaaaaaagggttttgtttttttggggaaaaaaaaaaaaagggggggggggttgtttttttttttttgggaggggagggtttttccccccccccccgggggaagaaaaaaaaaaaatttccccnnggccgccccccctctttttggggggcgccgccccccccgggtggtgttggtggcccccccnnaaggggggggggggggggagggaaaacanctcc

SEQ ID NO: 727971 - DNA, 892 bp, Homo sapiens
gggccacaggcagagagctggggtgactcggcgaggggttgcgcggtatagctacctgtggtagttcacccggggtccgctctcggctgggcgcgcacgggaggaacgggaggcggcatgggtttctgcgtgggagccgaacctaagcaagtgatgtgactacaaaatgtttccggatgatcaacgagcagaagtggggacatcacattgattcttctacggcgatacatcacctgctcagctttcaaccatcgtcagctcatgtacttcgcctttaccaggtatgactctgcttccagaagacaacatctggagaggatcctctctgttattttcttctttcttaatcatcagtgtgttagctttccccaatggtccgttcactcgactcatccagccttatggcgaatggttttggactcagtgtgctctacttcctgttcctggtattcctactcttcctgaatttcgagcaggttaaatctctaatgtattggtagatccaaatcttcgatacgcccaaagggaaagcagatgtcatggagtatgctgtgaactggcatgtgatcacctgggggaaggattatcagccactttgatatttttgcgtttggacatttctggggctggggccatggaggccttgtctgaatccgagtaacggtctctgctggcaatcagtattacctgggagctgactgagcccttcttcattggattttctccccaatttgcgagtgcttgggggcatccagtccttctggcatcctgtgtgccatgcggggctgtgggtggctggcggtgccggttagatcagggttccctggggggtcatgacttctcccccgggagacagaactttcggccctgtccgcgattctgttgccctctc

SEQ ID NO: 727972 - DNA, 191 bp, Homo sapiens
gtgtgttctgtgtgtgctgtgtcgcgtttgtgtgctgtgtgtgcctgtgtctgctgcgtccttgtgtgtcgtgctgtttgctactgtgccgtgtgtgcctgtgtgtgcgtgtgcgacgcggtagacgctgctgtgtgctcgtgtgtgtgctctatgtgcgtcagtctagacacagacagacccaaaaacga

SEQ ID NO: 727973 - DNA, 1679 bp, Homo sapiens
  misc_feature (134)..(134): n is a, c, g, or t
  misc_feature (394)..(394): n is a, c, g, or t
  misc_feature (1402)..(1402): n is a, c, g, or t
tattggtatgtttgttgggcttatcctttttttgtgagtcactatccgctgtggttgcttggtgtagtgattactctaggagtgctggtgtggtttgctcggtggttggtcgtttacatcccgctgtttgttcngttcttgtatagttgtgctcctcgcagtgttgtcgtatcttgttgtcctcggtgttgttttgttcctcactcctcttgctcgtctcggtctttccccgggggggcgcattcttgggggtaagtgttgtgagagtttggtgtggtctcttgactctcttctttgggaacccccatctttgtggcccgtgtgggtgtttatttggtgtgtttttctactcaccgtggtgccatccttgttctgtgctatcttatttcgtggnctttgtgggggccctcactattatggccactagtggtccccattcgttgttccggggcgccttgttgtggagagcacaccccttgttcgggtggttgctccccacgaggagtgtttttttgttggtgtactcaccgaccaggggggggtctccccactcttgcttccctctagtgtgccctcgtgtgatgggggagcattgttcttgttctggtgggaattcttctcccctagggctctcgcgagagtttttttgtggttgctgttgtaatacctgccccctgttgattggtgcctgtggtgcctgggtccccccaccaaattttttcgagatgtttttcttcttttcgttgtgtttttgggtgggctcttggcgttcctcctgttttggatacagccccgctgtgtcgtcactctctgtggggggggagtccttctctcggccgacactctactcaggtcgtgacctctttttgtttttccccacggcaggagaggtttgtagtatggggataactcaacgatcctttggtgtgtgtttcacatgcaacaaaacattttcacacaaacgcggggggtcgaacccgtttctggtattaaatcccacggggagtcgagtaccttggttataccacgcgcgcctctggggcccacagctggtgtgatagagagttttgtgccacactcttcgccgttgtggaagcttctgtgagattgcttgagctagagagcgtcctacagggataccccactctttgtcgtctttagactacatagcgccacacgctctctctctctctgtgaggtctctctcctgagatagagactctctgtgtgtgtgagtttttttgctgcccacacacttgtggacacagtggggcacacacccactctacaggatacccgcgcacaacacccacatggtgccctgtgttgtgcacagcctatatcacaaactgtggctgtgtcttgtgtccctcgagagagagggggagacccgcatatgtcnctatgtgtagatactccacacagcgtgttatagccctaccacgctatgagagaatggagggggcccgcggagcccaatccgctgccctcggtatattgtcacgacaccacacccacggcttgaatttggagtccccacggcagagtccaagggaaaggtgtgagtttttctgagggaaaagaggtgagttttgaaaataatgtaacttgtcacaatggtgttggacacatttgcgcccaaagatatggtaattttattattaaataattttttgaga

SEQ ID NO: 727974 - DNA, 1462 bp, Homo sapiens
agtgtaattactatcatttacctttctcatgacttatgaaatactatgtataacgtttacacccttcataatacctgccgtatatatagcactaaaaggaatgtgtagtagttcggctgttcaatgatagttactactcagtagacactacaacgaggctcacatacccttctctaatctcgaatatatgtcgccatattggcctagtgacttgactgcgtttggcacagccatgatgaagctacaaggtgggtcatagtctcataatagtgagcaatctggaaaccaaaataattgagtccgtgaggacccatcgataacggttgcaacgcattacacaactcgtcacatacttagattcggctaatcacagcatcagagtgctgttcaccctatacctacaaatgtactaagtatcatccttaagctaacatggaaacgaaattggaacggtctttgcccagggaaaagaacgattactaaaaatctttgggtaaattttctacaccaacgataatccaaagcacaccaacaaggggcataaaagtctaaaattaacaggcctagttgcacatttcctcgcttgcatcaatctgaatgtgtttaataaagaacccacacgatggcgaatccgattagcaacattccctttactttttaggccatagatatggcggcacccaacatcaacttgttgggcacgggcacgcggaactcgccacataaaaacaaatgattcctcatttctcctaagattttaagcgtgaatactttgactctgttgaagttttccttgatctccacttttcatcacctttcgggtgcgtcagagtcacgattcggtcgcgaattaacattgggaggtagaaattggaccggataaacttgcatgttggaaccttgtcctttaagctacatggttgactaagtgggggtgggtccaccgtcaacgataccctcgttcgcaagtatgggtcgtcacttgaaattcgacctgggacgaccttgaatatcctcggtcgactcagtgtcccctaagttcgttggcggtgcggggagacaactacccctttttaattccccgcaaacctttgggcaggaatttataacagcaccggggtccacggcacagcggcaagtctccaaaccgacatgaaattgcttggactggcaggaatataaccccacgaacgcgtaccaccaataaattagggcgcacacgtatgccgagaaataacagagggggacaggaaactccacaacaccgtgggcacgcgaggtgatacgtgagaacaaatctcgcgcgatgcgcgacatccaagtccaccaacaacacagtacgaccgccgtaacagcaacaatcccatagagacggccctactgaaacgacaccccgccaaccaaaggacaccaccgtgcggcacccgacagaacaccataaaacagacggtgaagaccaccc

SEQ ID NO: 727975 - DNA, 413 bp, Homo sapiens
agcctggaaggttgaagctgcagtgagttgtgtttgtgccactgcactcccggctgggcaacaaagtgaggccctgtctccaaaaaaaaaaaaaaaggaagggaaagggaaaaaagggcccccgagagcccaatttgtccccacaaaaataatttactaatttaaaaggcggtttaaatccttccaaaaatttatgtagctggggcatatttttatctaatcccaatttttaaaaggaaagaggccctttaaagcctaaaggggaatattttataattaactcataaacttgtatgagaaaattttttccaaaaggatttgcaccattgttttttcactcagggggtaaaaacagcggcctccctacaaattttgggacataacaaattggtttcttttccataggcggcaag

SEQ ID NO: 727976 - DNA, 362 bp, Homo sapiens
cattggagttatcagatctgggaaggaggatggagggcgagggactggggttgtggaatcctcagagacccttgtactgcgcggggggcgcctgtgaggaagagttccccgcttgagggatcggcctctcgcgattaggccgtgaggttagtcctggtagagcatgtctcgggagctcccggggtcgatgggcggagggctcgatagaatgtcgtgggcggagttgagggattgaatgggtggaagggtagtcgaggtgaaaggcacaggttgagtcggtccggggttgaagccttgttgggggctcagaagatggaattgtgaccccattcaagattacgcggttgcaatctcggggttgg

SEQ ID NO: 727977 - DNA, 160 bp, Homo sapiens
tttccccccccaatttttaaccaaacagtggtttccacatttgggccccctccaaaacccttaaaaaccccccccccaaactccttgggggaaaagatttgggcttttttcaggtttcctcattggggggccctaagattaaagttttttttttggggca

SEQ ID NO: 727978 - DNA, 1035 bp, Homo sapiens
  misc_feature (696)..(696): n is a, c, g, or t
gtatgactattctctaccatgacactaatatattgatacctcatactacgctattattactgagtgccactgatcctggatgtccttagcgcactacggcgtctaaagcctccttattcgaggccgatctgtgtcaggccagggcatactcgttcataggtatagcgatccaactatcgttatctactgtgagtcgatccaccagcccctatgactattatgatgaatagaatctttctctcataagtaataccccatcattaactccggtagcgctctagggataactcgatctgagttatccccctaaataatctggtgccccttgtatatggactgtttccccagctataaacgaacgataatggcttaacttgacatccttactcgtcccttcctcctccatactctcatgcatcgcatctgctatagtgcggaggccggagcaggcaagaggttgaatagtcatacaccttcctcttaacgacgagtaagcttacttcccagaccctgtacgctctcgctgtaagacccctacactccactcttctcgcttctacaacctatacagggttgtgttctcttcgtatctttatgggagccgatccaattctcatcgactatatcaacttaatccattaatagcatacccccctgccaaataacaccatataaccaaacagcccccttctttgngttctttgaatcccgtcctaagtcaccagtcaggtccttatcttctccatatctctctccagctcgctcagacttgcgtggacagtcactgatagctaactaacgagatcacgcaagctgtaatcacacacactttttcgaatccctgatcggacgtggagggagaacccctattctataccaaacagctatttctgtattttttcggtcaaccctcgaaggttaatatttctgattctaaccagggttgggaataaatttcccaatattgttcctttaatactgcggggaaaaaatagcctgttgcgttcctaagtttggtcttgaggaagagttacg

SEQ ID NO: 727979 - DNA, 119 bp, Homo sapiens
aacgatggtctcagcatagtttcttcccctgtgcatttggaactcctttttagtggtgggtgatatccttgggggttcactggccttggtaaaacaagtaaataaagtaagcggaagat

SEQ ID NO: 727980 - DNA, 86 bp, Homo sapiens
taaaaggagcaaacatgtgacctggagataaacgctggagcaatctcctcggaaggattcagcacgagtagatggtaaacatttaa

SEQ ID NO: 727981 - DNA, 1035 bp, Homo sapiens
gaaaaagataaaaaccgtttcaaaaattaaggcaggccaggtgcggtggctcacgcctgtaaacccagcactttgggaggccaaggtgggtggatcacctgaggtcaggagtttgagaccaacctggccaacatggtgaaaccccatctctactaaatatacgaaaattgggtgggcatggtggtgcacgcctgtggtcccagctactcgggaggctgaggcaggagaatcacttgaactcaggaggtggaggttgcagtgagccaagatgcaccactgcactccagcctgggcaacagagtgagactctgtctcaaaaaaataaaataaaaaatataggccaggcacggtggctcacgcctgtaatcccagcacttagggaggccgaggcaggcagatcctgaggtcaggagaacaatcccagctaacagggtgaaaccccgtctctactagaaatacgaaaattggctgggcgtggaggcagggcagctgatagatcccagatccccaggaggctgaggcagaagacatggcagtgaacctgggaggtggacgcttgaacgtgggctgagattgcatcaactgcactccaagctgggcaaaagaacgagactccatctcaaaaacaaaatatattatatatgatatacacacacgaccacagagatccgtaatcaaacaagacgagacacaaagaggaaaacaacagagagcgaaaacaacagggaacatacacacagaacacataacagaacaaacaaaacaaacaacacaaacgaccaaatcacacaagacgaaaaaagaataaaacacccaccaagggaaaaactaaaaagtaaagaaataaatactaacattggaacaactgagcatgatatacaactaaagccgaagacaaaagtgatgaacataagagcgacaaacaaaagataacacaacaacagacagaaaaaaaccataagaagaaacaaaaaggcagcacagagacgaagatcagtgacacaccgtgaccagcaaacataaatacaagaagag

SEQ ID NO: 727982 - DNA, 701 bp, Homo sapiens
cggatcgtgccgcggcggcgagcgcagctccttggaccgtcccagtgacccctggatgctacaggagggtgtccagaaggccacgatgccatggctgtggtggaacatacagacgagctgcccgataacattctgctggagctgttcagcgcacgtgcccgcccgtgcatctgctgactgaactggccgtctggtctgtcagggctctggcgggacctcatcgatactcgtgaccctctggaaacgacataagtgcctgcgacgagggcttcatcactgaggagctgggaaccagtccgtggtgcgacctggaacgatgcttctagcttacttagcggagacctgtagcacggaactcgtgcctgacacagacccgatgtgcgctgaacgaggggtatcgagtttctggaggcctggcatgtgaagtggaggctgatagagtggaatggtggaggatctctctcgagaccagaggaaggaattccacgcaatgagctaggtctaagaaatacttcgttacgttcagtattatgtaagatccggtggacttggggtaggggaaaggtcggccaaatcaactttacgcctggcggtctcgtcccgaccccgtggaacggggcagatccgtagcccgctcatgtgtcctagtgtgtgagacccgagtgcctatgggatcgtcaggctggcacgcgacggctgac

SEQ ID NO: 727983 - DNA, 328 bp, Homo sapiens
  misc_feature (129)..(129): n is a, c, g, or t
  misc_feature (154)..(154): n is a, c, g, or t
  misc_feature (169)..(169): n is a, c, g, or t
  misc_feature (181)..(181): n is a, c, g, or t
  misc_feature (187)..(187): n is a, c, g, or t
ggtaacctcggaaagtgaaacgcagctgttcacagacatgaggcactttgaagaatgagaccatactctaggatggtagaaaagacagaagaattttagatcactatgatcaccatggggtttctcagntagccttggacttaataccactgcnttatctccctcttanaaattcattgtntatcantgtcgaaatacaactgattttgtacattgactttatattctgtcacgctgttcaattcacttactagttctagtaattttgtctagattcttcatgattttctgtatacaaacgttattcgtttgaggggaaaagaccctg

SEQ ID NO: 727984 - DNA, 646 bp, Homo sapiens
agcgatgggggtggatctttcatgactaattcagcaccatcttcttagtgctgttctcatgatagtgagttcttctgaaatctggttgcttaaaagtgtgtagcacctctccacaccacccgcttgccttggtctactcctgctatgtagatgcttgctcccactttgcattattccatgagtaaaagctccctcaggccttcccagaatcagatgcagctatgcttccttcaacagcctgtggaactatgagccaattcaacctcttttcttcataaattaacaagtcttgggtatttctttatagcagtgtgagaacagaataatacagaaacatggtacaacgaggagtgaggcattgctagaaagatacctgaaaatgtggaaacagcactggaactgggaccatcagaccagaggttgcaagagtgtggacgggctccgaagatacgcgcacacgacgaggcgaagttcggcaattctcttcgagcatccgtcacaatcgttcgaccaaaatactgatagtgatctggacaatgaagtccaggctgaggaggtctcaagatggagatgagggacttattgggacctggagtgaacgtccactttgcttcaggcacatcgtgctcagcagacatgtgcccct

SEQ ID NO: 727985 - DNA, 802 bp, Homo sapiens
gttattgatatagacgattaagcatcaatatctttttttttatctcgaacagtctgccataaacacagggggggtgtacataataaaaaccacttgcacactcaatcttaactcagcttccatctcttactattattcttttgatgcagataaactgtcctagttcttcaacaactaaacttcagtattttaatcgtttccttaatctatccacttgaccattgacaacgtctgattatcattaaatacgactaagggacgactctcatataatagctcaatcatgcatcctgataacgattatcaggaatccatttgatgtatctactctaatcaaatatgaattgtcattctatgcaactagtttatatgtctcacgcttataagatagtagaagataatagactgccatccgaaactcggataaaacaagttctatattctcttgtaactgcacccgctaaatagtggtaacatttacagatctaataataacagtatgctcattaatgaatacatctgtctgctgtgttacggagcgaccggtcatacgataatgttataaaacgataacattaatgtatataatattaacatcatccattctgtatacaagctcccatgtctatctttttctcagtttaacttacatatcatcaaacatacggcgtagacgtatcatcacattattcattagcatttccgcataaattgagacatcccataattcgaaagcgcgtttcgggcctagaatttactgttggctacataactgagcattcgtataatactaagactattg

SEQ ID NO: 727986 - DNA, 836 bp, Homo sapiens
agcggtttggagacctgtagccaggaaaaattagaattaagtccaaactgtaaaaaatgataaaaattgaaaaactaggtaagactagaatctaacaggtgtactatagccaggcgcagtggctcacacctgtaatcccagcactttgggaggtagaggcgggtggattacctgaggtcaggagttcaagaccagcctggccaacatggtgaaaccccatctctaccaaaaatacaaaaaaattagccgggcatggtggcgcatgcctgtaatcccagctacttgggaggctggggcaggagaatccttgaaactgggaggcggaggttgcagtgaactgagaattgtgccactgtagcaggacaagtcgcagacaaaacccctcagacaccgagttaaagaaggaatggctttattcggctgggagcttcagggaagactcacatctccgaggaaccaagctccccaaatgagcaacttcctgtcccttttaagggctcacaactctaagggggtccacgtgcgagggtcgtgatcgattgagcaagtggggtacacgactgggggctgcatggcgccctgctaatccaggttggaacagaacaggacagggcattttcacaagtggcttttctatacagtgtctgtaatctatagataacataaccgattaggtccaggggtcaagtcttttaactaccaaggcccagggtgtggcaccaggctggctgcttgtaagatttcatttccgccttttaagttttacttcttccttctttgaaggcagaaattggcgctaagacatatgaaggggcctcttcctcacaccacatcag

SEQ ID NO: 727987 - DNA, 661 bp, Homo sapiens
  misc_feature (27)..(27): n is a, c, g, or t
  misc_feature (91)..(91): n is a, c, g, or t
  misc_feature (172)..(172): n is a, c, g, or t
ccggtgtttaacccattttgggttgantttgggttttgccggaagagaagtcccaattttgtaacttttgcatattagaaatctgtttttncccaacaccatttgtgaaagagaatgtcttctcccccagtgtgtattcttggcagcagtactatttttaatacccaagatnttgtggaaacaacccaaatgtccatctatgaatgactagataaagacaatgtggcatataaatccaatgaaaactatttagctttaaaaaagaaggaaatcctgtcatatgtgacaacatgaatgaacattgaggacattatgccaagtgaaacaagccaggcacagaaggacaaatactgcgtgattccacttatatgagttagataggtccaggcaaggtggctcatgcctgcggtcccagaactttgagaggctgaggagggagggtcacttgaggtcaggagtttgagaccagcctggtcaacgtggtgaacccccgtctctgctgaagatacaaaaattagccaggcatggtggtgcaggcctgtggtctcggctacttgggaggctgaggcgggagaattgcttgaacccgggaggcggaggttgcagtgaccgagattgcatcactgcattccagtctggtgacagagtgagactccatcta

SEQ ID NO: 727988 - DNA, 2218 bp, Homo sapiens
ggtaaagcgttagataaagatcgaaagtcgactgaacgcaccgaggctacctgacatagaccggctactataagtatatgagcgccgctattgtccattcagtgcagacgcaacacgtgcagcactcgaacgtcatcgcgaatccatggaagacacgccactgggacaaaacctggatctgagcacaaacgttcacgccatctgacacacgccgacctacacaccgtgctctactcgactgctcagacctgacacgatacacgactcacctcaggcatgctcacacgcaaaggctaccaacataatctggcaccacacccagcactagggctacccattgcgggcaaacacaacgccagtaagcgcaaacagaaacagaaatagacaacccatcttgcatgacatgcttacaacaaccacactccaccagagctaggagaccaatcgaaagaccaccaccagtcatggacacatacgaacatgacacccctgaaacacatccgacaatacacaagaggtacatataaaatgtcacagcgttggcatcactccagccccaggagcacccacccgccaccaaagcgccacaacaacgatctaaacacaccactcctgtccaccacacatcacattctcactaccatagcgcgcacaaacacaaccgtacacattgacaccaacaagcatgaacgcccgtccttttccacacgcgtccatcaacaatgcggacacagagcgacagatctgcacatccaccaacagcgtccacagttcaccttgctgagacgcatcatgcacgaaaaacaacgcacataggcaaggtagccaaccaacacctagtacaagcacaagcacatatcaacggacacaaacaaatacacgacataccgccacatggacgtaccagaccacgtcgaacaaactcacaatagcgcagagccggagatcagccacgccacaccgcacacaccctaacaccaaaatgagcgaaggagacgaacaacagacgcacataacacgatacaactcggaacactatatagccacccgccagaatccacaccaccagtaacacataaccattcaccatcacccggcgaaatcgacacacacacaagaatatacacatcccaccatacggcacacaaccacgactaaccaacactcgcaccacacaactaggcgacagcataaactcgcaacaccacaacgacgacacgtaacacacagaacagaaaacaatcacccacatgaccatcgaatagcaacacacaccaacgacaaagccaccaacaacgaataatacagacaatagacaacccacaacccacaagcagggaaccaacacacccacaaaacagagacaaccacaacacagcacaccacgacagtcaagacaaacatgccatcaggcaacccaagacgcgcagagcacacacaccacccacagcacaaacacagcgacaaaccaaatgaaagcgagccgaaacaacgcggaaacacgaccggaccaacatacaacaacacaaaagagaacccaccgcacaaagaacgcagaccagccttcacacacgaaccatacaaacacccaacgaccacagaacacacacaacacacacacgcgcgcagctacaacactcacccgaaccgacatgcactacagcaccacaacggcacgcacaaagacgcaacacacccactcgacatacagacaccaacacaacagacacctaccaacacccacgtcgacccacaacgcagactacaccaccacgaccgctcagaccaccccgcaccgctccacctccgctcactacgaccgagccgacacagaacaaagatcccatcgcaccaacactctcacgacgcgcacgaaacacaacaaacaccaaccaacagaacgacgacgtacgcagcaaccatatagtcagccacgacaccaaccacacacaacgcaacccgatacagcaagacaacaccaacacactcacacgcgaacgccacaacacagagcacacacaagcacaacacaacaacacaaaaacagcgaaacccaccgtcagagtagatcacaacaacaaacgacaacacacgcagtgcagcacaccaccccacagccagaacaacaccaacaacaacaaacacagaacacagaccaaacacacaacacacactcactaagacacagacactcagcaagaccaaccagttcggtcca

SEQ ID NO: 727989 - DNA, 105 bp, Homo sapiens
taggagtatagttggagcgctttgtcatgattcaggttggctttgtccacacgctatttggccaatgcaccttagcctcaaagctggcaaatcgtccaaattctt

SEQ ID NO: 727990 - DNA, 835 bp, Homo sapiens
ggaccccgaggcgcgcgcggggtgcggcgctgctcactgacctctaccaggccaccatggcgtgggctattggcgcgcgggccgggcgcgggaccgccgccgagttcgagctcttcttccgccgctgcccgttcggcggcgccttcgccttggccgccggttgcgcgactgtgtgcgcttcctgcgcgccttccgcctgcgggacgccgacgtgcagttcctggcctcggtgttgccccctagacacgggatccgtgcgttcttcgagtcaccgttcgggtccctcgacgtgctccgtaggtgacggtgcggagccctgcccgagggctccctcgccttccccgggatgtgccgttcctgcaggtgtccgggccgtcctggtggtgcagtgctggatgaccaccgctgtctctgcctgggtcatgctacgccagccttggtggccaccaacgcagcgcggcttcgcttgatcgcatgggccgagagaagcggtgctagagatgggcctgaggcgggctcagggccccgatgggggcctgacagctccacctacagtagctgggcggttcgacagcagcgagcaaccgtgctaggggggccatgctgctgaggttgtgccggtggcggggacccgtggcccactccttcgtcacttccttttccaggcaggcgagggtgccccctggaccctgaatgttggcgccagcagctggtgaagggccctggggggtggacctggggggcaaaaggccagggtgtggttgggagcggggttgttgccacctgggggctgggggtgcaggagccggattcaggcggaacggggcaggcttgg

SEQ ID NO: 727991 - DNA, 345 bp, Homo sapiens
  misc_feature (322)..(322): n is a, c, g, or t
  misc_feature (343)..(343): n is a, c, g, or t
tcagatagtttttctgtttgtaaactggtgaatttgtatttatttcatggctaaatttctgaagtaaaagctataggatctttgtgtgtgtgtatatatttaaaaggcctttataatttctataattttatgtttaattggcaattaaatctgttttaatttccctccagcacaccagactttttctctccatacgttatgatgtaaattttgctattcgattttcacctcagtttccttaaaatgcaaattcaaggctatttagctgacaaccgcttaggagtagtaaaacaggttatccaaggattcggaaggtgtggcnggggcacggtgggctcacgtnct

SEQ ID NO: 727992 - DNA, 116 bp, Homo sapiens
tttgtagtgggttatgtttttattctacgttattggtaggacaggtaacatgggccaagacctccacactcccctgggaaggaacagtcaggagaattagatacatctcaagtggg

SEQ ID NO: 727993 - DNA, 746 bp, Homo sapiens
ctacctccctcaccaaagcccggtaatcgcataaaacttaaaactttacagtcagaggttcaattcctcttcttaacaacatacccatgggcaacctcctactcctcattgtacccattctaatcgcaatggcattcctaatgcttaccgaacgaaaaattctaggctatatacaactacgcaagaggccccaagcgttgtaggccgcctacgggcgtacctacaagcctgtcgctgacggccataaaacttcttcagccaaaggagcccctaaaacccggcacatctaccatcaccctctacatcaccgtgcccgaccttaggctctcagcatcgctccttctactatgaaccccctctcccctgtaccaaccgccctggtgcaactcagacctagggcctcctatttattctagcctagctctagcctagtcgctgtttgacctcatgtcctctggaatcgaggatgagcattcaagagtgctaacacctacgcctcgtgatcggcgcactgggagcaagtagcaccaaaactatctcatatgaagtcacacctagccacatgattctactatcgaagcattagctaagtaacgtgggtcttttagacctctaccaaaccttatcataacatgaagaaacaactctgattactccttgcatcatgacccttgggcataagtatgatctaatctccacagtagcagagacccaaccgaagccccttcgaccttgccgaaggggag

SEQ ID NO: 727994 - DNA, 654 bp, Homo sapiens
  misc_feature (633)..(633): n is a, c, g, or t
ttggtctccttgtccgtctgcgtttgtctgttcccgccctgtagctcttttcctccttccaggtgtttctgccctgtcctcttggttctcttgactgggtatctactcatgctcgtttgctccttgtccggcgctttttgctaccctgcttcctaatgccggtttccctgtgagctgtctcttaccatttttcttgcttgattgggttcatccctcttggagcccctccttctttgtactatgctcccggctagcagctccagcgtctaaatttgtctccacctaccttcctgcctcccggaagagcttcaagagctaagaacctgcctgcaagtacactgccttcgcaagtgcgagcaacccacagcccatggagattgcctctattgctaggcgagtttgctcaagccatgctctcttatcctttttctggagagtagtctagaccaagccaatttgcagaaccacattctttagttccacaggagagccccattcccagccctggtgctcccgtgccgcagttctatattctgttcaaatcagccttcaggtgttcaccacagcatgggcccactgctagacaccgagaatccaaagtgttcccgaatctaaatcatccatacagatccntacccatggcaatttgttttt

SEQ ID NO: 727995 - DNA, 139 bp, Homo sapiens
ccgggcgagattaaccctctccccggatttcagggccagcgagagctaccggacgcgcggaaacggacgtttcaaggcacggccctctttgggggaaccattcaggcgcctgtcctttcaaagaaaagagaatctcccc

SEQ ID NO: 727996 - DNA, 217 bp, Homo sapiens
ttacaatgaggttactaaaaggtcagagagtaggacttatggagaaaatttaggacaggcggagtcaccgcgttccccggggtctaagccaaagaggcaccacatggtttaaggaagtaatggggacgtcgagggtccttggggccaggcccttatggataagtgggggttccatgtaccagagttccttttggggcccaggggtcaactatgcact

SEQ ID NO: 727997 - DNA, 379 bp, Homo sapiens
  misc_feature (7)..(7): n is a, c, g, or t
gattggntggagcagcagcaaatacttcattgaaatagattataacagttaacaaagagactaaacttctaactcttctacaactgctgatgtaaacaacacttgtttcctcaaataaaggcctacctattgttgcttcaccattacctagaaagtactagtgtactctgcttaactgaccatacagagggaccctaacattcaaatgaacacaaaaagaaacagactctacagctgaatcaattcagttggccacctgaggtgtatactacttggggaaccgtgcacgttaacgattactaggactatgcagaaaccagagagtttaagaaaccgcattgtctacttactcccttccctcccactttctacctcccta

SEQ ID NO: 727998 - DNA, 388 bp, Homo sapiens
ccgcagacgcggccgcttgtagctcgtgtggggtctctggtccagagcgcggcatgtgcgtgctgtgcgcagcggcgcgctgtctgtgtccgcggtgcggaccgaatgagcaagtggaccagcaagcggggcccgcgcagcttcaagggccgcaagggccggggcgccaagggcattggcttcctcacacttggctggaggttcgtgcagatcaaggagaaggtcccggagttcgtcgtcccggatctgacacggttcaagcttaagccctacgtgagctaccttgcccctgagagcgaggagacagcccctgacgggcgcgcagctcttcagcgccgcggcgcctgtcatatggagcttaaggaccggacctttgaacctgccctgg

SEQ ID NO: 727999 - DNA, 337 bp, Homo sapiens
  misc_feature (337)..(337): n is a, c, g, or t
atttacttacattttctttgccattgcattccatatagcactaccatatctcccattgcaaaagtccactctcacaaccccctagagccctggtactcaaagtgtggttcatgaagcattagcattgttttttagtgtctggatctgccccagaccaactgaaccattatttcagttttagttagatacccagtatgattcacatgcacattaaagcttagcatatatggcaggcctctaatgaggacttgtgtattcttaggccgtttatatgtatatgtggaagaagtttctgttcacttttctctatccttcccacttaaacagtctcctgttn

SEQ ID NO: 728000 - DNA, 119 bp, Homo sapiens
  misc_feature (3)..(3): n is a, c, g, or t
  misc_feature (6)..(6): n is a, c, g, or t
  misc_feature (10)..(12): n is a, c, g, or t
  misc_feature (91)..(91): n is a, c, g, or t
  misc_feature (93)..(93): n is a, c, g, or t
  misc_feature (100)..(103): n is a, c, g, or t
  misc_feature (108)..(109): n is a, c, g, or t
cgnttntggnnngttgtatctctctgtttcatgtaactaagttattaatatatttcatttttagtgtgatgtaatgagagactgtgtgtgnangttaggnnnnaatgnnaactgtatgg

SEQ ID NO: 728001 - DNA, 422 bp, Homo sapiens
cgtcacaaagttacgcaattttgcgcatgagggagaaacaggtactctgtggatggggtcgagatgaaagaaaccatcatagccttggcctgggaggcacctgggagtaagtcggctgtgctggacgtagaggctccgaggatatctgtgtctttctaccagtgtcaaaaacaacgggaagattgaactcatcaagatgttcgacaagcagcaggcgaacaccatcttctggagcccccaaggacagttcgtggatgtagcgggccttgaggagtatgaacggtgccttagcgtagtgtggacacttcggactgcacggtccatgaccatcgcaaagaattacaatggctatccagatgtcgaatggggatcctacctggcgctacgttttcacctctgtgtcctggtggagccataagggg

SEQ ID NO: 728002 - DNA, 194 bp, Homo sapiens
  misc_feature (127)..(127): n is a, c, g, or t
  misc_feature (182)..(182): n is a, c, g, or t
tatgcatgtatcgactgtggaaagtcctttaggcagagcacccacctcactcagcaccggaggatccacacaggagagaagccatatgcatgtagtgactgtagaaagggctctaaccacagatctncccttaccatggaccagagacctcacactagataagcccactccacatgtgctgnggacataggaag

SEQ ID NO: 728003 - DNA, 200 bp, Homo sapiens
tagggggtgactcttccccctggggacacaggcaggatggctggagactgcgtcaccactacttctccagaggcaccaagcgaggccagaggcaccaagggagggcgaagtcgaaggccctgtgcgctagaggccagagtagatctcggtggacggagagcaacgtgcacgagggtggactcgccagctcacagtgatgc

SEQ ID NO: 728004 - DNA, 480 bp, Homo sapiens
  misc_feature (456)..(456): n is a, c, g, or t
gctgtctcaaactccagagctcaagtgatctgggccggccttgcgcctcccgaaagtactggggattacatggtgtgggccaccgcgtctggcctaacctgtagtggtctttatggtattatggctaatgatgttgctgcctgactgaaagaagtttctgccattgagatagagacagatcagtggaaagaattttcagtggagcgtcaagagattatactggatgggggagtggactgacatctatggtaagactttctttccttggttggtggccggcaaagggggtttcatggtgtagctgaggctggtctggaagggaactcctaatctaaaaggatccttccaactcagcctcccaaatagctgggattacaggcatgcaccacaaggccgggtttggtgattaatatcacaggttgacgggttgagactgagaaactcagtcctgtgttncagtatagaaagtgagttctgaga

SEQ ID NO: 728005 - DNA, 561 bp, Homo sapiens
cagagaatggggatttaaggttagcagagaaacttggaaagttctgtgttaggatcttgctggcagaattaacttttgtgcaaaagttttatacacagatattgtgtattaaattgtggagccatagtcagaagactcagatcataattggcctatttttctatttccgtaactattgtaatttccactttgtgtaataatttgtgatttacaacatataacatttatttatttaatttttttaattagttcaaaaatcttgtgctggttggtagtctggcaactctctaacaatggattggtggtgtgcttttagggatttgatccagaaggaaacacttccaaaaattggagatgacacatgttgggttgcagccagtttataacgtaatatagtctaacaaggcaaaacaaagtggctggccaccttttatgcatgattttcctaaatcggagaacacatttggcgctgctatccacaatagaacctttatgtttggttttcaggttgaaaacttggcctccttgtggcaacattcgtcaaatgaagcagaattttta

SEQ ID NO: 728006 - DNA, 919 bp, Homo sapiens
  misc_feature (219)..(220): n is a, c, g, or t
  misc_feature (223)..(224): n is a, c, g, or t
  misc_feature (229)..(229): n is a, c, g, or t
  misc_feature (252)..(252): n is a, c, g, or t
  misc_feature (271)..(271): n is a, c, g, or t
  misc_feature (283)..(283): n is a, c, g, or t
  misc_feature (299)..(300): n is a, c, g, or t
  misc_feature (336)..(336): n is a, c, g, or t
  misc_feature (347)..(347): n is a, c, g, or t
  misc_feature (351)..(351): n is a, c, g, or t
  misc_feature (358)..(358): n is a, c, g, or t
  misc_feature (360)..(360): n is a, c, g, or t
  misc_feature (362)..(362): n is a, c, g, or t
  misc_feature (368)..(369): n is a, c, g, or t
  misc_feature (374)..(375): n is a, c, g, or t
  misc_feature (379)..(379): n is a, c, g, or t
  misc_feature (382)..(383): n is a, c, g, or t
  misc_feature (386)..(386): n is a, c, g, or t
  misc_feature (388)..(388): n is a, c, g, or t
  misc_feature (393)..(393): n is a, c, g, or t
  misc_feature (397)..(397): n is a, c, g, or t
  misc_feature (399)..(399): n is a, c, g, or t
  misc_feature (415)..(415): n is a, c, g, or t
  misc_feature (422)..(422): n is a, c, g, or t
  misc_feature (431)..(431): n is a, c, g, or t
  misc_feature (438)..(439): n is a, c, g, or t
  misc_feature (448)..(450): n is a, c, g, or t
  misc_feature (458)..(459): n is a, c, g, or t
  misc_feature (470)..(470): n is a, c, g, or t
  misc_feature (918)..(918): n is a, c, g, or t
gtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggtaactggattcttgatctgagcgcagacgtnnttnntaaantaaatgaatttggaggaaatggngggggggtgggtgaagggnaaggaaagaggnaggatgagagattggnngaggctggagtatgaggggaatgaatgtttaaaggnaagagaatggngatnaggtggntngnttagtnntaaannagtnatnnttntnaaggnatantntgtagaatggaaaatntgtaaanatgcttgtnttagganntcatggatnnnagggggannaagagaggagntgagaagaaagaggtagctgagcctcggaacaaacatacctcgtccagcaccttctctgcccacagaccctgccctctattctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggtgagcaaagcgttggtaggcagtatatctggagacccgtacctaccctctaaaattaggagagccaaagccggggtgagaatcagtccttagaagaaacaagactattcttcgaggggng

SEQ ID NO: 728007 - DNA, 462 bp, Homo sapiens
  misc_feature (33)..(35): n is a, c, g, or t
  misc_feature (48)..(48): n is a, c, g, or t
  misc_feature (88)..(88): n is a, c, g, or t
  misc_feature (230)..(230): n is a, c, g, or t
  misc_feature (275)..(275): n is a, c, g, or t
cggcacgaggggcggccaccgtggagagcagannnggcggcttggaantgctaagtcagagccgcgatgttccggattgagggcctcncgccgaagctggaccggagagatgaaacggaagatgcgcgaggatgtgatctcttccatacggaactttctcatctaccgtggccctcctgcgagtcactccatttatcttaaagaaattggacagcatatgaagacagganatcacatatgaatgcacgatatgaagagcctgggttacaagtttncgactcctctcctgcaagtgaataggccccagaaaggtgtaagagactcttttgaatggacataaaattctgcttgttaagaacaaagtttggctcctggtaactgacccttcaaagctaaaaatataaaactatttggggaagtatgaaaccgatgtctccgtgatctggtgtacccttatccctg

SEQ ID NO: 728008 - DNA, 130 bp, Homo sapiens
accactgagcaagctcttcaattagggaaggaaatgtcccccatccaatgggacaaatcctttataaaaaattaagcccagaggaccagaaagatgcctggtttactaatggacgacgcatatacactgg

SEQ ID NO: 728009 - DNA, 592 bp, Homo sapiens
  misc_feature (592)..(592): n is a, c, g, or t
attctttccattttttattaattgaggcacttataaaagaggctcaatgattaaggaaatttatgatctttagacagggtgttggctttacaccaacgaacaagaaaaacagatgagtaagctttggaacttcattatctgttggttattctcatggaaggttgagatgcttttaaatgggatgttataagcctaaggcagctagactggcataagcaagttttttaccctgactcttaaagcaggtctgcttattgtaagcctgtgcgaactctatgtacgaaagctgcgaaactattcatgacagctttcaggagcttttttgttgcctggggcttgtgtttcacaagctcaacacgggcagtttgcatctggatattgttcttcttgtcagaaagcgtgtatatatgtgtctggaacgggaatgtttcacaattaaactttttgtgtacgtattgttgatcgcctttcaaagcatgcaaagggtgcccccctgttgaccaaggagtttcgagcgcatttggagacggtgacaattacaggagggtacttatgccaaacacctactggcttaggaaccccgtatgatagn

SEQ ID NO: 728010 - DNA, 441 bp, Homo sapiens
cggaccgccttggtcactggctagtctgaggtgatagtggtcgtaggaggctgtgagcgagctcggaggatttaatcttccatactacagagtgctacgatcctgtagcaggagaatggaagtctgtgggctaagcttgcatgaatttagcagatcagagtatgcagtctgtgctctatggaatgacattcgttgttgcaggtggacgaatcgaacagccgtgatgtctggactttataactcacagttgaatattgggatcagagtagcctctcgtcaataaaggcagatggcgtcacgaaatggctgtcctccttggtgacgtatatgttgtcggtggctatgatgggcaaaacagacttagcagcgtagaatgttatgattccttgtcaaatcgatggactgaagttgctccccttaaggaagccgtgagttctcctg

SEQ ID NO: 728011 - DNA, 821 bp, Homo sapiens
gacggtctagcgctgcgtgggccatggtgcagctccgaccgcgagcgtctcgcgcccgggtcggggaggcgatggtggacgagggccagtgcctcggaggaggagcgaggcggagccaggggctgtggctcggggcagcccagcagcgggcgcgtccggcggagccccctgggaggaacagcacgagggaagggggcgacgatggagtttgagacgaatgaagcgcccccggtgaggtaaggcagcattttccgcccaagcgggcccaaggggagcgtaagccgagcacaagaaggtacgccggacgacttggcggaaaaaccgggggcggcaggggtacataaacccggccccggaagggacaaacgagggcacggcgaccgccggaaggaccctggctcctccgcgccccgcacataacagagaacacccctccgtcgcgaggaccacttaattgggacgaacgtacacccaaggttcacgagaatgaacccttcagacacctcgccaggacacgggtgacccgacggtactttgggcaacaacagaccgccatacgcacgaccgaacaccatacgttgtccgcgacccgctatcccccggaacacccgtcttatgacacccctctgtgggggcgcggcgcccaccatagtggtatcgccacgtgcgacaccgcggaccccagagaacccggcgccacaacgtgccgtgcccccccccataaacacgccgggggacacgggggctcagaacaccccgacgcgcgaggcaccagggccacaagggcacagggctataatcgcagacgtggagcgacgcca

SEQ ID NO: 728012 - DNA, 800 bp, Homo sapiens
tctgctacggggactaaaatggaagcgttttgggggtcggggtccgaatttggggcggggggtccggccccaggaaagtttaaccgatttccatccattccgcgaattccttcagtggactccgggcgtcgtgcacctttacagaaggttccaattacacggcggacccagaaacccccatgtgtgtgaccgggaacctcagtccttcgggggtaaagttcaagggcgaaggtggtgaattgccgaaaaacatttcgtggaactccatagggacctccttgggacctcgttttcgcgaaaaaattcttcttggcatttagtgcagatctcaacaagcagatcaccagtggctggggtgtgccttcgtgggcagaaatacggcgtaatttctccagttatttggaaaagccaaaggttccctgcgggccaaaaagtgggtgtagatttgtgagtagaggagaagcttttgtgcgggaaatatgtgtgtccaccaacgtatatataagacagaataaaaagcatatatcacatttacaggtggggttgacccaaggggcgccatatgttaaaaaggccgagggaccatccgagacagcatgttgcaaacccctccttatgtcggggacaaaaccacccgatgagggtcacaatcacggagaagcacaataatgcatgtgaacacttgaaaaaagaaaggactattcacgtcgcggatcatagttgtggaccaacaagtgttctggaggacttgtgatacccctcttcaatagacgaccccccccttttccgacttggtcccc

SEQ ID NO: 728013 - DNA, 383 bp, Homo sapiens
tgcagcttggctcatatcaaatacccggagagctcttaaagacatttccaactgcccaggagtcaccctctgtatattctgatattaatgcatccttttttggtacttgtgcttcagtattttttcattttaatttcttgcatttactaaattttagtcttatatgtggcataaaagttaccatttttatcatttttaagtgtcacgtttagtgcctttcagtatcttaatggtattgtgttgctcgtcaccttctactctagtttgggcatttctgtatcccctacatggatatcccttgccccatcgtgagtctatcctcattttccccttctccctgtcgggccaggccccagctgcggcggtaccgaggctctcattcg

SEQ ID NO: 728014 - DNA, 574 bp, Homo sapiens
  misc_feature (254)..(254): n is a, c, g, or t
ttaaaccctgcgtggcaagtccctgacgcaccgccgtgatgcccaggtaagtacagggcgacctgggaagtcctaactacttccttagagatcaatccagactagttggatgattatccgaaatgtttcagttgtgtggaagcagacaattgtgggctccagacgcagatggcacgcagtatccgtcgatgtcgccgttcgcgaggaaggcttgctggtgcatgatggggcacagtaatcattcccagtgcatnggctgtccaacacggcgctagttcgcggccatgggcggccttatcctcgttgggggaaacattaggcatcggaatacctcccccaaaggtcgttccttggcgcaagaaaacatcttgcttggccttcaatattcccggcgtggacactgtggcgctcgtcgatggctttcagcctcacacgtggccacggggaacccccgagattctacgcgcttggaacggcaattccacacgcgtggaccccagtggctttctgggccttcggggccctaggagtttaccacggggtgggtcccaagggccgttggccttggtccccg

SEQ ID NO: 728015 - DNA, 131 bp, Homo sapiens
tcgctctgaacataatcatgtaaacggaagaagtcatcaaatccatgaaggaaggtaactgggtaacacttccccaaaacgtgtaaaggtaaactttgggtctcaatatctttctttttagacagtgtttt

SEQ ID NO: 728016 - DNA, 1496 bp, Homo sapiens
cgtgatgcgtgagttcagaaccaagacgttgcagagaggtaataccgtagaggactgacttcgaaacctatgcacgaatgatatctatcatggcatgaggaatatctggaagactagttccaagctactgatgcatcttcggtcaaatccggtgaagcaggatggtgaacattctaatgtagaccaacgaccctgaggagtgacgtgaggcgtcgcaagggaccactaacgatggccacacagtaccaggaagtagtgacacgtacagtagagcactctcgccaagagaggcgatgtagtgaagtgagtcctggctgcgtgaactgagtcatggtagctattgaggagagtcgagcgatgtgcataagtcaagaatccgtgcgcaagcaaggggtccagaagtcaaccatctcttgcgcaagagatcggagaacacgtgacggtggttagtacatgggaatcccaaacgtaagagctagcaaaaggtgttcggctgtgaccttaggcgcagggagtaccaataacgcggggaaacctttccgaggaattaccaatctcacattgccgagcgaaagacaggagcggatgagtaaacggtgccgccccaggcagtggtctcaaccgataaccgaccatgcgctattggggttaccaacaagcttttcgactgagcccgccaatttagaagcacagaaaaaggccgggaccttgtatgaactgtcccccacccaaacggaatgtggctctccgataaccactgggtaaaccttaacaatcggtgtcaactgacctctataccatgtgcctttacgcaccaacgtggagctccgcggtcatgatccatttgatgtacaacccgacagttctgttaggttacggcaccgggcggggacacatctatgtatgtggcacccagaggtcatcaagagagagtgcgcgcttgcgatgagccagagtgtagcgcacttacaagatttacgcatacacatggcgataaaagaggcctataactaaacaccccttaaggaggggagattaaccctataataacctttacgcccgcgagaagagggccttaatggcgtataccgcttccccaacgcgactgaccttttacgccccaaatgtggatttaatcggtttcacaggcgagatagtcgcaatgaacttacggcgcaccgtaggcctgtgagacggataataccaacgcgaggctccaacctaaaagaccgacaccataggaaagaacgcagctggctataggccagccacgcaggacaagacgtccccaaagagggaacccaaggtgcgatacgacgggcgaacagagtaacatctgcacaacgactagcagcctacagatttaaattcatctacgaccagagggcaggggttaaaggaacccacgacgttatagggggctcatagcgcgacaccgagaccaagggagacaagccggaccaccgagtcgcgcctgcaggccgaccaatcaaaag

SEQ ID NO: 728017 - DNA, 103 bp, Homo sapiens
cgcgttgggtgtagacctgaagcactaagatcaggcaacgcttctcccaaactaaactagtcaccatcccccaaacattcccagaatgtcccttccccaagcg

SEQ ID NO: 728018 - DNA, 173 bp, Homo sapiens
attattcttgacttaactctagtccccttgttgtgctatcaaaaactggatcataaacattctgtctaactgtatttttgtactcattaaccatcccccacccccaaacctcctgtataaaaagtaccgtattttttgcccatcaaactttgtaataaaacttggccctgtta

SEQ ID NO: 728019 - DNA, 314 bp, Homo sapiens
  misc_feature (18)..(18): n is a, c, g, or t
cccgcgcaccaggctccnggcatcgtcttccacccgttgggcttcgccttcgtgcaaacgcagcaggttgttcatgccagcgcctccacggccttggggtagacccgctccttgaacggctccaggccgatgcgctgcagcgtctcgacgaagggttcgtcgctttcccggtagcgtacgaaggtggcgatgatgcgttcgatcacctcggggatttcctcggcgctgaaggacgggccgatcaccttgcccagggcactgtcacggcccttggccccgcccagggtgacctggaaccactcgctgccgttctt

SEQ ID NO: 728020 - DNA, 602 bp, Homo sapiens
cccttactttggtcttcctccaggcgaatgaagtagaggccagtggcgtgtctgctgagtcgcaggatcagactacgtgcactctgaagcaggtgcaggcccagttgtcacctctccagaacatatacccatggattctggcggtattgactctttcagattcagaggtagggatcattctgacttattaaagagctattataccagttaattccatctgtatgatgcttgacatacccttaatagacagatgagggttgaacgttagtaataggaggggtatggaggtgaaacattcaactaccttcctagttccaggtaatataagaacatggcgtgcactgtagataaatgggtctggtgggtcccgaggtcatcttatcacattaatgactaatttcacattatggaacccagtaccaaagtgttccagttagatatccccatagtattctgacagttgtacttcatttactttttaggctcttacagtctgctatcctgttgggcattctaggaaaaattggaaccaagtatgttcttcaaattaccttacccagagactgccagcctggaggaagctcccagagggtttaccagaa

SEQ ID NO: 728021 - DNA, 318 bp, Homo sapiens
cacaagaaaggtagctagtactgaagtaaaacaaacaatacctgaatactctgtagcctaaactccaaacatcctcttccatataagatccactggctggacaaactgcaccagttgctacttcaatttatacctcaattttcactgtgtccaggtagtactttggctcgttggctacattaaccttctctgtccgcagtgtgccacacgcacaacctgcaaggggcaaggcaaatagcttgggtcgcgcactcttcatggtgacactcgcagtcgggcagcacaagtgtcatgcaataccttagtgccagttatttg

SEQ ID NO: 728022 - DNA, 203 bp, Homo sapiens
ggcattcgcgggtcgtgcgtcggaataggcagggaacatctgcacggtgaatggcaattcaaacgccttgcccttctcggcggcgtcaactgctccagataccaggacttgggcgtgcgccagctggatcttccgtcggcgtgacgctggaatagccctcgatcagcgccgtcagcaattggcggcaggcgcggggtagagcg

SEQ ID NO: 728023 - DNA, 804 bp, Homo sapiens
ctcagggccggtattagccatggtctgggagggtgctgaatgtggtgaagactggcgtcgcgagtcatgctcggtggagaccaaccctgcgagactccacagcctgggcaccatccgtggagacttctgcgatacaagtccggcaggaacattatacatggcagtgattctgtggagagtgcatgagaaggtagatcggcttgtggtttcaccctgaggaactggtagattacacgagtctgtgctctaggaatctggatctatgaagtgacaggagggcagaccacagttgcttgttgcagctatccagtttcccctccttcccagtggggcagagtgagccaggctgtcacggaaatctagcttattgtacaggaacttcatcataattgtgtgcacgggaacgcgtcttggagcatgtgagttctccctgtaccgtggttgaccatccccgactcatctgacttaaatagtgcttcctcccagcataggtcaacaacatgtgaattcaaactcaagaaaaagtgatcccgggaaatgggggccttcgaaagcgtatttcacagcgctgttgagaggactgaggtcgcacgagggcttcgtgacacggtcgtcagcaaggaggcacccagggaacgcggggccctgagaccagggcagaagaggattctgcctgtcaacaaaagacccccggggagcatcgaagaccctccgagaagctcggcgtgagtgtcaaggagacactcggcttcagcacacggtgcgaaggtggtcccgagtcaagcagccgcggggtggtggatg

SEQ ID NO: 728024 - DNA, 509 bp, Homo sapiens
  misc_feature (37)..(37): n is a, c, g, or t
  misc_feature (75)..(75): n is a, c, g, or t
  misc_feature (132)..(132): n is a, c, g, or t
  misc_feature (164)..(164): n is a, c, g, or t
  misc_feature (229)..(229): n is a, c, g, or t
  misc_feature (266)..(266): n is a, c, g, or t
  misc_feature (275)..(275): n is a, c, g, or t
  misc_feature (280)..(280): n is a, c, g, or t
  misc_feature (402)..(402): n is a, c, g, or t
  misc_feature (411)..(411): n is a, c, g, or t
  misc_feature (418)..(418): n is a, c, g, or t
  misc_feature (508)..(508): n is a, c, g, or t
ttatcctgtgcagccccaaactgggaaagaagatgcnaaatttaaagtggaagacgctgaccggaaagggagatntgaagatttgaaccatttggaaccttaaccagaccaaagggtgggaagcccgaaatncaaagggaagccgttgttgggaagggaagagnagggggaaattcccccccccaccaaaccagccagaggggcttccattcttaccagtgggccaaanccagattgaaattggatgaaggaccagccagcttggntttacaagnttttnggtggtttccagttcctttccaccttggtgtttgggcttctgagaggaaggaagtggttcttaagccagtgatggacccctcccattttaccttcttttacccctgtcgctccattaatganggcctccanatatccnctcacttcttctggggaccacccatagccaatgccccccttccccttgggatgcccccattaatgtatgtctaactggttggggactgtng

SEQ ID NO: 728025 - DNA, 328 bp, Homo sapiens
cccctttttttagtgaggggggggttagggtttaaaaaaagggaatttggctcaacttcagttgagggggggccgccccgccagcttgacggttttttaatgccccaaaatgccctgggggaacccccctgggctttttaggaacccgcccctggggaaggcatgttccccaaaaggtttttgggggggcaaaccccccccgtaaaccataatggttcatgaaaaaaactgtttttttatgccaagaaatgaaaattttaaggccttgttaaaattactaatgggcgcgggggcgggcccttaaaaaaggtggttttttgggccccca

SEQ ID NO: 728026 - DNA, 705 bp, Homo sapiens
  misc_feature (65)..(65): n is a, c, g, or t
  misc_feature (145)..(145): n is a, c, g, or t
  misc_feature (201)..(201): n is a, c, g, or t
ggagacagcaagtgtcggatccgcaggcgcagccgtgcgatgttgtcctctacagccatgtatcnggtcctggcagagacttggggatggaaccgacagagccgcgggcctttgcagctgcagattttcgccctacgtttccaancggagggtactatactggcaattgcgctggagaagattttgcaatgtgtgcttctngatactcgatgtgagtgaaagggtttcccaatttcatacgcgggatagccccaaaatgttacaaatttaccagacaaaaacagtccattggatgcagccggttccatggagactgtcttacgctgacaaagattatgtggacggcaagactaaagatgtattaagcattccaataataacggccatgactacggggcgcacatttgctgcaaatggttgtctacaatccttgtattccaggggcgctttttcccatacttattgtttaccaacattcatcggtggactttgatgagaagaaggaaaaggggggcctgtataacagcttttggatcccagtagggtcttacccagagagaactcccttcaaggctggaaggcctcagcaatgtgccatggtaacagccctgtttggacaacccaggtgggtttaacagacccttgcagactgggggagcatggtccggtgtccttggcacaacaccccatgcggtggtgacagtg

SEQ ID NO: 728027 - DNA, 842 bp, Homo sapiens
ggaagaatgcagagtataagagatacctagagatgctgcttgagtaccttcaggattacacagatagagtgaaggcctctccaagatcagaatgaacttttcgggaagattcaggctgagtttgagaagaaatgggagaatgggacctttcctggatggccgaaagagacaagcgagtgccctgaccacgatgctggagcccatcttgacctctctgcgattctcgcatccatgggaggagttggcttcatctgggtgtggagcagattgaaaatcgtgctctcgttaggcttgtaggcttgaaatgtggcgggtacgcctagaagagcgagccgcagagactgattctagttaccaaaggaaagtccctggagtcgactgtgatacctcttggttggccaaaaatcccaagtcaaagggcagccaatgcgagacacctgagaaggaacaaagagattgcttttctagaagcccaggatctatgaagtatgtagagattctcggggaacagcgagatctcactcatgaaggagtgtacagcgcaagcaagccaggacaggagaagagcgagaagaatgaggaagaagagcagatcagtgagagtgacgagtgaagatgacagagaaggagatcatgtaagaagcccaaaaagctgcaattggctgggattgggagagctatgccctaatgggtgtataaagctttgtggctaaatatcaagtacaaatgtgagatttgtggaaaataacaactaccgagggccaaagcttccagagaaactttgttgatggggtcatggtcatggcatgagggttgggtcccaaaatggcacttgtatgtga

SEQ ID NO: 728028 - DNA, 281 bp, Homo sapiens
caagagttgctggaggagagcacttacgactggatgacgtcacgaaacgcatactgcagttcatgacggaaccagcaccgggggtccacccagacacgatctcgttttatgggccctggtggtaagaacaattggttgcccatgcaggccgagcggttactcgctcacactagaggcagcagtgggactatgccagggacagtgaccgtcggaacaacggggagaacaggaacgaccaatggtaagagccacacgccactggacaaaagaggagagagtaa

SEQ ID NO: 728029 - DNA, 109 bp, Homo sapiens
tcaggctcggcccagtgtgtcacgtggacttccagagggatgggcgaaaaggctccatctcagtgaatagtcgcagcacgccgttcttgtgccactggagacagcgaga

SEQ ID NO: 728030 - DNA, 133 bp, Homo sapiens
  misc_feature (1)..(1): n is a, c, g, or t
  misc_feature (124)..(124): n is a, c, g, or t
nttggaggtgtttcacacacacacacccctgccttgtatgctgtctggctgacaaaccactgctcacatagccaaccctcggagcagtaattccagacagataagtggggttcggagtcgctcntggaatgtt

SEQ ID NO: 728031 - DNA, 109 bp, Homo sapiens
gatgaaatatgtgatgctcatctggcaaatactgccatgtgagacctagtcctgcaggcttccatggatgagaacaacatgcaacaacacttgaagcaacgtgcatgtc

SEQ ID NO: 728032 - DNA, 792 bp, Homo sapiens
  misc_feature (483)..(483): n is a, c, g, or t
gagataatttgcgggtgtaaatcaggttgcctggtatcccattctactttgcagcataggccatgcacttactacgtaagcctggctggtccatgcggtttcatgctagcagtttgactgtcacaccagtccattgtgccctacatgcgacggtaacagcgggttactaaagatctttctgcatgcggagtttcgtgctgagagaagagtcacgtattgtcttgttgtacagaagaagcccatgcagtatcaccaatgtggatgaaggttttaggtgtggacacagtggtccctcgcttaatcgaatgaagcatcactgaccttgggcttcatggaagaacaggcccagctctggggctgcgtttggatttatcgttttgattgccacacttctctacttggtctcctggaagtttttaccacatgtaacagatgtcctttactatgtagctgaaaagcgactatatctgtagaaaactgtcnaggtcaaaatatgtgaacggaactgatgagcatgtagtccagtctgtggttccatggccgtttgctttgtcttggggtttatctgctattgaagagtatataccaactatgtatatccagttaactgagagaattttgatctctggtaataaaagtgcattaagtttttgattttgtagaaattagcttttgtctaggcaactagtggttatactactgctaaatagttgtaatgaatgtgtacttttttgatttttgtaataaaaattgggtgcagataaaatgtcaaatgaacaaaccagtacctcc

SEQ ID NO: 728033 - DNA, 635 bp, Homo sapiens
taatattcagtatatttgggcatgtatttgcttaggttagtgtttggaaaatcaatactacttagatcagtatacataaagcacaggctttttaagtttaggcgatatgaagttgaataaaagatgctccaagagaaactgacaggataattgacacggtactagctgttgcatttcagagaagcaatggctagattgggttgaagacatggtacctcattagtgttctaatttctgtttcctttatggacacatttttttctcatatgcaggtaaggattttatattttctgttgtctgcatatatctgttattctttgggccggtgggaatcttaaggtttgttctaagtcagcatatagagaagtcgtaattacagtttaaggggtgtgtgtgtgtgtgtgtgtgtgtgtgtgtaatatacatgtgtgtgcatacgaagagagagaaagagtgcgggggtccttgaaaggatgcgtgtgtcgtgcacagtagtacattcctaccctcttggggtaacgagcacccagttttacgtttagagaacccatgatgtgtgtgctatgtccatcctatctaggtatgttagggtgccgtcaatattggatagtggatcttcgggggcatagagatgg

SEQ ID NO: 728034 - DNA, 215 bp, Homo sapiens
gcggatcttatgaagtatgtcaaattgactgaaccagattcattgccatagaactgggcacccactcctgctgaagagctcagtgaattgaaactggggctttccagtgtaatgaagaagcactactacatctgaatatgtgataccaatatcaccagcattcctcaaggtcttcctccttaccttacggacttacatctagatggaaaaaaaaa

SEQ ID NO: 728035 - DNA, 84 bp, Homo sapiens
  misc_feature (71)..(71): n is a, c, g, or t
gagagagatgaagggtcttacgagagagatgaagggtcttactactgtgcctgtgacacccctgggggatnctctcctgggaca

SEQ ID NO: 728036 - DNA, 369 bp, Homo sapiens
agatgattgaagtgatgtttgttaggctgaggtcaggtttgattttgctgggagccttccttgattctgattgtgtcttatcatttgtttgtcttctgaaggttgtggaggaggagggaagggttcatagaaatgccctgggtgtgatcccattgttgcaggttgtaatgtctggccacgtttcctcctgcggtgtctgattggaacttccactctgatcaagcagcaggagcaataaatagctaggtctgtgcctccctttctatgtgaagctagggaaaggactttatgagctttaagcggtaacttgatggaagactttacgcctctgcacatactgtcagatgctccctcagaagagaatgacaa

SEQ ID NO: 728037 - DNA, 543 bp, Homo sapiens
ctcttgtattacattccattattaaattctggccctattcccaattgttagcatctggctgatattaaggtctttgatgtgtcacaatattctcaataaatgagacattctgaactgcctggtgatattttcaaaaagagcaattaaaatgtgtattccctctaatacagctgatagaactgttgtgttaaagcaagttggaaatttgcatgatagtgtggaaaccaatggaggtccaaaatattaatcatatctaaaatatcagaaaatatcaatactagtcttctttatgcatatttttgactttttaagagggcttatgaattcaatgtttcttctgaggcaatccttttaatgtaaatactaaatacttgcatgtcttttgacaaaggctaaactacaatctattaatatgcacatttttgataaaatataaagtaccctaattaaagaaattgtggtagaaggtgtatgtcctgaatactatacctgtttaacaataccaaatgttaaataaaaatagtttgaaattaatgtttaaaa

SEQ ID NO: 728038 - DNA, 168 bp, Homo sapiens
gtgttaaaattcggagacttcattgttctttcctcttcattaacaaattcttctacacgggccctgaccagctctgccgtctagtagcatctcattgcggttccgtgcacagacattacatcgacgtgacttgccttttctgtcattggtctctctctgaacgactct

SEQ ID NO: 728039 - DNA, 322 bp, Homo sapiens
gatagcttatagtgacgaaggaagtaccacaaatagatgaggaaagaaaaacttattcaatagtgttaaaaatttgctttatatttgaaaaataaaatcactatattttttaccttaaaccttccttaaagtaaattgaatagcacagtgttaaaagtttttagataaatccattaaaaatgtttagctttaaaggattatctggaaagagaaaaaaataagcataaagcaaagcaaacaattgcttttacaaatattagatttaaatgcacaatcattaatatttttggaatgtttagaacatctggagcaagcagaggtt

SEQ ID NO: 728040 - DNA, 134 bp, Homo sapiens
tcggaacctgcgatattcggagcacacgctctactccaggtatcttcatgaagccataccccccatgatttggatgattcatctgtcacttccacggtgctccgagccaaagattatggctgatggctggctct

SEQ ID NO: 728041 - DNA, 361 bp, Homo sapiens
atacccgtagttccttcgattgctatcagtttccactttgaatattggactcgactatgcatacgtaccgagaacataatgcgactctagtgtagacaggtatgctgttggatttgtccgaatcctgcaatgctttcattactcctttgatattggaccatatgcatagtaccgataaactagtgcgagagtattgatcaggtattgctgttagatatccccgagtccttcaatgctatcattccctttgatattggaccatatgcatagtaccgagaaactagtgcgaagtagtgatcaggtattgctgttagatatccccgattccttcaatgctatcatttcctttgatattggatca

SEQ ID NO: 728042 - DNA, 834 bp, Homo sapiens
ggccgggcacagtggctcatgcctgtaatcccagcactttgggaggccaaggcaggaggatcgctggagcccagtaggtcaacgaccagccagggcaacatgatgagaccctgtctctgtcaaaaaattttttaaactattagacctggcagtggatagcgcacgcctgtggtcccagctgctggggaggctgaagtaggaggatcatttatgcttgggaggtcgaggactgcagtgagtcatagatatgtatagactgcactccagcctgggtgacagagcaagaccctgtatcaaaaacgcaaaaacctgggaaacagtgacagtatggctgtaagatctcatggttcacgtcctagcaagaagcgagaattctgagatcctccagcaaagtccgagcagcacacacctacaacctcggggccagagtctcaggccttaccggggacctgccgagctggaactaactgtggagggctgcagcgcaaggcatccctgggcgccacagacgagacgagccaggacagggcttcggacggcacaagctcagcgcaggccaggcactgatgtggcgaggggccactaccaaggacagctggcccaagaccaagtaccagacgggaagccctgaggcagaaagagaggagagcagacggaacggcaaattgcaggaagaatgatcaagcgccaaacagagagtagcaagcgaccggggcaacccggctacacaacgatgcacggaaaccgaagagaagagggaaactcaaaaaggcgacaaacagacagaaacgccgacaaaacacatacaacacaaagaaggcaacgaggaacaca

SEQ ID NO: 728043 - DNA, 292 bp, Homo sapiens
  misc_feature (38)..(38): n is a, c, g, or t
aacagagaaataagttcaaaacttggataaggttgatnaataaaatgtgtgcacatttcctagagatggggtacacatttaatttctgagcagttaaggcaaaaacaataatagtatccataagtgaaaaacagtttagcatacttaatcctgggactaagaccagagaagaatttctcttacgtttctttttaccagagacaggataaagtagtgaactatgtcctcaacaacatttgctaagtaacaacaacaacaaaataataatgagtttccataggggtgaagtcct

SEQ ID NO: 728044 - DNA, 106 bp, Homo sapiens
tacagtcggtcctttgatttcatgtcaggcatcttgaatttgaaaggccccaaggtgaaaggtgatgtggatatttctcttcccaaacttgaaggggatctgaaag

SEQ ID NO: 728045 - DNA, 986 bp, Homo sapiens
  misc_feature (5)..(5): n is a, c, g, or t
  misc_feature (107)..(107): n is a, c, g, or t
  misc_feature (109)..(109): n is a, c, g, or t
  misc_feature (151)..(151): n is a, c, g, or t
  misc_feature (154)..(154): n is a, c, g, or t
  misc_feature (163)..(163): n is a, c, g, or t
  misc_feature (167)..(167): n is a, c, g, or t
  misc_feature (173)..(174): n is a, c, g, or t
  misc_feature (178)..(178): n is a, c, g, or t
  misc_feature (214)..(214): n is a, c, g, or t
  misc_feature (251)..(251): n is a, c, g, or t
  misc_feature (275)..(275): n is a, c, g, or t
  misc_feature (449)..(449): n is a, c, g, or t
  misc_feature (479)..(479): n is a, c, g, or t
  misc_feature (489)..(489): n is a, c, g, or t
  misc_feature (507)..(507): n is a, c, g, or t
  misc_feature (520)..(520): n is a, c, g, or t
  misc_feature (536)..(536): n is a, c, g, or t
  misc_feature (543)..(543): n is a, c, g, or t
  misc_feature (547)..(547): n is a, c, g, or t
  misc_feature (555)..(555): n is a, c, g, or t
  misc_feature (563)..(563): n is a, c, g, or t
  misc_feature (582)..(582): n is a, c, g, or t
  misc_feature (587)..(587): n is a, c, g, or t
  misc_feature (592)..(592): n is a, c, g, or t
  misc_feature (594)..(594): n is a, c, g, or t
  misc_feature (604)..(604): n is a, c, g, or t
  misc_feature (607)..(607): n is a, c, g, or t
  misc_feature (611)..(611): n is a, c, g, or t
  misc_feature (637)..(638): n is a, c, g, or t
  misc_feature (671)..(671): n is a, c, g, or t
  misc_feature (679)..(679): n is a, c, g, or t
  misc_feature (691)..(691): n is a, c, g, or t
  misc_feature (695)..(695): n is a, c, g, or t
  misc_feature (709)..(709): n is a, c, g, or t
  misc_feature (714)..(714): n is a, c, g, or t
  misc_feature (738)..(738): n is a, c, g, or t
  misc_feature (742)..(742): n is a, c, g, or t
  misc_feature (754)..(754): n is a, c, g, or t
  misc_feature (761)..(761): n is a, c, g, or t
  misc_feature (812)..(812): n is a, c, g, or t
  misc_feature (828)..(828): n is a, c, g, or t
  misc_feature (838)..(838): n is a, c, g, or t
  misc_feature (849)..(849): n is a, c, g, or t
  misc_feature (881)..(881): n is a, c, g, or t
  misc_feature (967)..(967): n is a, c, g, or t
aaggnatatgaaattgacaagacactatatcaaaaaaagatgtgttcggacttcactgatgcgatggtaggtcttttgggttacaatagatagggatgatataaaananaatcttttcctgtctattccattttagaaactggtgggtgtnctnacgtttgtntggncattgnngcantgaaaaaatacatgaattaagcaaagcatcggaaantattgacacatgagactaaaataaataagagaaacgngctgatctttataactagaaatanatggaaattactgaaaaaaattaaagtgcagaggttttcattttagcaccatgaattgtgatgaaatcccatttctctcaacataatggcaggactgtatgcagataaggaagcatagagtagatgatgatattagaaggcaaatggtagaattttttgcgttcaaaaaacagnaaggtcaatggttaatcaatttttagaaanaaatggggancaatagatgaaataaagntctggtaaaacantttccttcatgttgcntttttcnttanggcgagantatttccntgcaattgtgagggggtanatagntatgngngaaaggtacnttnattnaggtagagagaaaaatccaaagatcnntaagtccccttttggccatcgtgaaatggcgtngaaatttngcgtcaatagantccncattgccaatcatngatcnaaaggccatgaacccagggcggtncaancccaataattcntgaacgnaattcagggtttccaaatattaatttttctaggagttggcatgggcaattntcaccatacaaaatcntgcagtaggnagggtccaggncaaaggtgcagctttttcttctccgtttgaanatctcccgtgcataaggatcctaaatgcatgcttgtttgcctgctggctgttctcacagaacaatttttcttgtgtcctctttcanctcgattatctctcaaaag

SEQ ID NO: 728046 - DNA, 425 bp, Homo sapiens
ttttattcctttatttgcccacccacatcctgctgattggtgtgtttacaatcctctagctaggcagaaaagttttccaactccccacccgacccagaagcccagctggcttaaccctctcagatcctgctcagggagtttagaatgaagaaggcagaagcaggagactagccaggaaggcggaacaggccagacagttctgcaaactcacatgtaaaaaacaaggtgggaggaaagggagaaggtccaaggtaatttcccaaaaagggatgccggtcttggagatgggtggatccatattttccaaaaaccaaggtggaattctttattgccctttcaaaaatttaaggtttaaatttaggggggggagttttttcaaccaaggatacatgatccttttttgggggtaggggacaattaaagct

SEQ ID NO: 728047 - DNA, 189 bp, Homo sapiens
gtgccggtacccaacaggagaataatctggtcttaagtttgctctgttttagacaaatactttacatgactgatgtaaactgttgcatagttgggcaaaggttttctcattcattcctgaaattctccatcattcacaaacacaaattgttcaatatatggggaagtcaaagccctttgctcagaacag

SEQ ID NO: 728048 - DNA, 152 bp, Homo sapiens
tttttcaaacggattagtattagatctttctgtattagaaaacatgcccttcatcgtgtcaaatgctgtcatctgcatagtgcttttttaaagtgttcttacaatttcctttttttttttttttggaaacattcccacctggttggcgggga

SEQ ID NO: 728049 - DNA, 320 bp, Homo sapiens
gaggaggtcacatgagactaggggcacgtggttcttcaggacgagacgtgcagctgtcaagctctgtctatgcctgcgcatggtgcttgaagctgtgtttccatggagctgttaagtaggggcttggaggctgtggcttgagcccagagagaaacgtgagcctgtctgcgactcctccctgatggctgcctccaccgctccctgaggatggcacagagtgcacttcctccccatgcacagaggagagcaaggcctagagcccctgtcatgtccacagcagactgaggggagttcttgtctgggccaggcctggtgaccat

SEQ ID NO: 728050 - DNA, 1354 bp, Homo sapiens
gggctgactcctgaaggttgatggccgtcaccaaacccgtttgccttggcttccaccacagcccacctctgcttgctaggggaccttatggagactcacggggctctgggggaaggatgtagacattctgctctcccccagtccccgtcccacacacacactccttcactcagctgtgctgtgaccccacccttttctttaatctgtgttctcttctctcccttagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccacgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactattttgattcttcagagagaactactaataaaaatctaaaaggta

SEQ ID NO: 728051 - DNA, 218 bp, Homo sapiens
cgatttattttacaagatacctggagcccaaacttagggataagacccctgggccctagtctagtaagaggcagaaaggaggaggggcagtggagaaaatagggacacagtctgaaacttctgcctcagtagctaagggtccccaggttcctactgacactatgggctcctaggacatctacacataagcatcactggggataccttggcttgtgact

SEQ ID NO: 728052 - DNA, 210 bp, Homo sapiens
gtcagagactgtggtgggtcacgtgtgtctttggggggtcgcgcgctgaaggttccttcccgtctccaggtgtctgcggagcactccaggcacaggccctccaggtaggctctcagttgctccgcttcaggggccgcctcccatttgcgctgcgtgatctgagccgcggtgtccgccgcgacccaggacgccaggtcctcgttcagggcg

SEQ ID NO: 728053 - DNA, 4511 bp, Homo sapiens
  misc_feature (61)..(61): n is a, c, g, or t
  misc_feature (83)..(83): n is a, c, g, or t
  misc_feature (95)..(95): n is a, c, g, or t
  misc_feature (127)..(127): n is a, c, g, or t
  misc_feature (4284)..(4284): n is a, c, g, or t
  misc_feature (4311)..(4311): n is a, c, g, or t
tggaagtaggacttcaacatggcggctgcggcactggcggtggctacggtgacggcctggnccggagcgggcagaagttgganggtggtggcgtngctctccctaggggctgtcgggagctcagcgnggaccgagcctgggaggccggccggtgccagcacctttcggcttctgagacggcggcagcagcggcattcaggttctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactattttgattcttcagagagaactactaataaaaatctaaaaggtatgtcttggtgtgataacttctttattaccaaggctgttttatgggagtgggggggccatgtggtgtataaagagatttcttgcttagatttgctggggatagaataggacctaaccgttttctatttcggagctttcttcccacttcagacctgtcctcgtttttggtttgcaaaggcaagcctagactgagtcttttaaacctggcccagctccgtctgtggaccaaggacgtaggccttcctgactgtggagttgggataggctgggccttcagggggatcacccagtaaaagaggaagaagcccttttactgtgagcagcaggcatttatgcatcatttgccacaagcagaggatgggatttaaactgtttcaccagctctcagtggtgctgttgtatatgatgatagaatagggttcattcctaaagtaagtaagtttttgtccttgaccttaatactgtgccattgtcccacttgagcttttggctagactgggtctttgaaggtttttagtgatcatgtgagggaggggccgcagtgccctgcagccgggaagcaccaataaggatgccccctggcggtcagatgaggcactgtcaggctgacaaagggtgactggaccaggctgctagtgtctcaagagagccatttaaccctcttcttgccttttaattaagccctccttttaaaaccgtaaaaagttatcctttatctgaaggaaataaaggctcacatagtaatgggcgttcggggccaggccgtgactcatgaatctccatttgacccaagagtggcttcaaagtaattggcacctggaggctactttgtcttccctgtcctgagctgcttcctgctaaaaagatacacagcaggcagaacttggctgaaggtttgtgtgtgaattctgtttcagaggcctcagactgttgaacagagcactctgttcaactgccaaggttcccaacacagacccctgagaggcagggtggctgggcagggtgaactggatgaaggccaggctaggagatggactattccatgagggggctgggtagtgaggtgtcccagataggagccaggagctgccatggaagcatgagagtatcggcatgtacagagcctttcacccgagcaaaagtcaggagaaaattgatgtgtgacacaggcaccctcttctgcctcaacactggattgcaggaagggaagggagctgtaaatataaggcctgtctcacatctgctgctgtcagtgacacatcaagtcaaggtttatgctatttacattttcaaaacgcctctgaatccccaaatcaatctccaagggctgatggggcagagctcaccccacccctgtccccctagcaccaatggttaagtttgggccagtgtttagtcttctaagttaggcacagaattcagctggtgaagcctctggtctcagcatgttgtcttctctgtcttgtgacctctgacctctaggctaccactgaccaccccatcctctgatccccaaacttagaaacttcagggttattagacccaaatatattcccacaggcaaggggttagttaatcatattctctaggcacaagggaaaggcattaggttcttcggcctggcccacccttggaggcactcctgtgcatggaactgagggacaggggcctgtccctgagggagaagctgggacctatctgaagccacgtggggctggggtgacgctagcataggcaggaccagcgtgtgggttctggtgtgtgcagggaggacctggcagaggctcctccagcctgagagcccagcacagactcctgcagggcccccaccatctcggcacagggtctggctctaagacggcactgtnccctcaggggctgcggtgggcccgtgncaggtgagatagagctgcagctggctcctcagactctgggatacccttggatttcagaaccatgattcatccagctgggtcacaaaatcttcaaaatcattagaagccagctggctcatcagcgtctcctccttgagccgagatcagccattcatccagctgttcctggtgtgtcggattgacactgttggcttgtccag

SEQ ID NO: 728054 - DNA, 1815 bp, Homo sapiens
  misc_feature (1252)..(1252): n is a, c, g, or t
  misc_feature (1377)..(1377): n is a, c, g, or t
  misc_feature (1423)..(1423): n is a, c, g, or t
  misc_feature (1762)..(1762): n is a, c, g, or t
  misc_feature (1767)..(1767): n is a, c, g, or t
cccgtgattgtgtaaagcgacagagatggaatgagactactatgaaacggattagacactgatgagaaaggccatagcaaccacagggacgagtgagagaatcgcgaagaatgcagcgtgatgcggtgaaaagacaagacataaaacaacagagcagggcgacatacgaaaaaggggcacgaagaacgtgaaagacggcgaccacaggacaaccggggcttagcacaaacagcatagcatacggctagctgacccactgagagaatagacagcgcaggaacggcatcagaccgaccaatgccacatgaagaacgagaccaaaggagagagaacagacaggatacatacacaaggttgaaccaccaaagaaagtcaaaacaaaaagcggaacaaaagaacaaagaacaacacagaatacaaagaggaagccccacaagcagaaccggcgctcgaagcgcaaaagactggcaccaaacagagacacaatagacaaaagaacgaaccaccagcacaaaagaagacagttggacgaagacgcacacaccagacgggagaacgagaggacaggagacagagtagaatacagaaagacaaaacaaagagaacgaaggacgcagaaatgagaaagataacacgaaaccaagaaagacacgggcacagaagcacaaagcaacagaacagacagacgaaaagcaaacatagaacagacaccacaaagaatcccacacaggaagagcacaacaagcacaacaataacatccgcacatagaataagaaagaagaaaatacacaacgagatgaaagcaacaatgtcaaaaaggaacaacgaatgagaaaaacagatggcgagagcaacacatacacaccaatatagaacatgcaaccacctacacgaaatagtaacatagggaagaatataagacaccaacaaggagtgaagaacaacaagacacacatgagacagaactacaagacaacaacgcgaccatacgcaccagaagctgcacacaaccaacgacacgagtcgacagagaaatgaacagcacaaagatcaacacacagcagcagcaagaaacacgaccacgcgaacaccagaaatcagataagttagcacaagatcaagctggcgaacagtgaacgacagcacagctcgagatcagctaaacataacactgaacacgacactaagaacacataggacgatcaccacgccagacacaaaagcaacaaagcatagatgggatcaacaganagatgatgacaacacacatagcagaatgacagacgacacacagctcgaagaacgacgacgacaacaatgtacagatacagcaacagacagagaagccgaatcgaggaggcgaccactacacacanacgacacgagcacccatagcgcagcactcatcatcaacagcagaancacgatgcacgaaacagcgcaagatacgatacgagagactcagtagtctgaccagaccactagcatatagtagcacatcatacagcaagacgccagaactcgcgaacgacagagaacagaaaatgaaagacagcaggaaacagagacaagacaaaccgatggaggctagagacacaggacgagacagatagatacgataaatcaccgcacaactcagacacacgagagacagcacgatacatagaatagtagatagcaacgagacagcgagacacatagagcacagcgcgagaagacctagtgtagatagcgaacaacgagcgcggtagccacagcgancaccncagaactagagagacacacacgtcaaccgacgacagagacaacacgga

SEQ ID NO: 728055 - DNA, 124 bp, Homo sapiens
atcttgaattcttgcttaattggtcagattgagcttgctgttgcccactgatgttgcttgaatgacccattgtgaccaatgaacaatgctgggtgtgcttggccccagacagctgcagctggta

SEQ ID NO: 728056 - DNA, 505 bp, Homo sapiens
caagacccttggcttggtgaaaatgcaaaaggagagtctggccaatctacaaatggagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttca

SEQ ID NO: 728057 - DNA, 324 bp, Homo sapiens
  misc_feature (4)..(4): n is a, c, g, or t
  misc_feature (82)..(82): n is a, c, g, or t
  misc_feature (91)..(91): n is a, c, g, or t
  misc_feature (94)..(94): n is a, c, g, or t
  misc_feature (97)..(97): n is a, c, g, or t
  misc_feature (106)..(106): n is a, c, g, or t
  misc_feature (156)..(156): n is a, c, g, or t
  misc_feature (162)..(162): n is a, c, g, or t
  misc_feature (168)..(168): n is a, c, g, or t
  misc_feature (207)..(207): n is a, c, g, or t
  misc_feature (230)..(233): n is a, c, g, or t
  misc_feature (259)..(259): n is a, c, g, or t
  misc_feature (266)..(266): n is a, c, g, or t
  misc_feature (317)..(317): n is a, c, g, or t
  misc_feature (321)..(321): n is a, c, g, or t
cttncattttttcccagtccactttcaaccatttttcccattttttcaggtacacccaggttgcggcgtattacggtcacgngtctgggtngtngcncggtaaagncccaagcccctgcctaggcagagctgtggcggttgggctgggtttaattncaattnattttntgtgtgtccatggcgggggggtgtacaggcccctggggnacggggttcccaaattctttttnnnntgctttttcggctttttgttgggcgntgttaangcctttaccggggccgggtcggtttttttaaaaggtcttctgcttgccggncttnttt

SEQ ID NO: 728058 - DNA, 1852 bp, Homo sapiens
gcccggccccagggtccacacgtgctctggcctgcaggatggcttcagccacacagcagatatacgcacgttggctgggagcagtccgtcacaactggctctgtgtggactgtggtgcctattcatgctgcctggatctgctggggtgacgctgggcctgaccctggaggatgagccgctgaccgggctgcgcttcctgcagctgcacaactgtgctggacaacagtgatgccgcgctgtgttcctggagctcacgcgctacatgcccggcctgtggggctgcacgccgccgatcacgctgccgcctcgagttccctggtggctggccgcgccctggcctgccctcagtgtcctgcccctttgctgctgcgcctgcctcagcgcgggcctctcgctgcctctgctcacctcggtgtgcctgctgctgttctgacgtgcacttcgccgtggccgaggaccgtacttggcacagggaagggcgctggcgcgtgctgcggatcggagcctgggacgcggtggctgctggtggcgctagacggaggcacggcactggtacagcctcgcccaaatgggtgccgatgaccgcagtggacccgctacgtgcgcggcagcgcgtcgcgttcactagctatcggaccaggtggtgcagctgagctccgcagccccgtgctggaggctcgctgtctcctgctttggcaaggctgccagagtagcctcgtgcagcatgacgcttgggagacattgccgactgcaagtctggggttatgtgagcctcgtgcgggaaccagcagaggacaagagagtacggtgcctcgagtgccccattggtcacggaggacagcgaaaggatacaaggccacggcaaggcaaatagtgaggtccgatataaaaatcacacaagaaacgaaaaaacacaaacacaaaacaacaagaaaacaaacaccaacgaaaaaaaacacaaggaacgcaacaaagaacaacaaaaacagaaaaaaagagacaaaaacaaacgcaaaaaaacaagcagagacgaggagcgagaagggacggacacagagggcggacacgagcgacagagagagaaagaggcggggaggagaggagccgcggcagggagaggcaaggacgacgggagcacgagcggcaggagagacgagagagaagaggcagcgagagaagagaagaagacgcgaaggaaggagacgagacagagagaggcgagaacggaggagagcaggggcgagcagaaggaggagaggtggcagagcgaaacacacgcaacggcgaaggcagaggggaggcggacgaagcaagcagagaaagcagggagcaaggtagccagcccaggcgtcggagagcagcgagacggagagagtgggcagcggagagagcagaaggaggaagcagacggaagaggaaaagggagacgagtagaagcaggcgttaagccacacggcacacaggaggggagaccaagaggagaggagagcaggacgcagaggcagagaggagcggcgaagacagagagagagaagagcagaggcgctgccccgaagagaggggagagcgcacggcaaaaaaggcgaggaagacgaacggcagcgagaggagcagacgcacagggcaacgcacaagagaggaaagaggcgcgacaggagcaagaagaaggagcgaaggacgaggcgagaggagagagacaagcaggaaagaccaacagacggacggaggaggacgtcagaggaggagggagcgcagcaacgcaaagcagcgacagaccacagagcgcggccgagcacggcgccgagagcagggcgacacggcaccatccgatccggaaggatagagaagccga

SEQ ID NO: 728059 - DNA, 2417 bp, Homo sapiens
  misc_feature (61)..(61): n is a, c, g, or t
  misc_feature (83)..(83): n is a, c, g, or t
  misc_feature (95)..(95): n is a, c, g, or t
  misc_feature (127)..(127): n is a, c, g, or t
tggaagtaggacttcaacatggcggctgcggcactggcggtggctacggtgacggcctggnccggagcgggcagaagttgganggtggtggcgtngctctccctaggggctgtcgggagctcagcgnggaccgagcctgggaggccggccggtgccagcacctttcggcttctgagacggcggcagcagcggcattcaggttctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactattttgattcttcagagagaactactaataaaaatctaaaaggta

SEQ ID NO: 728060 - DNA, 680 bp, Homo sapiens
  misc_feature (378)..(378): n is a, c, g, or t
aagagaacagagacaaagctaagatgaggaagttctgtacagtataggaaatagaggcttcaagatgataattcgcagtgatgtgaaactggcctcccaagccctgataacaacatgggcaactgccctggacaggaccattgctgagcgtctgcaagtggcggcttttgctgcccgatgagacagatctgtgaacgagtaattggggaagctgtagccatagagcatgtgtattcgttgtgacgctcagattgtctatccaggcgaggttcgccagtaagggagctccattctaatggagtttattcgcacagggaaccgaacacgtcactttgtggacaacattgacgcttttccagatggctctatatggcgccnccattggcgttgatcactacacggtgattggtcgacaattccacttcaatcgtgagcgcggaagttaatccaacagacgcattgagttagaccatggtttgtgtatttcagagatgttgcatatccaggttgttgacacatcctggcacaggacagtcctctctggccaagactcatccggagattgcgttgaagaaattgcttggggacgacaaccgtgtggttctgacccatgtcaatcaatcggttgagaaaacgccagatggcctttggggaagatacacatactgacacgacaattc

SEQ ID NO: 728061 - DNA, 2607 bp, Homo sapiens
  misc_feature (61)..(61): n is a, c, g, or t
  misc_feature (83)..(83): n is a, c, g, or t
  misc_feature (95)..(95): n is a, c, g, or t
  misc_feature (127)..(127): n is a, c, g, or t
  misc_feature (2562)..(2562): n is a, c, g, or t
tggaagtaggacttcaacatggcggctgcggcactggcggtggctacggtgacggcctggnccggagcgggcagaagttgganggtggtggcgtngctctccctaggggctgtcgggagctcagcgnggaccgagcctgggaggccggccggtgccagcacctttcggcttctgagacggcggcagcagcggcattcaggttctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactattttgattcttcagagagaactactaataaaaatctaaaaggtaaaacaacaacaccataaccaagaaagacacagaaacaagaaactccgggggggggccgggaccctggccccatatggggggggaacacaccccggggcggcgttcgtctgaatggacaaccggcgtaccaattaatcgcttgagnaatccccttggcagtgggataggagagcgacgagccatggggcgc

SEQ ID NO: 728062 - DNA, 995 bp, Homo sapiens
  misc_feature (61)..(61): n is a, c, g, or t
  misc_feature (83)..(83): n is a, c, g, or t
  misc_feature (95)..(95): n is a, c, g, or t
  misc_feature (127)..(127): n is a, c, g, or t
tggaagtaggacttcaacatggcggctgcggcactggcggtggctacggtgacggcctggnccggagcgggcagaagttgganggtggtggcgtngctctccctaggggctgtcgggagctcagcgnggaccgagcctgggaggccggccggtgccagcacctttcggcttctgagacggcggcagcagcggcattcaggttctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctgttattctggcaacgagaaggcttacattgaatgtcccttaataaacccagagggtgcaatagcttactacgagaggcctcttgtcaagctctgactttgaatttcaaatagttcatcaccactctacatgtaatgtgcataacc

SEQ ID NO: 728063 - DNA, 1858 bp, Homo sapiens
  misc_feature (1631)..(1631): n is a, c, g, or t
  misc_feature (1658)..(1658): n is a, c, g, or t
tcacggttggtcaagagagcatttaaccctcttctggacttttaattaagccctccttttaaaaccgtaaaaagttatcctttatctgaaggaaataaaggctcacatagtaatgggcgttcgggccaaggccgtgactcatgaatctccatttgacccagagtggctttaaagtaatagggttcattcctaaagtaagtaagtttttgtccttgaccttaatactgtgccattgtcccacttgagcttttggctagactgggtctttgaaggtttttagtgatcatgtgagggaggggccgcagtgccctgcagccgggaagcaccaataaggatgccccctggcggtcagatgaggcactgtcaggctgacaaagggtgactggaccaggctgctagtgtctcaagagagccatttaaccctcttcttgccttttaattaagccctccttttaaaaccgtaaaaagttatcctttatctgaaggaaataaaggctcacatagtaatgggcgttcggggccaggccgtgactcatgaatctccatttgacccaagagtggcttcaaagtaattggcacctggaggctactttgtcttccctgtcctgagctgcttcctgctaaaaagatacacagcaggcagaacttggctgaaggtttgtgtgtgaattctgtttcagaggcctcagactgttgaacagagcactctgttcaactgccaaggttcccaacacagacccctgagaggcagggtggctgggcagggtgaactggatgaaggccaggctaggagatggactattccatgagggggctgggtagtgaggtgtcccagataggagccaggagctgccatggaagcatgagagtatcggcatgtacagagcctttcacccgagcaaaagtcaggagaaaattgatgtgtgacacaggcaccctcttctgcctcaacactggattgcaggaagggaagggagctgtaaatataaggcctgtctcacatctgctgctgtcagtgacacatcaagtcaaggtttatgctatttacattttcaaaacgcctctgaatccccaaatcaatctccaagggctgatggggcagagctcaccccacccctgtccccctagcaccaatggttaagtttgggccagtgtttagtcttctaagttaggcacagaattcagctggtgaagcctctggtctcagcatgttgtcttctctgtcttgtgacctctgacctctaggctaccactgaccaccccatcctctgatccccaaacttagaaacttcagggttattagacccaaatatattcccacaggcaaggggttagttaatcatattctctaggcacaagggaaaggcattaggttcttcggcctggcccacccttggaggcactcctgtgcatggaactgagggacaggggcctgtccctgagggagaagctgggacctatctgaagccacgtggggctggggtgacgctagcataggcaggaccagcgtgtgggttctggtgtgtgcagggaggacctggcagaggctcctccagcctgagagcccagcacagactcctgcagggcccccaccatctcggcacagggtctggctctaagacggcactgtnccctcaggggctgcggtgggcccgtgncaggtgagatagagctgcagctggctcctcagactctgggatacccttggatttcagaaccatgattcatccagctgggtcacaaaatcttcaaaatcattagaagccagctggctcatcagcgtctcctccttgagccgagatcagccattcatccagctgttcctggtgtgtcggattgacactgttggcttgtccag

SEQ ID NO: 728064 - DNA, 1352 bp, Homo sapiens
tactttgccagtgaaatttaagttttaaatatactttcagaatgtattattaactactgcaagttttatggtcgtttacaaatgtcaaggtagcatcgtctctcttttctcgtctgtcatctttcgtgttgtctctctccaggtatattcttatctttgttaactttccattatgggctaaagaaatccatattagtttatgaaaacatcttggttccttgctttactttcgtttcataatagctgtacatttacttcctctttttctaggcgacctgtagtgttaacggtgatagtactatgtccctaaagatctattttactgtgaaaatttcaattgggtaacctgttttcacgcttcgtgatgtgtgtctacagaattcactgctggtgggtgaactgactcccatatgtaatcgtcttgtcgaagacgaaagaaagaacagcgctgtctacacttgtgtggcctttgtgacacctccgtgtttatgacacctttatgtgtcccaggagtaagtatgttacttgtaagagaaagcaatgcggatgccccgtgtgtggttacacaatgcaaagtacagtgggtgtggtcaactttgcgaaactgtggggaagctgagtggacagtattctaccacccgtgggtttttgtaggacaaacccccccattttttaacccacggttcctcctgtggcacaatggcggtgcgaagggctatgtcgtcgacggcattaaacacaagacgatgtgtcgctgtcacacagctgaaagcatgcgaagtggcattgtgtctctacgcagaaaacattacgcgcgccctttgtaccactaaataattgacggggggaaattctatggtgggaaatgtgggctacccccaaagtgtgggcgtctttaacaccatcaggtgttttggtgattaccccggttttaggggacttagaagaaaattgagggtcataaaggcacaagtaaattgcagcgagggagtggatatgaggttcaaagggcaaaaagttaattgtgagtaaccattgaattttttccgcaggcaattttaacggacaattgtgtgccagcacaacaatctgtggtgtaaccaccagattgttagtggactccacacagaaataagtgttgaaagacatttgcttgaagaaaacgacagtggttaacaaacaaggaataggtagagaaggttataaaataacggtttcacaggaaaaaaattgtcgccacattccccaggtggtattctgcacacgtgcacacttacattagatagagggtacgcacccgatgacaatggttttagcatacatagttatatcaggtgaagcagcccagtatg

SEQ ID NO: 728065 - DNA, 83 bp, Homo sapiens
gcacgagcttttattacctggaaaccatggaaaaagaaacctaagtgctctggcccagacctggggctctgggaggctcacgc

SEQ ID NO: 728066 - DNA, 416 bp, Homo sapiens
taattagaatttccaaataaaacagtttccataaggtgtcagcaacagcactaaaaatctcaaatcacactgaaccctaaatgtcattgcaagaaataaaaatttaagaattaaattgctgccctgtgtataatctcttgagatctttttaaagctagcaagacctctatttggatcagaactacattattacaaaacaaaatgaacacttgaccaaaaaaccacattaatttaaatggagcctttcattattttcagatagcggggtcctttccatttatagagaatgatgtaactgccaggacacttttgtgtttgcccaggactcctagtaagaattgaatcttgagggagtaatgataacaaaaggtttcttgtgactggtaacatcaggacagacagagtttttggtgaga

SEQ ID NO: 728067 - DNA, 411 bp, Homo sapiens
cccgtaagagccagtttctttgttcttgattcctttttgctgtctttcttacaggtcggggctgccttattaaaccccatccttgggttaggtatgtgttctccttgcatctcagctcctcagggagctccccgggtggcccacttgcttccttggctgtctctgccctgccttgagggagcatgcgtgatgatgcaaccagaaacacgtttaggagagctcttcccccctccatatgtcgtatataatagggagcttggagtcatgcccttcaggtctctaacatctttgaacactaccttctcacagtcagtggttcctgggtctgactgcattagtataatctgagataatctgagatccttgttaaaaatatagacatctggggtgtgcttccagagggactgaatc

SEQ ID NO: 728068 - DNA, 117 bp, Homo sapiens
  misc_feature (34)..(34): n is a, c, g, or t
tgaggctgggagcagagcgttggcttatgtttgnaatcccagcactttggaaggccgaggtgggtggttcacctaaggtcaggggttcaagacccagcctggggcaatacggaaacc

SEQ ID NO: 728069 - DNA, 248 bp, Homo sapiens
  misc_feature (183)..(183): n is a, c, g, or t
gggatcatcacttcctgggtcagcaattctcctgcctcagcctatgagtaggtgggattacaggcgctcgccaccatgcccagctaatttttgtatttttagtagagatggggtttcaccatgttggtcaggctggtctcgaactccgtgatctcgctgatctgccctgtcttggcctcccanaagtgctgcggattacgaggcgtgagccacgtgctccgcagcctctggttttatttgtttggttt

SEQ ID NO: 728070 - DNA, 332 bp, Homo sapiens
ttaagggaatgggagagcggcccatagaggtggacggcgggcacgattgtattaaagcggaccctgtgtaggtatagagttgagtcaagtggagtcactgtctgtgtacctctggtcatcgtgatggccagaggcctgggggcaccccactgggtggccgtgggactgctgacctgtgcgaccttggggcttctggtggcagcactcgggggtcatgactacctgaacgaccatctgaactaggactatccatggctcaagccacaggcactcacatgaagatttccaccatggtcaacgaacatgcccatggtcatggccacactgacgag

SEQ ID NO: 728071 - DNA, 1332 bp, Homo sapiens
gtggccagataccgcccacgtgaccccatcattgctgtgacccgtgaatccccagacagctcgtcaggcccaccatgtaccgtggacatcttcccatgctgctgtgcaaggacccagatccaggaggccatggagctgagcgacgatgagaccatccgaggactgaagcattgaccatgaaatgattagagcacaggcaccgcaggcatatcttcacagaacgggagcatgatgagtacattcgttgacagaccaggcatggcagccacatggactccaggctatcacacaagcacccagtgcagtagtagtatccatgtgcccgtagataggaccaccaagagacacactacacatcagaagaacacacaagaaacaaataaacaaagtaacacacacaaaacacagcaaatagacaacacatcacaacatcaaagacacaacacaaacatacacaggacacaacgaaaacacgcagacacacgacaacactgagagagacacaacgacaagaagacaccagagagcgacaggaggccagagaatagaaagacgaagcggaagacccaagacgagcaagacgagaaaagagaagaaaacaaggagaacaccgcaccaccaccacgagagagagcgacaccccaacacacgaacaggaacacagaacgagaaagaaacaccacccgagcgggcaaggacgccaacgagaacggcaaaaaggacacaaagacaaggatacccagagcaccagggaaccggaaggaaggagcagagaagggaaacgaggagacgagaagagataacgacggaggaaagaacaaggggaggacagacgcgaacgcccagcaccacgagagagcgcgcgaaacagagacaaaagaaacgaacacaaaaaaggacagcagaaaggagacgcgaccagagaaagcgacagcagaacacaagagcacagacgacacagagcggccagaagaagaagcgagcacacaaccgacagaagcacgacaacaaaccgagaagacataaagaaaaaacagaaagcgcaaatggcaagcaacagcaaggcaaggacacaaacataaaccacatgaccacacaacgacagaaagacaaaaaaacgtaggagacacgagaccgtgacacggacgggcgcagatgagcacggagggaaatgagaagagagccgagcagccgcgaaggagcagaacaaagaaatacaagaacagaggggaaagagagaagagaagaacgcacggagagacgaacgcgagaagagaaacaagagagacacaagcaacgcaaagcaccgacggaacaggataagtagcagaa

SEQ ID NO: 728072 - DNA, 527 bp, Homo sapiens
taaggatccccggccaccagctgggatgatgctagaatgcgtggagaagaacagagatcgtattgtgagcacaaagacttatatggctacactaagaatgactgggaagccaagtcagctcaagagattttgattattctggttccagaagattgttgtcgacacaagtgttactaacactggacagataatatatggatgtagaatctccctcctggcctatggtgtgtaccccaatgtatgctatcataaggaaaagaggaagatcctcaacactgaagggcgtaatgcacttatccacaaatcatctgttaattgtccttttagtagccaagacatgaagtacccatctcccttctttgtatttggtgaaaagattcgaactcgagccatctctgctaaaggcatgactatagtccaccccctgcagttgcttctctttgcctccaagaaagtccaatctgatgggcagattgtgctagtagatgactggattaaatagcaatatctcatgaagctgctgctgt

SEQ ID NO: 728073 - DNA, 232 bp, Homo sapiens
gcccagggccgggcacagcaccttggtgaccagagggtgatggctaacagggagggcaggaagccagcttgtggaggggtgtgaggggggtcccgcacagtccaggttcctggtttcaatcccagggcgtttcaggtggccccccagggcattgcacccagaggcagtcttttagaaaagggaggatgcaggcctgtatataacccttgagaataatgcaacatgggcggcc

SEQ ID NO: 728074 - DNA, 83 bp, Homo sapiens
tattactgttgatccaagtttgtaggtaatttaacaattgaggtctctctttgggaagcgggtgccttatagggccttttttt

SEQ ID NO: 728075 - DNA, 605 bp, Homo sapiens
  misc_feature (4)..(4): n is a, c, g, or t
  misc_feature (137)..(138): n is a, c, g, or t
  misc_feature (154)..(154): n is a, c, g, or t
  misc_feature (156)..(156): n is a, c, g, or t
  misc_feature (177)..(177): n is a, c, g, or t
  misc_feature (195)..(195): n is a, c, g, or t
  misc_feature (200)..(202): n is a, c, g, or t
  misc_feature (247)..(247): n is a, c, g, or t
  misc_feature (258)..(258): n is a, c, g, or t
  misc_feature (269)..(270): n is a, c, g, or t
  misc_feature (277)..(277): n is a, c, g, or t
  misc_feature (283)..(283): n is a, c, g, or t
  misc_feature (339)..(339): n is a, c, g, or t
  misc_feature (345)..(346): n is a, c, g, or t
  misc_feature (358)..(358): n is a, c, g, or t
  misc_feature (382)..(382): n is a, c, g, or t
  misc_feature (384)..(384): n is a, c, g, or t
  misc_feature (397)..(397): n is a, c, g, or t
  misc_feature (413)..(413): n is a, c, g, or t
  misc_feature (429)..(429): n is a, c, g, or t
  misc_feature (465)..(465): n is a, c, g, or t
  misc_feature (481)..(481): n is a, c, g, or t
  misc_feature (527)..(527): n is a, c, g, or t
  misc_feature (544)..(544): n is a, c, g, or t
  misc_feature (574)..(574): n is a, c, g, or t
gganacgccgggccccgcgccgcgccgcgccatgtacgagtgaacatggacgagctgaggcaaaaggtcatgataaaccagttcgtgctggcagagggctgcgcggccgaccaggcgaagagaatgctgcaggaggnncactggcagttcgtanancgcgctgagcaacgattcttncaaaaaaccaacattccnaaaannnaccaacaacacctagatgatgtgaactcccagcaacacccatgcnacgccgcccancttccccgttnngatggcnatgttnttcaagcttcgtgcctacgagggaatgcagagcagcaacagccccatgacagccgnagactnntccccacctacnaacttcagcaccttatgggcctcntncccgataagacancaggggtcctggcgcncgccctcctcccccancaccttccaccacctccacagcacacagccaacgtngcccacagaagcacancagggaggagcccacagaaaagccatggagccatggacggccaganatgagaatggacgccgnagggcgctgggctggagctaaggggcagcncagggttgtggggaaacaggagggccaggga

SEQ ID NO: 728076 - DNA, 208 bp, Homo sapiens
taacacctggcaaaaaacatcatcgatcccttttcataaagataaaatgttcattagttcctctggagctacacactatcacaagatgcagtggccatctgcctcagggctgcctttgtcttgttaacacgctgtaataggaaagctatgccacagcgaccaggtgacacatagagctcccagagagtgtacaggctgtccttccctt

SEQ ID NO: 728077 - DNA, 382 bp, Homo sapiens
cgaatgaaagcacagaaggaagggtaggtgactgaccagtaccagacataaatatagaatcctaaatcttaacctgattaatacatacattatctacccaagagtggattaaatggtttgccaggatcctctcccactgagaagccacagccgaaacagcaaaagcagccacagactgcatcctctccaggggctggggctggcaggaggccctgtggatgaggtacacgtgctccatgtactccgtgatccgctgcaaagaagctcagaggctcgttgaaggcgattggcatcgtggtcttggacagctccaggccaacacacttcttcaggatggtccacacgctgaagtcgcttctgctgaacatgggagccggcagcg

SEQ ID NO: 728078 - DNA, 114 bp, Homo sapiens
cagctctggggacgggtgtatcctgtaccatcagaagtcccctcctcggcctggcaaagacaggcagcattcccatccgcgaccccttcttcaggagcgcccagaggtggatcg

SEQ ID NO: 728079 - DNA, 128 bp, Homo sapiens
ctagaggtatccccggtagcacagatctcgtggggtgtaaggcctgtgcaaaatatatttgagtattaaatattattggccgggtgtgttgactcatgcctgtaatcccttgctactttgggagagcc

SEQ ID NO: 728080 - DNA, 94 bp, Homo sapiens
gtcgacaagaaaaagaggccatgaatttgagaaggagttgggagaaggcatatgggggattggaagaaggagggagagtgatgtgattatattt

SEQ ID NO: 728081 - DNA, 243 bp, Homo sapiens
gggaagcggagatgagtgagccaagattgcgccactgcactccagcctgggtgacggagcaagactccatctcaaaaaaaaaaaaacccgggttttggatccattagcctatttagtaggccatagtgccggcctgacttttagaaaacggtagatacttcaggcatactattatggttctaaaaaaaaactatgtgggagggagggctgggatcaattgggtgcccggtgaagaaactccaa

SEQ ID NO: 728082 - DNA, 423 bp, Homo sapiens
ttccacacaaatgttgtatatcttgtaaattgatgtctaaagatagttttgttcttatagaaagtgttgactgccaggttgcttatagcactttaaattattctgaagatgaaattaccagccaagtatgttggcttaagtagttttagttatataactcttaaaaatacctagttcttttgggaacagtttagataattatctaaagaaaacatactattaatcagaatctctggtgttgtatgacgcgctgttgctaaagatgaatagaaacggcatcgtttcctcgtctgtgtaaagctctcattacaagttaggtaatagtgtctaggttagaggtttataatataatataaggaactgtaaataaatgtacccttcctattagtcttccacagcagtattattgtctttgtggaggtg

SEQ ID NO: 728083 - DNA, 1429 bp, Homo sapiens
aagtagatcgcggatgctgcgtttcattggttcataagctgaggagaccgaggtacccgggcgacagacagtcggtggacaggtcgtacaggaagctccaggaggacttgcagggatgcacaatgtcagtgcctgcgtggttgcgaagccgggactgggggagctggggataggagatgagtaaggttcagagaaaccgctcgttgagaatctgtaagcttcgttgcaagggacatgattgtggtgcctcgagttctatctagacgggtcaataaagtaagtgggtacatcgtataaagacgctgcactgaggagtcaagaacagaacttcagtgaatgacacgtgattgtcattctcatgtgtggatctagtcacccctggaaaaggtatgagttggtagattggaggacgcgaaggacacacagtactcaccttagggacattggggtcccatggtaaattagccctgacacttgtgaggtcgagcaggctttcgactgtgttacgtttactcttgcacgcgacactcggtagattggctagggtccatgctcagtactactcctatattgaggtaaggcttgggcccttcattggtttcgcccgcgccttcgtttctcgcgaggtgttccgcaagcaatactcgatgtatcataaaccagttacttcgatgagttgcggagtagagtccccaaccgaaaacttgcaactaatgcaactctaatttgtacccacgaagcctagaggaatgactacctggaaccacttattccatggtgtgggtaatgcatgatccatgtgcaatagatcacctgttggaagtgagcagattgggggtggacatctgtgcatccagcaagcatgggagttatgcattgatccgggtccgggcggcaaaattgggcaattaagtggtgcgagccccatgctgggacccagggtggggccccggaataagcgaaggcatcggagcatggtgcaagttactgccggtccaggggaaaagtccccaggaggaattgggtggtaccaggacccatggtctgggacatcgattcaggggcccaaggagcccggaaggcgccaaccaccagccgcaggggtaacacgtaagaaaccggacgtgagagaaccatttggtaagaaaaaggtccacagagtcctgccaaaaaaccctgggacgatctagaaggggcccaacaagaaacggttgacatgcggcgcccagtatgagccaaagtccctagtactgaagcatacaggcatattatcagaacacacaacaaacagggggctacatatacagccagcacacgagataaggcagctgaaacaaaatacgcgacagcagcgaagaagtgacgattaattacacctctctgttgttcttttttttctctatgcatgtcacagagagaaaagaaaaga

SEQ ID NO: 728084 - DNA, 151 bp, Homo sapiens
atcccttagactagccgacagcaaacagcaattagcagccttagcccctgatataacaaactcagagctagcttaataggggggataagggcaggaggaggagggggtgtaactatatggccctagcggagagcctagtacgggctaagta

SEQ ID NO: 728085 - DNA, 521 bp, Homo sapiens
  misc_feature (435)..(435): n is a, c, g, or t
cagaaaggccgtctgattgcaacgcagcctgcattgtcctcgctgaacgcctggtcctgtcccacctgcaccggacagcaactgcttcccctccagggcggcccccatcgtcccccaggtgctgcaagagcagtgagacttacccaagacaagtcagaggctttggagctctcgggggcggtggcttctcccaggagccccgtatctgtcagtccccccataaggggaggggagttggcaaggctcctccttgctcccagcgtgaggattgcccctacttttccggcccccacttgccccctccacctgcccttttccctccgggaagccctggaggttttccaagaactctgcgggtcgagggggcagcctatgtggggtggcggggggcctcctgcttgttggatgcccagacgcctacacctttcaccctgnggtccagtcggctgatggccatgagagagaagctgagagcaaccagagcccacagctccatgctggtcccccatctgcaaacgctg

SEQ ID NO: 728086 - DNA, 256 bp, Homo sapiens
  misc_feature (1)..(1): n is a, c, g, or t
  misc_feature (80)..(80): n is a, c, g, or t
  misc_feature (99)..(99): n is a, c, g, or t
  misc_feature (101)..(101): n is a, c, g, or t
  misc_feature (145)..(145): n is a, c, g, or t
  misc_feature (221)..(221): n is a, c, g, or t
  misc_feature (239)..(239): n is a, c, g, or t
  misc_feature (247)..(247): n is a, c, g, or t
ncaagccgccctcgccatggccgcgcgcccagggctcaatctcggtgttctcgagttcccaggagctgggtgcggcgtanagctggctggcccagcgcnanatgctgctggcaggggccgcgccgtttcgcgctcggctgtcggngggactcgtctcgatgctagccgcgagctacccgccgccgtcgccctgccgggcagctagcttagcgcgctggacntgggcttctgcgacgaangcctcgtngccttcgat

SEQ ID NO: 728087 - DNA, 148 bp, Homo sapiens
ggcttcccgatccacctctgcttgggtcatactctctaccctggcaggtgggccaacaagatgaggcatgcttactttttctttggacctggctgacaccccacaggcctgggagatgagtgagcgatctctctgttcacgccactat

SEQ ID NO: 728088 - DNA, 592 bp, Homo sapiens
gccactccagtgcccaccagccttgtcctaataaaattaggtgtatcatttaaaaaaaaaaaaaaacaaaaaaaaaaaaaaacaaacaaaaaacaaaaaaaaaaaaaacaaaaaaaaaaaagggacaaaaaaacacaaacaaacacaacaacacacacacaaacaacgggcgcggcggcggcgcgcgcgcgcgcgcgccgcccggagagagcggaggcgacgacaacaacaaacaacgtgcgatgagaggagccgcgcgcgggcgccgacagagatgagagaaaagaacagaagagacgagagaacgataaagaagggagtccacatgagaagcaagactacgcgcgggcgaacaaaaaagcagagaggcgagagggatgacataccaaccaacacgaaaaaaaaacagagccgcgcgcgcgggaggcacaaccacgaacgcgcgcagaaaagacaacacaacaccacacgaggaggagaacatggctagagaggagataatagaggagggggcggattacactaacaacggagagggaggtgcaacaaaagaggcgaaagcgaccccgaacaaaaaaaaaaagaaccacca

SEQ ID NO: 728089 - DNA, 444 bp, Homo sapiens
cccgtgttggctgttagtgtatttgaaattctgcctgtctccccatggttgaaatttgtttgaaggatagccgcctaatctcttggctgtttatacttttttaaactttcctgtgttgtaaatattgtatacttttggtggttccaggtatgtaacctctttgctctttaaggtggttatttgtatatagcaacatggccccgtgatattatatagtttcccaatgggggggtttttgggtaacccttgcctttgttttaaccctacccggaggatgttgggccaacttttaaccctcaattttgtttgttttcccaattgtacttattactgcttttggtactgttttacgtgcccatagtttcccaatcacctagccggcaagggattttttttactttttgaacccctgtaatatttaataaaaaatgttaccatctgtta

SEQ ID NO: 728090 - DNA, 836 bp, Homo sapiens
tcaaaattttctttttcctagaaagaatattccctttttattggtaacatatctcacaccgccctttgtttaaacagccggcccaatttttctttctcccaaccccggggggtaatattaaacattggtatagtgcccccatgcccccctcgctcacctattaagtccacgcggacgatcacgagtggggcaaactaaagccatggttttagtgaactatcgtacacattccactgatgacgacatctgtttaaacacctcgtgatactgctctcgccccacgcgggttgttaccccctatggtcttcttttcacgccaccgaaggacgacgaccgcttggatgttttctgccaaataattgaggaagtagggaacacaatgtatgttataaaatcattttggggctagtctccccgaggatacaaatgtgcgtaacaaggaatcgttgccacacagatacaccacgagtagtgcaccccactactgtttaaacacacaaaccagtttatgttgcagaaggacacaccactagggtacaagtatatacaagtgctacaccccaagaaagatcacaaatagattctactacgttagattgacctttccccgatagacgagagcaattatgactcccccgaccccaagaggcggaccatgaataaatcctatctatcagtacctatacaccgcggagtgtactatatatgataaagaagtggaaggttcttgatcttggaccctttagccgccccagagtgcttgtatgcacgcgctattagtctttcgctaacgtcgtacgattggaaccaccacaggttcccccccccacatgaca

SEQ ID NO: 728091 - DNA, 173 bp, Homo sapiens
ccttagctggctcctgtgtgcagtcccgccaaaaaacacgagctgcccggcattctggaagcttctggtcgaggaggttctcccatgccattcttttgcctgccgtccttcattttatcctctattaagctgtcatctttaacagtctgcacagtttccaaagctctactact

SEQ ID NO: 728092 - DNA, 781 bp, Homo sapiens
  misc_feature (72)..(72): n is a, c, g, or t
  misc_feature (97)..(97): n is a, c, g, or t
  misc_feature (561)..(561): n is a, c, g, or t
  misc_feature (688)..(688): n is a, c, g, or t
gtgggaggactagctaggtacgaggctggtgtgaatcggccgagggagagactagtctcgagtttttttttnttttggcatcccgactctggggttnatccaacacaattcttccactctacacaacaatagtacaaacacaaggtcatctaaaaggctacaagggtataaaactcaaaagagaaatttatagtactgacgggtacaatggaaagcaaaaaagaaaaaaaataaaagcaaggtacagtgtggccaagataaccgtgaaagaccaccagtgaacggcgaggcacaaccagtggcgtgcgtgagtgacctccgcagagcgggcctctccacctcactcgccaattttcagagtacaggtgggtggggctgcgggtgtgtgcactcgggtgcacggacagacagaaccacgagcagcaactaccagtgggttgagaggactcttggagggggtgtgaccctgtgagactcagaagaggccctcgagaggccaggcctaacagggtgggcagctgcactaaagccgggggcagcctccctttccaaagggacacngcccagcaacagcaagggcacggccgggccaccatcccaggtcatcggggaggggaaaagtgtgcccccaggtaagcagggtcaaaccacccccaagagcctcacttttccctggtggctctgccantgaactggactcttagaacccggaaacggatgagcttctagccagaaaaccgggagggatcttgcggggcaccagtcccaaccaaagaattcg

SEQ ID NO: 728093 - DNA, 493 bp, Homo sapiens
ggatagttgcctagttcctctttcccatctggaaactagctactttcagccagaggagcaaatccttcaggaactgaacaagatttctctagacccagagcttaaaattggaggaagcagatatgacctcacatccttggtaccagggaatctgcagccagggacagagactggaaatcatgaagtggaagatgctcaatccctggatgatcttgatgccttcactcaggaaacactggacagaatgaattgtcattggtcaagaacgcaagttttaccaaataacatttcgggatggagaaaccagagggggaaactgaagtgacaggacctcaggatttctaaataacttcaggaccgaaaataatgccactatccaaaaagctaaaatatgatatctgggaaagatggtcatcagaagcagcattcatcccatgtagccattccatggataaaataaacaaagtggacatggttcacagaaatgttaaag

SEQ ID NO: 728094 - DNA, 429 bp, Homo sapiens
  misc_feature (86)..(86): n is a, c, g, or t
  misc_feature (89)..(89): n is a, c, g, or t
tttaattccttggtcaacccaattaggctatgctaaacatatgggtttgatccttggaaaaaggcatggggcctgcccagcaaggnagngggtgtttggaggacactgctgaagaaacacctttcgtatctttgtccctggagcccttgagttccctgcttttgttcctgtgggtctcattaaacggaaacagaggatgttgaataatccacatgcctcaagcagactcggtcccagatcggctcaaattctccacgtatttaaggatttgaaacatgcaatcataggatacatagttttatgtcccattggattaaggttttttttttttaatgtttcaaaacataagttttatggtagtccttttgggaaaaatccagtattatctaaaattattggcaaagttaaatgtattttacatacctggaa

SEQ ID NO: 728095 - DNA, 384 bp, Homo sapiens
  misc_feature (144)..(144): n is a, c, g, or t
  misc_feature (175)..(175): n is a, c, g, or t
  misc_feature (201)..(201): n is a, c, g, or t
  misc_feature (339)..(339): n is a, c, g, or t
ttagctgggtagggtggcgcacacctgtaatcccagctacacgggaagctgaggcaggagaatcgcttgaacctggcaggtggaggttgcagtgagccgagatcgcaccattgcactccagcctgggcaacaagcacaaaactntctcaaaaaatagtaataaaaattttaaaanttagctaggtgtggtggcgcatgctntagcctcagctactcaggaggctaaggcaagaggttcactcaagcccaggagtttgaggctgcagtgagctaggattgcgccactgcactccagccttggtgataaagtgagaccctgtctctaagaagagcacaganagagagagaacctagttctgactgcagaatccctggagcacagat

SEQ ID NO: 728096 - DNA, 87 bp, Homo sapiens
agctctgtgactgccgcggacacggccgtgtattactgtgcgagtatggatcaccagctgactagaaactactggggccagggaacc

SEQ ID NO: 728097 - DNA, 153 bp, Homo sapiens
actgtgagctatggtacgttcattcctcatcagcccattcctctcttctaaggatttctttagcacatctcctatgatgtctttgctccaaaagtcaagagagaaatacattaataacctgggctagtcacaacaagaacatcagtgactacc

SEQ ID NO: 728098 - DNA, 891 bp, Homo sapiens
gatgtggtacccaggatcgcagtcccggacacagcgtgtagtgagcctgggagagttctcacaggcgctgcaggagccttgcaacaagagtctgggcctacgctcgcgacattcgtaccacgtcgaggcaggagggcgaggtccgggccagcgcggtgtccctggagtgacagatgcactcgaagtgagccgtcggtgtttggtacagatgcctgctctggcaaagggtcctcctcgctgcactcgatcaacgtcgaggcaaatgagtgctccgcggggtaccctgggtcggtagccagtggtgcacaagtacatgtgcaaaggagccgtcagtgttgacggcactctgccgatgagggaagcagaaatccgccctcacaggcaactcgtacacgatctgcgcagtggccccgggcctgacccgacaggcgcccaggtaggcctggacagcgcagcttcagtgtaaatggagccttcggtgtagagtagcaagtggccgtggggacccacatgtagaatgtggggcaccccgaaaacatttgcattacgttcgccttcagaagcctggggccgtggacaagactacggtgccgctcggaatagccacatgataacatgagatgcagagcaccgaggaccgggacccggggcacacacagacagagtcaattagcaggtttcgagcaggatcggagaggatagcagagcaagccgagaccagtaggaagaccactaagtggaagaccaggagtcgaaagcaaagacgagcagagcaggactgaaataaggaactagacaaacacgatcgtatgggaccaaaagtagcagaaatgacacataacaaaaggacagacgacacagacgtccacaaagtaaagcatgagacaaaag

SEQ ID NO: 728099 - DNA, 461 bp, Homo sapiens
aagtagtgaatcagctgggcgcagtgggctcagcctgtaatcccagcacttttgggaggccaagggcgggtgaatcacaagctcaggagttcgagaccagcctgaccaacatggtgaaaccctgtctctaaaaatagaaaaattagccaggcgttgtggcacacgcctgtaatcccagctactcatgagtgctgaggcaggagaactgcttgaacccaggcagcggaggttgcagtgagctgagatcacgtcactgcactccagcctgggtcacagagcaggactccatcttaaactaataaaagaaaagaatgaagagcaaaaaaccagtagtgaagtcgatggtctccatgttctatgtctacgccactctccatgcagaaacttggcaattttagaactgacattaactccttctgacagaatcttcagctaaaaatcttcactatatcacacagcac

SEQ ID NO: 728100 - DNA, 103 bp, Homo sapiens
ttgtgggcctgccttccctccctcctcccccccgggccggactgtacaaagccctgctgcggggtgttaggaatgacctggaattgtcaataaacaaatgccc

SEQ ID NO: 728101 - DNA, 857 bp, Homo sapiens
ggaaagtccgaattttggagatttccccaaaaatgcacaaagctcccctatgcccgggagatgaaaaatttacttcccccccaaaggttgttaggaagggaaggtaaagggccccccatgctccctaaaggcccaccatctggccttcttccgtgttttgctctgaacatcgcccaagaattcaaagtggacacccctgtcctatccattgggataccgcaaagaaattttggtgagattgtggtctgagcagtcagccaaagataaccacccatttgaacagaagccagctaagcttgaggagaaatatgaaaaggattattgctgcatactcgtgccaagggcaaaagtgagcagggaaagacggccctggcaggccaacaggctcaaagaagaagaacgaaccagaagatgcggcgcaggtggaggcagcagaagatgaagatgggagggagaggatgaagatgaagaataatgcttaccctttatgagcggtgtggatgtgtgtgtgtgctcggccaattttttgctaagaagtaaaatccaggggcagctcattacttgcttccgtttaaaaactgtacagatttttgtatagccgataagattccctgtagaggaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatattaaaaaaaa

SEQ ID NO: 728102 - DNA, 867 bp, Homo sapiens
gccctggtgcggtttggagagcatgtgttgcatcttcccgttgcctcgcttggcgcccgtcttgaccttggtgttcttctgcctgtgttgccctggctatgcctctgatgtcccccgcttgtccccccggcttgttgctccgggtcatcctagggcgcctgcttctgtctccctggcgcctgtttactgcctcttgtttgttggcgccgaccattgttatcccccggtcggtgatgtttgtctcgtcgactcttacgccccccgtaggggcctgcccggggtacctacgccctgaggtggtgcaaccgtgcccatacctttgtgtctgtagtatcggccccggttgttcctcccctgcatggcggttcttggctggctcggactcctcgggtgctgggtactccacgcctgcggatcccatgtgcgctctctcgtcaaggaggtctcaagaatgcttggatctcccctctatgggctgtttgagttgggcattttttcccggacgctcttgtaaggctggcgcgtgtcccccccgttgtgcctccccgggtgataagttgcttcgctggatacacccggctttcgcgggccatagatcttgttttcgctagtacacgagggtccctagttaattagtgcccgcgcccttatatgcgcggtctgacaaggttttgcccccacgccaactagggggtttacgtctttcgctccgctccgcacgtggacctacacacatatacgccagctgggtctctgcacgccgtggagtcacctcgtctcgttgttttagatccgctccttgccccccatttctccccttttcccccacccccgcactttaccggtgttttcccctgtaaacataac

SEQ ID NO: 728103 - DNA, 1063 bp, Homo sapiens
ctttggtaccacactggacattcaacctacattctggccaaccgcctctacccagagtctgcccgggactggtttaccatggagtcgcctcgtagatggtccagagacaatgtgtgttccgtgcgagcaacttgcaaggctttcccaggtctcagggaccatgttctaatccttccattgctagtatgtcagtcagcctgagcaagaatgggtaggtctcctcgttggacctggacgtcagcccgattatcctctatggtcaagatgtgaatgtctattcagggatcatgtccagaaatcctaggcatgttgaatggataagatggggggagcagatggtcttctcttatcagacccagacgaactgatgccaagtccttcattcttcccaccgtagtaattctgtggtgtggagcctgcctcatgctccccgtgttcaatgcatcattcggtgcttcatacttactgtccgtgcgcagtgagtaactcagggcattctactggaatcaatggaatgccggcgtggttggctgtaaccagcatagggtcccccactattctctggtgtcctccatgactcggtgtgattccgcttgtgaccagaggtgcggggttgagggtgggatcggtgtgcgtggtagctgctgtctcacccgggcagactctctggattgagtaggttccctctttcgtattgcagaattgcactggtgcgctctcctcagtccctttcttgattcgctcttctgaccgtgtgcatgagtcttagcttgggatgtccccatctctctcaaacatggtgtacatgttcttgggtagatgtgtagagccattctgacttcccgggtgccacgctgtggattgcgttaggggctgaagtctagcgttttcttctccttgatagtgccgggggtacttcgtcctggctgtgggggggggttcgggggaagaggtccgtccctaggagagggcccagtcgggggtgggccccccaaggtgcgcggggcgctcttgggagtgttggccaagaacgggtttgggggggagaggcccccgcgggtgt

SEQ ID NO: 728104 - DNA, 155 bp, Homo sapiens
tgagcattgtgactgtggactggaaacaccgagtgatacatctttcgtcatactgctgagccctccccgacctcccagaactatacaggagggtagcagtagaacatgcctatcatcctccagatataaaatccgccgtcggcgatacttcctat

SEQ ID NO: 728105 - DNA, 81 bp, Homo sapiens
agccccaaccagacctctctgtacttctgtgccagcagtttagggtccccgggactaggaaacaccggggagctgtttttt

SEQ ID NO: 728106 - DNA, 767 bp, Homo sapiens
  misc_feature (154)..(154): n is a, c, g, or t
  misc_feature (277)..(277): n is a, c, g, or t
  misc_feature (280)..(281): n is a, c, g, or t
  misc_feature (291)..(291): n is a, c, g, or t
  misc_feature (300)..(300): n is a, c, g, or t
gtgtcttttatgaattgggatcccgatgatcagctccatgcctcctgcctttccctggccactgctcccagccttacgaccttaagcttttacggggattccatctccataatctccctgcagagtctcctgcagcacctcatcggcgtgaacncatctgacgccacgtgctgtatcctgtccgcctggagattatgaggacatccatggtaccctccccctggagaggcttgcctatctgcatcccaggctcagggagttgctgtgtgagttgggncgnncccagcatgntctggcttngtgcccaccctgtcctcactgtggggaccagaaccttctatgacccggagccccatcctgtgccccctgtttcatgcctaattagctgggtgccacaatatccaaatgcgttcacttctgcataacttggacccttaagcccggatgtgcaatgcatcttgaagccaccaagcacgccacccgtttcagaccaaatgttccgtgtgagtgacggaaaacaactgttcacgtgaggaaaaaacacttcagaccaatgttcacgtgaggaaaaaaaggggaaagttgggggtaggcacgatgttgaacttgaggagttaatgtgatctttggggagatacatcttatagagttagaaatagaatctgaattttctaaagggagattctggcttgggaagtacctgtaggagttaatccctgtgtagactgttgtaaagaaactgttgaaaataaagagaagccatgtga

SEQ ID NO: 728107 - DNA, 210 bp, Homo sapiens
tacatttccaggtctgagcaatcttcaggtattccaacatagcattatcttggagcatcccacggtgttccgcatgccacacctggatccagtcctcgcacgggtcccgggtgaagtttgtgctggtccatcactctttgagggatcagccgctcagagctgaggtacccagactggtgcacttctttgttgtagtccccaaactggggc

SEQ ID NO: 728108 - DNA, 99 bp, Homo sapiens
  misc_feature (27)..(27): n is a, c, g, or t
tgcacggaaaggagcgggtaacgtctncgcgccaaagtgggccgcagtagggcgaggcagcaggtgctggactgccacggaagagcaagatctgcctct

SEQ ID NO: 728109 - DNA, 313 bp, Homo sapiens
tctagaaggtacatgtcgtattcaatgcacaagactgatttcttcatacttaatctgatatctttgagttttcctatatctgagagaagaactccaaaggtatgcctgcctcataatctgccctggacttgtcattcccgacaggacacctcattggacactgccccaccccattaagactctgaagcgtagggtcccattgctttgcttccgaaatccaaggggaacaagaagtacccatctcttacaaaaataagcatgtcaacattgttcagtacatttttctacacatattgggtactacgctttggca

SEQ ID NO: 728110 - DNA, 358 bp, Homo sapiens
ccaaaatctgttccgctgtaacagaactgaatttggaccccgagcacaagttgtcacgcctgtaatcccagcaactttggcaggccaaggtggaaggatcacttagagctaggagtttgagaccagcctgggcaatatagcaagacccctcactacaaaaataaaacatcaaaaacaaaaacaattagctgggcatgatggcacacacctgtagtccgagccacttgggaggctgaggtgggaggatcggttgagcccaggagttcgaagctgcagggacctctgattgcaccactgcactccaggctgggtaacagaatgagaccttatctcaaaaataaacaaactaataaaaagc

SEQ ID NO: 728111 - DNA, 340 bp, Homo sapiens
tgagctcgaccgagtcctccgggacgtatggctgcgcggtgaccggggtggacgggccggctccggtgacttcgggggggcggatcgagcgtcagcagggtcgtcaggtgcttgatggcttcgggcaccagcgcgaattcgaggtcggtgaagaagaagcggccttggctgaccatgatgttctcgtggtgcaggtcgctcgcgcccgccagcatcagtgcggcgatggcccggcccaggtcgccgaagacccgtccggcctctgcggagtcgatcacgtgatcctgggccgagctgtgcggcaggaactgcacgtagccatagtccacgtcctcatggg

SEQ ID NO: 728112 - DNA, 92 bp, Homo sapiens
ctcgaattcaagcttctaacgatgtacggggacatggtattccccttcgatccaaagttgtgtattaggaggagagagaggaaaaaaagagg

SEQ ID NO: 728113 - DNA, 148 bp, Homo sapiens
ggtcagccccaggaaccgactcagccatactaatctgtcttaaatgctccagaatagcaggtttagttcaacacactaaactctccgccgggaaatcttgccacttcttttttttttttttcttattaattccccggaaaatggtggg

SEQ ID NO: 728114 - DNA, 611 bp, Homo sapiens
  misc_feature (76)..(76): n is a, c, g, or t
  misc_feature (137)..(137): n is a, c, g, or t
  misc_feature (144)..(144): n is a, c, g, or t
  misc_feature (146)..(147): n is a, c, g, or t
  misc_feature (478)..(478): n is a, c, g, or t
agaacatggtgcttctttcaaacagattgttggagaccaagctctaatgaggcctacaacattctgaaatcacgtngctgccattttatataaaaagtgggtacaaacgtaattgtatagcattaaataaagctgcngtaactntnngaaaataagaaaagttttttgtaaggaggaggcttaaatccttgggcctggggatttaacccccataaaggtttcccggacgggggcccaaaggaattggggaccgtgccccctcccctcctgaagagattaaacgaaacagagaaagaagaacctttgcttttaaaacaaccggaaagatggcttttttggggggccccccccaaaaaaggaaagcctttataaaaaaaaatttttttgaagaaagcgcggaaaattccaaactcccggggggcgccccaaaaaaaaaacccctaaaaaaaaaaagaggggggttttttaaaaggaaaanaaaaaaaaaaaacatggtgggggcgcagaacacccaccccccctcttccctttttatttttttcatattgggggggggggggttatattaatataaaatatttttttttaggaaccctcttttttttttttcc

SEQ ID NO: 728115 - DNA, 252 bp, Homo sapiens
ggtcccctaggtagactaacccaggtccaggtagaatagcaagaaaactataattagaagtggaccctggaagacagaactcaactgctacaatctcatgataaaatttgaacaaatgaggagttgcattttatggatgagcaaaggaagtggtttcctggagacagaatctactcctgggtgaagatgctggtgaacattattggaaattattacacaaagatttagcaatattacactaaactttattgg

SEQ ID NO: 728116 - DNA, 430 bp, Homo sapiens
agaacacaaccaaaattactacaccaaaaccaacaatataaacaagggggaaacacaggacattaacgggaacccccataaaacaacaaaggggacaaacacactaaaaaagcccaccccacaaaacaaaacaaaaaagacaaaaccaaaaatagagatcaacaccataacaaaaaaaccacccaccacacataacaccaaaaacgaaagaaaaaccataaaacccccacaataacactaacacaaatcaaaacacaacacgaacaaaatacccatacaaaaaccatcacaatcaaccgaatacaaacaaaacccaacccaacacacaatctcaaaaaaccaaaacccaaccaacaacacaactagaacaagccatacacaccaaaagccaaacataacaaaccacacaaacacataaccacaacaactc

SEQ ID NO: 728117 - DNA, 146 bp, Homo sapiens
ggcgcaaagatcttcgccggcgatcagtaacaagccgcctatagtgaaggatcgacacagcaacatcgcgccccggccagtgcttgggtacaattgccggccaacttgatcgagtaacaggacctttacatgatcgcttgcctgcg

SEQ ID NO: 728118 - DNA, 116 bp, Homo sapiens
tggaaacggagtcctgctctgtcacccaggctggggtatggtggcgcaatcttgagctcactgcaacctctctctctggggttcaagccaacctcccaccaaagccacggccaacg

SEQ ID NO: 728119 - DNA, 345 bp, Homo sapiens
ctcaccactctgctcagctatataccgcatcttcagcaaacctgatgaaggtacaagtagcgcagtaccacgtaagacgttaggtcaaggtggtagccattggggtggcaggaatgggctacattttctaacccagaaaactacgatatgcctttatgaaaacttaagggtcgaacggtggatttaggcagtaaacttggagagtagagggcttaggttgaacagggccccttgaagcgcgtacacaccggccggtcacctccctcaagtatacttcaaaggacatttaacttaaaaccctacgcatttatattagaggagacaagtcgcaactggtacggcggg

SEQ ID NO: 728120 - DNA, 171 bp, Homo sapiens
  misc_feature (14)..(14): n is a, c, g, or t
  misc_feature (42)..(42): n is a, c, g, or t
ttttatttatttancccgccattgtgtgtttttaagtatttnctttttttaagggaaaggaaaagcttgtcacaatctaactggctatgtattattattaaatttatgttttgcaacttagaaaccaactacagtatggcccacttaataaaacacctgaaacaaaaaaaa

SEQ ID NO: 728121 - DNA, 125 bp, Homo sapiens
tccgacgtgttcaagatgcatctctcagaagtctatgtggtcacctttgttttttttgtttgtttcttttttgagatggagtctcactccgtcacccaggctggagcgcagtggcacgatctcag

SEQ ID NO: 728122 - DNA, 135 bp, Homo sapiens
agtgctacctccacacaggtccttcttgtggaggaagaggatgatggatgtgtcgtgtgaacccacttgtgtgttgcagcatgctatcgaatcaacttcatgctctcactgcatggcagttcatctacctcgtcc

SEQ ID NO: 728123 - DNA, 298 bp, Homo sapiens
cagagatgatgccactgcactccagcctgggcgacagagcaagactccatctcaaaaaaaaaaaaaaaggctgttgaattcgggcagcgcttttaaaatcccgggcccgggtgatttgcgtaactcgggggcgcccgggatagtgcctttcatagggccctgcaattaccctcttcctcattttagcattgggccaaggtctctaacattctctttaccaggtttaacaggggccgtgtaaaaggctttcacccattggaacaggtacaacctggcgggggggggggttcctcataga

SEQ ID NO: 728124 - DNA, 147 bp, Homo sapiens
ggtgtttgagatcagaaagaaggaagaaagaaaagaagaaaagttgtttgggacatgagcagtaagtgggctgaggcattatgagagcctgaatgaagatagcaaatgtgggaatagagaaaagcagatagataagggagatattac

SEQ ID NO: 728125 - DNA, 559 bp, Homo sapiens
taaaaagcttttttgttagcacacagaaacacttcatggtggttttggggggaaggggcatatgtcactaatatattgtctccaaagccgtggattgatgtggagcaaaacacctttcccttctagtttggagagaacttccatctgggctcccaggaaggagggatccccgtgacttgtgacacaacatgtggccaccttgtggcacaaaagcctgtggtggtattagaaaaaccaaatttggttttaagtgtcctctttctccctttccatcttatcagcattagacttaattcccttataagcccagaaacttcgtgtgtgagaaccgtgaccccttagttacctgggctatacacaggtgtgtgtctcgggcacatctggggacttttccagaggtagtgccgcacgtgggaagagttggcccctggttctaaagagaaccaaggggggtcccaattttcctagaaatgggggggaaatctttcagccaatacagatttcgtggccatttatcatttcccgtctcctgaacagtcaggggttcggctgtttgacc

SEQ ID NO: 728126 - DNA, 415 bp, Homo sapiens
gcgtcttagatgtatggagtggctgatcactcattaacgatgcatgctgcctatgcagcatctgtttaacaaacgcacatcttgcaccgcccttcactccatttaaccctcagtgagacacagcacatgtttcagagagctcaggtttgggggctaaggtcatagctctttcgtgatgtcaaagcagaagaatttttcttagtacagaacaaaatgaaaagtctcccatgtctacttctttctacacagacacagcaaccatccgatttctcaatcttttccacacatttcccccttttctattccacaaaaccgccattgtcatcatggcccgttctcaatgagctgttgggtacacctcccagacggggtggtggccgggcagaggggctcctcacagcccagagagccggaa

SEQ ID NO: 728127 - DNA, 402 bp, Homo sapiens
  misc_feature (49)..(49): n is a, c, g, or t
  misc_feature (74)..(74): n is a, c, g, or t
  misc_feature (85)..(85): n is a, c, g, or t
  misc_feature (100)..(100): n is a, c, g, or t
  misc_feature (107)..(107): n is a, c, g, or t
  misc_feature (129)..(129): n is a, c, g, or t
  misc_feature (316)..(316): n is a, c, g, or t
  misc_feature (318)..(319): n is a, c, g, or t
gtcgacgtgaggactcccccgatgaatgcgcgttcggtggtctgcatgntcttcatgatgaagctcctcaccangaagtcctcanaccagatgtgctcgnagaccangttcacctcatagatctggtanagattggagccttcatccggccagtagtgctagcactgccggacgccgttctccgcgaggggtgtcagtcatgacgatcaccacgcagccgctctcccacaccttctgtcaaaagtcagccacggtggcgggcagcggtctctgggtggcgatgtacgcggggttcctcgggtcgtgatccatgatngnnctagcgttgatgtagtctgagtggctgtggctgttctccgccttcagcaggacccgggagtggtcataggtcagcacggccag

SEQ ID NO: 728128 - DNA, 115 bp, Homo sapiens
gtccctaaaaattttcctttttagggggcaaaaacctatttttaaaaaaatgttgggggaaacccgtaaatgttggacatgtttctggtttcaaaattaaaaaaattcaaagtta

SEQ ID NO: 728129 - DNA, 897 bp, Homo sapiens
gaacgtcagtttgagttctgtgttctccccgccgtgtccgccgacccgtgcccgcgatgctggcgctggctgacgggctcccggtggtcggcctgctctccgtcccggctccgtgcggtgcgcttccccggggcctggtctggaggggctccggcgaccgtcgtcttcctcctcctccggtaacccgctcgctgtacctggacgtgacgccaacggaaagccgctcggccgcgttggttgctgtagctgaaggcagatgtcgtcccaaagacagctgagaacttcagagccctgtgcactggtgagaagggcttcggctacaaaaggctccatccttccacagggttgaatccctttcctttcattgttgccaacgcgggcgatttacgacccaaccacaagttggcacaggccgggaatgtccaatctaacgtaaagcccgtttccctgacgagaacctttcacacgtggaagcactgttggggccagggtgttcctgctcccattggctaatggctggttccctaaacaacccaaacgggttccccagttgctttcaatcttgcaccatataagaccaggacgtggcttgcggatagagccaaggccattggtcgttgttgcgggtccacgtgcacacagagcgcattggacgtcgtgacagacacatagaatccttcgcggttctaacgagtgggagggcatccaggaaggcttggtcctcaccagactgtggccatgttgaggctaatcttgtggccactggtggcttgggcattgttttgccacctgcaaatgttcctgcccccaagggggcgccgtttgcgtgtagaccaaaggcctaaacaatagtgtggccctcccatgtcacattgccctcaaagcatctcgggcttc

SEQ ID NO: 728130 - DNA, 771 bp, Homo sapiens
tcccaagaacagagttttgctctgttgcccaagctggattgaaggggtacaatcgggctcaatgcagcctccgcctccgcgggttcaagcgattttcccgcctaagcttcctgagtagctgggaattacgggcgcgttatcaccatacccagtgtaatttgtggtatttatagtagaagagcgggttcaccagtgtttgcccaggagggtctcgaactctgtggcctcaagtgatccaccggcctcggcctcccaaagttgctgggatgacaggcatgaatcactgtgctcagaccaccatctgggagttttaaaagggctcccatgtgagtccctgtgatggccaggccaggggacccctgccagttctctgtggaagcaaggcgggggtctggggtccctgtatggtggaagcttgggtgacgccaggacagggctggttcctcttgcccccggtgacgcttcctttgccgtgggttgggatgtcttggcggcagtcttctctctggctcaggtgtgggtgggagggcgccacaggaagctcagccttctcctccaaggttgtgagtccctccaagagggcagtgggtggcaggcccgggagcttgtgggtgaccagccattcaagaggaactttgctggtcccttgcagaatcttcaggttggggaactggcagtgtccccttgatggggaaaccagggtgtgtgtgtctctgaaggttgagtgcggagaggaggtgtttcccaacaccgggcccgagatgtgtgtga

SEQ ID NO: 728131 - DNA, 390 bp, Homo sapiens
ggttgcttcatctcagcaagaaagtgatctcaatacagagagggcacatagccctgcgggtatcatcacgaaccaagtatagccaacagtaactgtagaaataccatcttgtaccatgtacaaataagttctttataagataacctaacacctactacaaatagtctcctaagttatactagaaaaacaaattacacacatagcatagtagcatagtagcacacacacgcacacctagtatgcatatctatggggcctttaaaaaaaatcaatctatggatttatctgtgtatctcttccttctatttcttttttcatgaaattacacaatggtagaaaaatgagtgtctctgttaatagcaatctatttgtattcttggtctagataag

SEQ ID NO: 728132 - DNA, 1616 bp, Homo sapiens
ggtacatttcaagttggtcgcggcttgggctccgctcttgcgtcgaggggcagcaggtttagtatcactggcatctctgaatacccaggccccctccaccatggccatgccggggttaggcgctggccaggggttacgtggctcggtggccaagtcagaccctatcacacgctgccagcgcccgtaggagccatatcggcaacagggcgatagctcacggcccccactcaatccccaacctctagcaaaccctatacttagccaatctactttccacctaccaccttacgccgaggcatccctgtcctcagggcttgccctcttggccgcccctcctagtgccgccagtgcataatggaggcacattcatagatctccttgcactcaatccctgcacagcgccttactagaaactctcaactctacccctcacctcccctatagtcaccgtcacaacattcttaccccccccttcgaaccctcactccaccttacccccgatctcccccctctccactggctcccctccccccccatctagcttcaccccacttcgtttgtcccaacccccccttccacactaaaccccacctaacccattcctcctcacattccaaccacaatccgcctacccactcgcctccccccccccaccttcctgacacctacaattcagctcaccccattcccctcaaaattccgtgcgcatatcctccccctctcaccctatctgctccccacgtcccgcgcatccgctactcacccgctcgacgagctcggccctccccctccctctcgagcaggcgaaccttccgcccgcgcacactctcgggctttgacgcctttagggcgcgctaccaacctagtgccatccgcttgtcacatctgccgcgcccacttgtctctgccctaccctcccctacacctattacgccgtctcacgtccccataatcactctccatcttccatcccttcccccctctttcatctgtcctacacccccatagctttaccgtattcacatcaccacgatatttcaaccaacgcccaacgctccaacacccaccctctcaactccactcaccatcccctcccatcactaatactccgactaatcacactctcactcctccccatcaccccccacctccccctcccctcatccacaccactcttctcctccactcccccaccctatctcctatactcacccctctttcacccaatcccaactctacccatcccctctcccctccctcccaccatcctcacctctcattcactccatcacatacctccacctcttccttccatccccctccaccccacccatcctcaaaacttatcgtcgaccaataccaatactaccgcctaacatcctactaactcacactcacttctcccaccattcctcacctcgcgcttcttcctctctctactccctttgcatatcctacccacacaacctccctccactccatccatctcattctaccaactatcatcgatacaatccctcccaccacattcaatcctcatctcgtccccactccattcccacccacctcaccacccgccttacctcaaactacccaagatacatcataattgactt

SEQ ID NO: 728133 - DNA, 177 bp, Homo sapiens
ttttttttggatacaaagtctcactctgtggcccagggtatagaacagcgcataatctaggctcactgaaacctctgccacgtggttataaattaactctcatgcttcaagcctcccaaatagctggaattacagttgcccaccaccacgcctgtgcttatttttgtgtattttaag

SEQ ID NO: 728134 - DNA, 670 bp, Homo sapiens
  misc_feature (524)..(524): n is a, c, g, or t
  misc_feature (670)..(670): n is a, c, g, or t
actggactttctatctcttgtactacactgtaatttacctctcactgttctaatatattttattgggatctatacatgttattttttttatggtggtttgaatatgtctttttggatcgtttgaatttcacatcttgctcgcttgcttttctctcgttgtgcttcttcacttttcttttttgtactatatgtttggtttttttttatgtttattttgttcctatctctttcttctatctttttttattttttagttgctccttcgtttgtttcctgctatcttttgtttgcttatctatttatttttttttttttttttttttttttttttttttttttttgttttttattttttttttctttccttctttctcttcttttttgttccttttttttatgttcttttttttttctatttttgcctctctatcttttaccaccctcagttcccttctttctttctattactttttcctttttttactttcttctttctttctcttttcttccttatttgctcccantctctctcacgtctttttcgtctttgttgtttatttcatatttgtttgatatcttttttatctttttctttgttcattatctttctccttctactttctctttttcttttcctctctctttctttgttctttctttttctgtcttn

SEQ ID NO: 728135 - DNA, 140 bp, Homo sapiens
aggggcgactccacacaaggccttgaacacccttctctcagcccaggacgctcatcagcgtcctgggcctgcttcagttctgcccggaggacctgtaacttgtttgtctgagagaggacatgcccactatggctggagct

SEQ ID NO: 728136 - DNA, 1499 bp, Homo sapiens
ggttcgctgtggccgggcgcctgggccgccggtctgttgtaacttcggctatccgctggacccatagtgatctttgcagtgacccagctagcatcactcgtttcttgcgcgtgtgaagataacccaagggaattgaggaagtcgctgagaacggagtcgtgctggagattgcgactacggagtagactattgaatacgtgacgacgagttaccagcgcaaggggtctgctaggctttgccaagaaggaaaggtcgaaactatcactgcgagtcatgatacacactatgcacttgacctacacgtttaaccgctgcgaagggcctatagggacgtgcgcaccattcgaaggggttcgcctattcgcaccatacgcgcggtaaactaccaccttattccttttataaggttacccaatttggaatttggcccctttacattgggccactctggggcaccttgggaccccccacaacggccgcatatatctacacaagaaagtcgaacccaagtactgatgctccgtggcaccattactctctgtgcggcagaatgaccgcccacaagcaaagacggcggacagcgcaaaggtacaaggcaacaaacagaagaaaaagcacaggcacgtgcatcggacagggcaaaggccagaacgccattgccataaggcaatgacccaacacccgaagggccaacaccgaagcgccaaagaggcgaaggcaaggacagaggtcccaagccaaacgcccaggacacgcccacagtaccatgacagaggcccagggaggaatgcacacaggacaaggggccaagcacaaagagccaagcagccacggggatatggagactaaggccctggagccacgccctcgggattgcacgaaggaccaagggtccaacgacccggagatagccacgatatggacctacggatgtaaccattaaagccaaagcaattgatggcctagaagatgctgccgctatcggacagcgggaacgcaggaacggaggaactgaaacccacaaaaccccatagtcttttacgattaattcgccaccgagataccgtaacacacgtgtatacgctcttcccgtttccgacacactagaagcttttgtcccacgcccctcgatattgcgtcccacgagggtggccacagcaggcggagagcgattaccccaagtacttctggataggacttacacgccggtttaacaagcagaagtctccagactttcgtggaataccatgtcacctgcgaagttggcacaaaccaacccagacgagttgtgagagctttagcgcacattggccgcagcgacacaggtatgcacacaatagacccattgtgaacggggagggacagccacatgttagaacgtttagcgcagaagcagttcatagtggtaaaggctcccaggaacggtgaggaatatacagggcagaagacacaacagaaattccagtgagctatataggcccaagcgcaacgatatcgca

SEQ ID NO: 728137 - DNA, 104 bp, Homo sapiens
gacagcatcctaaccaggacgctctaaccagacaggaaacttttgactgctgggctgcgtgccttccagcaggaaggcattgccaacatcacttgcctcaaaga

SEQ ID NO: 728138 - DNA, 334 bp, Homo sapiens
caaatatggtcccttgtttcccctgaagggtcaggctaattttattcgtttttgcaaaaatgttgaacccaaatccaagtttgaattaccagcttatcagcttttctttcaagtaaaaatgatatttcatgaaagtgtcccgttgtttggaataccaattatcccaaatgcttttccttgagacaactgctgtaccttggtatgcaaaaaaggtttgtgtagtattcccccctttgtcccatgaaatattgaaaaaatgtgtactcaaaggttaggatgtcccagtgtatgagattaatctcttcaggttaataaattttttttgccttgtcca

SEQ ID NO: 728139 - DNA, 316 bp, Homo sapiens
aagtcgagttggatcgagtcattccccaaagcttcacaatgtggccgaggacttcgattgcacattgttgtttatttaagtagtcattccaaatatcacatgcattgttacacggaagtcccttgccatcctaaaagccaccccacttctctctaaggagaatggcccagtcctctcccaagtccacacaggggaggtgatagcattgctctcgtgtaaattatgtcatgcaaaatttttttaatcttcgccttaatacttttatattttgttttattttgaatgatgagccttcgtgcccccccttccccctttt

SEQ ID NO: 728140 - DNA, 619 bp, Homo sapiens
  misc_feature (166)..(166): n is a, c, g, or t
  misc_feature (232)..(232): n is a, c, g, or t
  misc_feature (297)..(297): n is a, c, g, or t
tgtctctagaggatacacaactcaggggcgagctgtaactcaggggcgagctgctaactcaggggcgagctgctaactcaggagcgagctgccctagtgaatcagtaaagtgagcaatcagatgatgaacttctgacactttccagtccgcatggcaatgccaatngtgacaagcctcatggagtcaagaagcccagcaaaaagcagcaggagccagcagcccctccacccnctgaggatgtggaccttttgggcctggaagggtctgcaatgagtaacagcttctctccgccagcngctcctcccaccaattctgaactactgagtgacctgtttgggggtggaggtgcagctggtcccacccaggctggacagtcaggagtggaagatgtgtttcatcctagtggacctgcgtctacccagtcaacaccacgccgctctgccacctccacctctgcgtctccaaccctaagagtgggagaaggtgccacctttgacccatttggagcaccttctaaaccatcaggtcaggatttgctgggttcttttctgaacacatccagtgcttcctacgccctttctccatccagccaccgtttcgcctgatggtaccgagctc

SEQ ID NO: 728141 - DNA, 243 bp, Homo sapiens
tgttagtggcttgcagaaacccttcgctgaaccaggagctgttctcatatgctatccaggaatctggcttgcttgaagctatggctctcttttgtatgatgcttgctctcttgattttgtctgccatgtaacaaattactgctagagatgttggcatcatattaattacggatgtactgctgtttatcttactgtgactccaaaaattgtattattggtgtcaggagaatgttcgttattaac

SEQ ID NO: 728142 - DNA, 438 bp, Homo sapiens
tataagagccagcgatatagatactgggcgatgaggtcagtaaagatcagcaggacccacatcatgtgagccctgtggctgtgacagccattttggattgtattaccaagtctcatgagaagccaaggataggttttgaacaggggaatgataggatctgattttgtatcttataagttgtacctcctgcagtcagcagacatcaaatgatgggtgggtgggcaaagcacgggcagccagcagagcagccagttgaggctatttcagtcaatctcaggcagcagcaacatcaagagttgcttcacagtcaggcatgctggagctggacaggtggtgcagcacagggcccggaagccatgcatcatcttttgcaaggtcgcagcaaaatgcagcatcgctgatggctttgcagttggccacgtgcaaggcaaagtgcac

SEQ ID NO: 728143 - DNA, 82 bp, Homo sapiens
  misc_feature (7)..(7): n is a, c, g, or t
aaatcanggcagatttcaaaggaaaggaaattaaaaaaaaaatcagggaacccgttgttataaagtaatttaaaaatgaaga

SEQ ID NO: 728144 - DNA, 636 bp, Homo sapiens
ggagaatcgcttgaactggggaggtggatgtttggtgagctgagaacacgccattgcactccagcctgggcaacaagaacgaaactccgtctcaaaaaaaaaaaaaagtttatttggcaaataaaaaataaaatttttttggaagataaaaaccatgtcttgagctgggtgccctggtgtgtgcctatttccctagattctcaagagttgagacaggaggatcacttgagcccaggagttcaagtccaactggggcaacatgacaagacccttgtctctttaaaaaagcaacccaaaccatgtcttgaaaagctatttaagggtcagacacgatggctcacgcctgtaatcccagcacttggggaggccgaggcaggcggatcacttgaggtcaggagttcaagaccagccgggccaacatggcaaaacccagtctctactgaagtgaaaatacaaaaaattagctggcctagcagtgggtggtggcaggtgcctgtagtcccagctacttgggaggctgaggcaggagaatcgcttgaattggggaggcggaggttacagtgaacccacttggcgccattgctccagctgggtgatagagtgagactctatctcaaaaaaaaaaaccacaggggc

SEQ ID NO: 728145 - DNA, 307 bp, Homo sapiens
gggattagtgcagacgtgtggtaggctatatcatgactgctgtcccagccaacagtggcgaagagcgtgaagaacatgagctggtcggaatccatggtagtgctggaagaggctggctccataagtgaccgtggcccatgtgtgatccatcacaaaatgccactgtcactgggatggcaatggcttggttggtcacggtggctggagaaggtcagggtagtggacagagtgcccttggctgccagccgcggggtccgagacgccgaccgtgtaatgtgatgaagctgggccacctaaaaatccccgt

SEQ ID NO: 728146 - DNA, 643 bp, Homo sapiens
  misc_feature (527)..(527): n is a, c, g, or t
cggacgcgtgggcaaaaaaaaaaaaaaaaaaaaaaaaaaaaattagctgggcatggtggcacacacctgtagtcccagctacttgggaggctcattcgagcccaggagtttgaggctgcagtgagctgtgatcacaccactgcattctagcctggacaacagactgagaccctgtctcaaaaaacttatccaaaaaacaaagacatggcagcagttgactttatcttttgcatatccctgttaagatggaagcctggctactgtagttttgtgctttagtttggtggaatccttagggactgttgaaatatgtgtggttacattggctttgccaccgaatctcctcattctgtaattgttacctgatactttagtttcatggcctcttttgtcttaatgttggtgcattgattggcaaagcaaggactgttaggtggctttttcaccccagagtctgttgcctggcggatttcttggtccttggttattgtaaagtagaattgacatttgtcagaaagaattggatntatagttgtgtacaccattctggggggtgggctttattctttatagaagaatgaaaattctgtgttcctttaaaaagctcaaattcagtgaccttgattccccagtggctgataca

SEQ ID NO: 728147 - DNA, 423 bp, Homo sapiens
tactgaatactgatattgcgatctatgggcaggtcagctagctacatagagatgaatatcacatgctatacggtcatgtcaggggctaaagagcctagttccacgtatagtttaggtcctctaccccacatcactgatgtgttccatgtgatcttcagttacaatgcaactaaaggaaaccacacaactgagtcagatataccacagaatcaagtttgcgctttttatctgagaactgcgacagcactgaattctggctgacaaattacaggtctaaacccacacccacacagttttgatgtaagctagctttaccatacaagtgttaggtgctgcactgtaatttcattgtccgaaatgtgatgacagaatgtccacggaataaaagtacatacaagtcacccagttagattatattgcttg

SEQ ID NO: 728148 - DNA, 260 bp, Homo sapiens
ttctcgagtagctgggattacaggcgcctgccaccacgcctggctaattttgtatttttacaagagacagggtttcaccatgctggccaggctggtctcgaactcgcgactcaggcaatccgccatctcggctcccaaagtgctgggattacaggcgtgagccaccggagcttgctaaaatggagttttattactcctttgaaaaggaatactagatcaagatgactgagagattgactcgtggatttggcgaggggccg

SEQ ID NO: 728149 - DNA, 341 bp, Homo sapiens
cagcattcctgtgcatctcacacaacattttattttttatctcattgaccagatcttaatcaaatggccacacctcactgcaagggaagatgaaaaatgtggtctttttcccgggtacataagtgaaatgtgaattttcctacaaagagaaaagggatagtagattttgagcaggaacctagcagtctctgctgcaggctgacacctttgtgagtgaggtatataaattacagctatgccaaaaactaaattatgtaaatagaagaaatttaaaataattatttgggtctcttgcagactgtgtaaagctgctttctctcacaagtattaaaaaaaaaaaa

SEQ ID NO: 728150 - DNA, 913 bp, Homo sapiens
tacaaaccagaacgacatggatcactatagctatattcggcgcatgagctggagtcctaggcagcagctctaaacctccttatgcgagccgagctgggagagtcaggcaaacttctaggtaacgagcacatctacaacgatatcgtcacagcccatgcattgtaataatcttcttcatagtaatacccatcataatcgcgaggcttgggctattgactagcttcccctaataatcggtgcccccgatatggcgttatccccgcgatataatacaacataggctttctgactcttacctgcctctctcctacttcctgctcgcatctgcttatagtggaggccggagcacggaacaggttgaacagtctatcctcccttagacagggaactactcccaccctggagcctcgccgtataaccgttaaactcattctggcttccttatcatcctagacaggtgtgtcctacctatgctgtaggggccatcaaatttcatcatcaaacaattatcattagtaaaacgcccctggcataaccgcaatagcaaacgcgcctctggcggctgatccgtcctagtcagagtagtcctacttgctgctatgctcttcccagtcctagctgctggggatcactatactactaacgagacccgaagcttaacaccacttcttcgacccgcggaggaaggagaaccccattctaataccaaaaagctattctgatttttcggtcaccctggaagtttatattcttatctagccaaggttcggaataatctcccctattgtaggttactaatccgggaaagaagaaaccccttggtgccctacggtctgggggggccagaaatcacgggcgtcccaagagaacgggtgaagccacaaattcggctggtggagggaacccaggtttt

SEQ ID NO: 728151 - DNA, 303 bp, Homo sapiens
  misc_feature (26)..(26): n is a, c, g, or t
  misc_feature (261)..(261): n is a, c, g, or t
acatcccagaatatctgggacacacntaaagcagtgataagagggaagtttacagccctaaatgcccacatcaaaaagttagaaagatctcaaataaacaacctgacatcccaactagaggaactagagaaacaagagaagaccaaccccaaagctagcagaagatagaaataaccaaaatcagagctgaactgaaggaaattgagatgcaaaaaaagccatacaaaagatcagcaaatctaaggaattggttttttgaanggaattaagtaacgatacggtagactgctagctagactaata

SEQ ID NO: 728152 - DNA, 102 bp, Homo sapiens
  misc_feature (99)..(99): n is a, c, g, or t
  misc_feature (101)..(101): n is a, c, g, or t
agaagcggtcttggaggtattgatttaggtggttggattttttccgtggctctatcaattcacaattcaaattaaaaagaaaaattcccctccggtcgncnc

SEQ ID NO: 728153 - DNA, 926 bp, Homo sapiens
ggtctggctccgtgacctgctattaggttcttacagtacgtcgtgcgtagccacttaggtgggttcgtgcgccttctacctcgctgtgtcggtgttcctgagctcctcggaccttttactcctcgctgttgtcagcttgggaacggagctgaagcgcgaagctgggtacttggctttacctgtctcctgaaagaagtttaacagcaaaacattggactatcagaccacatgtcattacaagtttagtatcaaccatattatgagatgacaagaattactaacggggagcgacattgaagaggatccctaatatgcccttgtttactcagtttgggtcatgtggtggacactttgctggctttaaacgaccatagaatgatgacgcgcgggcaaggcctttgtcatattttaaaggacactggcgctcatccaacaaaattgccttgaagacacgctacaagggatttccatgttgcatggtaaagccaagtggcggaactaaccggtattgcaaaaaaacagattcggatactatatcaagagaattgcgtgggaaccttttcgctcgccgaagaaacagggacaacacgagtggacaaaaagccaaagactgtggaagagactgcaaggaacacaaacaaaaagcctggccagggaactccaaattcaggctaatacccagggaaattcaacaccaaatctcagggtgcctgattactctccacatatatttattccttaataacttaccaagagagactactgcgatgatggcatccagggttactagtgcccggctcaagaagtcgcggtaccagggaggcggacctcgtttggcgagtttcaatgtggcagcgtgctcacaggtctttcggattagagcccggctgtttggaaaccttcccaaaaatagggatgtttaaagg

SEQ ID NO: 728154 - DNA, 843 bp, Homo sapiens
tgatatttatggattactgagcaatgaatatatgctaacattcttctatgaactagaaatggatcaacttatgtaattatcccaatcatgtgaaataggtactactattattgctattttcaaatgagaaaatcaagcaaagagaggttaaacatttctccaagtcacacatttacaaagtggtacagactaattcaaatccagtttcactcccaaggccctcttttaaacactgagagcttcatggtgtttggccatgaagagagagaatcatgataactcaggaaaagagtactatgaaagagtggacagaagatgtaggaaaaggacactcagaggactgcaaagacttgaagagtgggggtatcaagagctaagacgcagcaaacatgggcaagacagaggagaacagcaacaaaatggaaagctccaggcagtggttcagtctgaatggtttataaatcaggaggaatttgtaaaccaaacactgaatctgaaagttgcttctgcttccatcatgaatcatcaattttattaattttgaataatacaaaaaaagatcttgaatctaagaaatttagtaatttaaagaaagaacactaacatagctaaagaaattaaatgagagacaaaagtttgaaaaatgcttagtctttttttttttattagataaaatggacctcactgcaatgatactgcagaaaaaaccaggtggatatgtcataaatgtctgcattacttttccatctgtcattcaggggagataggtacctacaaatatatatgctgttagtcaagaaatttattttggtattaagaaggactaagggctatgagtacaaa

SEQ ID NO: 728155 - DNA, 561 bp, Homo sapiens
  misc_feature (1)..(1): n is a, c, g, or t
  misc_feature (3)..(3): n is a, c, g, or t
  misc_feature (37)..(37): n is a, c, g, or t
nanagtttgggctccaaaaagtttgaccctccccaangtggctcctaaagatacccttactattgtaaaccctaatgtgagtttctggggtgctagttaagttggtctcccctgtgtgagacacccatgggaagccatggcggcctctgaggagaaaagtctccttattgccttcatgtctttatgccccgagagcataactcttcagcagcattccatgggttgctcagggagatcacactcccttgaagcagtggagcataatcaaacatcttggctcctcctgaaacccgcagccacccgtttcagttaagttaaagatcttaagtagtttagacacacgcctttgttcaaggaaattcacagaaacggccagtgctttacatcttatggaatgactcacgagttctcctttactgattaatccttttcctgatcgcttcctccccctccaatcagccataagaacaaagagcttgtaaaccaataaactgggtggagcccaagagctctgggccgccaggaagcctccaatgctctggccacctggacccgcctttt

SEQ ID NO: 728156 - DNA, 110 bp, Homo sapiens
gctgcgcaatcaccttgcctcttagatgagggtggcttcacccgtgatttcaccaaggctgacgggcctgtcacgacggtgtacgacgcctcggtgaattaccgcgagca

SEQ ID NO: 728157 - DNA, 339 bp, Homo sapiens
ccccctttttttttctcccccttaacccaccccgcccccccggacacccatgggggggggggtcccccctttttcccccccatgggggggaaatttcggtgggcccttcccctgccccctcccccccttacaagggggccccccccggttggggggggggccccccccctttaatttgggcctggggctttttttgcccccccgggatcccctttttggttttttcggaattccccccgggaaccccggtttttttttaggggttttttattttttccttatttcccataatttttggggaaacttaaaaaacactaaccattaagttggagggccgga

SEQ ID NO: 728158 - DNA, 424 bp, Homo sapiens
  misc_feature (132)..(132): n is a, c, g, or t
  misc_feature (283)..(283): n is a, c, g, or t
  misc_feature (300)..(300): n is a, c, g, or t
taagaaactttttagtaaaattttagaaagcaatgatttgtgaacttttcttactttgtgggacacaaaatatttccaaaatgtgaacatcaatgttgggtctttgtaggtggagggtagaagattggaccngtcttcacagaccatcatcccatgtgtagaagcctccatggccagccaggcttcctgcctggaggacagctgctcccctggctcagtgcagttccgcaaatgtaagtcctccttggtgaagcacagctctatctggccaacggtctgcacngctctctcccctgttcntggcataaggcactggattttaggcaccacaccatagattctgggtaagtgcatctttgaaatctgcaagctggtagtagttgatgggatggcttgatccccaaatttttgtagcacactgttg

SEQ ID NO: 728159 - DNA, 219 bp, Homo sapiens
cgtcagtggtccacacatctagctgcctcgggcctggtcaggtgagcagaggggaggggaaaggagaccccctcactcagtgcggagccatgctggctccgcctccagagcctggagccccgtcccctcgggctccttccctgcaggatttggcggagcctgaggcgacagaagtgagactccgatctcaaagaaaagtaaaaataaaagataaagtaa

SEQ ID NO: 728160 - DNA, 108 bp, Homo sapiens
  misc_feature (96)..(96): n is a, c, g, or t
tgttaagcagattacttcccaccagtattgagccaggagttgaggtggaagttcccattgcaaatgcttaagtccactattttaaaaaattgatgncccggttggtta

SEQ ID NO: 728161 - DNA, 357 bp, Homo sapiens
gtaccccagatggcatgatttacattccaggcccctgctaaataaagcaggctccaatgccagctgatactgtacacttttactatgaggggaagagttacttgtctatcagaatactgcagtaaggtacctggatctgttacatgctcatgtgttccggaagaacatataaaatatcatcccacggatgacgatacagacccctgcttcaagccactactagatcaagatagtgtccaatgaaccccatactccttcccagcacaaagatgccattgagggctccaatgtcaatatattcatcagcttcctcccgagtaaaggaaccacaacttctaaggttaagggggatcctct

SEQ ID NO: 728162 - DNA, 182 bp, Homo sapiens
gagagctggcatcagagaggatgtctgggaggagcgggctgtgagctgagcggaggtgcccccgtgactggaggcttgagagctccaacgggaagatggcttcacggacggtcagacagagacaggaggcctggcgatgatcttgaaccctgtctccctgtcgctcgtgccacaaggggatc

SEQ ID NO: 728163 - DNA, 1024 bp, Homo sapiens
tagcggaactcctcctccaaggttgggccccctaaggccaaccctacgatttgccacaaacgccacataccgacgccttcctctcggaagacctctctggtccggcgaactcgccctagaaagggcgaacgacgtacttcgaaatcggaaaggcgttccaaaaagggcttcgcttggaaaagtgcgcggccctttgcggggagccaaaccggggctaccccaatgggggcccacgccaacacccctaatgggttggccaccgtatggcccgcggcccccccaccttcaaacccctaaagacaagaacatcgggctctaccccttaaccccaaggaaccgccgagaagggaactggcgtgagagggaaagggttcaatgccatttgggcgcgcgccattagaagcccacgcttacctcgctagacacgtgctatggccaagggaagccaagcaacgccatgggagtaagggcgctacgcgcaaaacaaggtgcgttaaacgggttcacaaaggggaactctgtggctccttaccctttggaggggaaagcctttctgtagtaaattggcgccttaacctcacccatgggaaagggggccccccggccgttgtcgccccaaggagtaagaccggttggcaaggccgccaacccaccattgcaccacgcttcgatgcatggcccatcttctggtaccctaatgagcttgttcactataggccacgcaactccatgcccaccccgcaccagctggaggacccagcacgtcacaagtgtcgtctctcttgtgccagacacaagcggccacgatggggggtggggggcagggagtgtacacacacagggccattgtctcacctcccaaagggaccgcctgcccccagctcatcccagagcgtacactgactgcaaccctgacagccgtctcaccaggccgcgttccccaacatccccgccccagcctccctcattaccccagaaaggtcaggtatgacctcaaaagcgaggaagtcccaccggccatgta

SEQ ID NO: 728164 - DNA, 192 bp, Homo sapiens
ccagcatcaagaggggggcttgagagggaaagatcattgtagatgaactgaagcatgaagttatcagtaccagcagcaaggcccaggcaccccagtgcacctacctggactgccctgtggacggagacactctgcaggctgcctacacgcacattcagaagcttggaacttgcctgaccctcgctccactca

SEQ ID NO: 728165 - DNA, 1032 bp, Homo sapiens
gctggaagtagaccgtgaggcagagaagaagcgtgagggtaagcagcgagctaaggaagctcaggagcgggaactgcggaagcgggagcaaggcggaagagaaggagcgccggagaaaggagtatgatgccctcaaagcagccaagcgggagcaggagaagaaacctacagaaggaagcaaatcaggccccgaaatctaattctggctcccgtccccgcaagccacacccggaagcagactcgttcctgggctgtgctgaagctgctgctgctgctgctgatatatggtgtggcgggagggctggttgcattgtcgggtgacagagctgcagcaggcagaaccctctgcacaggggtgaaacacatctatgacaatgcggtcacagggtcattacgcacgcatgagatcctccagtggggtcctccagacgcgaactctcagaagtgagcttgttccccagacaccatgctgcctcccagacttggagtaaggatacctatggaattgggttctgctggacacaaacctctttctaggcatcagacctacctgcatcatcacatggctgagatctggatacatgagactcctctacagtaggacttctgcattacttagatcagggttcctgaaacgaatgacggcggaacatgggaggaggcgggggcgccaatggaggggcagccacactgcatgcctaacgacagtatgggcctggaggtcgaggacaagaggaaaccaatagcctgtcatgattgctctactaacgctgtgttagagcaccggactgtaaactatagggacagcggctcacacttataatccgaatgcccaggaccattattactcctgaaacgcgaaacacgagaactgaggaacacacaagacgaaaccaagcaaacaaggagccgcctcgataacaagacaacattctgagccaaaactataaatcgcaacacacagaaaagcagacgtgtcaggaacaaagaagaaaagaacaaaatatgtaacactgagaagactaacgatag

SEQ ID NO: 728166 - DNA, 237 bp, Homo sapiens
tcttctggccacgcccaagacagcggcgctaggggctcatatcgtcgatcggatcagagagttgctcggcgagaatgggttatctattgccgagctgacggagcggagccgccctctcccaacggattgattcaatcgttgacgctcctcctgtccggatccgggttttcgcacgctgatcaacagagttacagcgcgcaacgcctgtagtgggcatcaggggatgggtggcaatca

SEQ ID NO: 728167 - DNA, 331 bp, Homo sapiens
ggttgactgtgctttgactacatatttaacattcatatttttcctttgatataaatggccttctttttatcttaagttgaattgctgtgtgaagtaattatgctgttatatcgcagagtacaagttggttgattttctgcttttacaattaagtgtggttggcataaatcctaatggctcaacccttcattgaaaagaatgataaaattaaaatgaactattaatgttatgtttaaaatccaattattatatataatgtatcagatatattacaatggcatatggtagatttgtatccttttcaagtcttttaagtaaaatattacgtatc

SEQ ID NO: 728168 - DNA, 452 bp, Homo sapiens
  misc_feature (3)..(3): n is a, c, g, or t
  misc_feature (19)..(19): n is a, c, g, or t
  misc_feature (400)..(400): n is a, c, g, or t
aantcccatttaacttaanttcctccccctttaccctactccaaggacattgttcccaaaaattattttgtttcttctgtatcacccagtttttcttcctactgagtcattccccacagtatcacaaacatactgttatttttcccttaaaataaaaagtcccctggtcaggcatggtggctcatgcctataatcccagcactttgcggggcagaggcgggcagtttgcttgagcccaggggtttgagaccagcctgggcaacaaggcaaaactctgtctttacaacgaatacaaaaattagctgggtgtggtggtgcacgcctgtaatctcagctgctagggaggctgaggtgggagaattgcttgagcctgggaggttgaggctgcagtaagctgtgnagttgccacagcactctggcctggcaacagaacaagatcctgtcaaaaaaaa

SEQ ID NO: 728169 - DNA, 339 bp, Homo sapiens
ggtggctcatgcctgatcccagcacgggaggccgaggcgggcggatcatgaggtcaggagatcgagaccatcctggctaacatggtgaaaccccgtccctactaaaaatttaaaaaattagccgggcgtggtggcaggcgcctgtagtccccactacttgggaggccaagacaggagaatggtgtgaacgggggaggcggagcttgcattgagctgagatcgtgccactgcactccagcctgggcgacagagcaagactctgtctcaaaaaaaataaaaataaataaattagtaaataaattcttcctcatagaaagacacaaagtacagagtcctaac

SEQ ID NO: 728170 - DNA, 335 bp, Homo sapiens
  misc_feature (316)..(316): n is a, c, g, or t
ccatgcactaacattcattgcacagacacataagccatgcacaactatcaatgctgagacaacaaacacgcatgaaatgccaatctatatacttcgcacatacatgagctcacaaacgatcgcttagtcactcattttttcagctgcacccagaacagagatgccctcatctagggcacggagatctccgtgattccaactgtgcagaccagatatacccctcactgctgcaccctattacctggcctctaggaggcttccctccaggaagccaggatcaatgcaacaagcgtactgcagctgacatagtcccgangatactagatgaacatgaa

SEQ ID NO: 728171 - DNA, 394 bp, Homo sapiens
  misc_feature (191)..(191): n is a, c, g, or t
ggtctgtatctctgaagtgtagagaaaatagtgtctgctgggtgggatcgttatgaatgttgaatcaatagggtgattgtgaggaggcccaagcggtgctgtgcacgcagtgactggcaggaggacaccttcccagctggcggctgtgccaacaactcctctctctgtcccgccagccggtgtttgccccncatgcttcagagcaacccaagcatgctgacgtcgggcagccatccccaggccatcgtgtcatcctctacccctcagtacccttctgcagagcagcctaccccccaaagcccttttatggtgagtcctgcgcctggtcccttctgctctgggctgtgtgccaagcccccttctggtgtgctcagcactggttctcccttctttc

SEQ ID NO: 728172 - DNA, 986 bp, Homo sapiens
agcgggaagctgagctggctggtcggcggcggcggtcagtgagcccggtgatggcgtgacgcgggaggcggcggcggcgcgcggagacgcagcagcggctgctggcagtgatgtcgggccggtcggagcgtctagctccctgccgcctcccgtaagcccgcacgtgtccttcccaggcagccctcggggtcaccccgtgcgccggcggccccagaaatccttgcgggagctactcgggtgccttctttcttgcctgtgagatgttctgattgcggcggtgtcttgttcgtgcgatctttgagttgccatccatcacaactgctttaccacgtaactcttcttagttaccagaaggactggggctcactgatttgttgtccggtgacgcacggcgctgtgtgtgcctgtgttgcggcctaccgtcttgttccttggtgcacttgttcgcgtcctcgttggcagtggcgtggcttcagagaacgttcgacgtgcgttaaacttgagaaacctttcgccttgggactttatatgctcgatatgcaagtatttgaacaggggtgacttgtgcgtccttccctaacttgtctgtcggaccgacgcttgatacataactttgggacaatggcagagcaatgcccagacaattctcccttgcaagttggagttttggccagtttggcacagtaacaaagccaatacaccgtggtcagaccaacattcactgaagttgaataacgcatgtgataacgatacacactgatagtcacgccctcaaatgttttttgccattttagtgacctgactaggcttttgttcattggtgtgcgagtatatgcggtcatggcttttaccagaagataggtcgaccacgtaagcactcccttgagacaactgtgtgcagtcagtagtttggtcaggttttcaccatatagtcctacgtgttaatattggtctggatcacattttgggataccaatttttgtcca

SEQ ID NO: 728173 - DNA, 401 bp, Homo sapiens
gcacacacctgtgatcccagctacttgaggctgaggcacgagaattgcctataccacagaggcagaggttgctgtgagccacgatggcgccactgtacttcagcctgggcgacagagtgagactccgtactccatctcaaaaaaaaaaggaactttatctttgaaaaggaacaacattctgagagtgagggagatctagaagattctaattttatccagataagcccagaaattatttagaatgattcaacctaatgggcgatgtggtcagcatgtgcctgtcatgttccaaaagcatgagtgatggttgctgggttttggggctttaaatttaaaggactttaataaaaaaatatttccttttatataaaaaaaggggcaacgggggggcgcgcccccac

SEQ ID NO: 728174 - DNA, 163 bp, Homo sapiens
caaaggcaggcttcaaagctcccccagccatcaatgccagggtgccctttaacttttttttcccgtttgtttgacaatgctcaaatgcatcagttccttaataaacccgtgaaatttgaaaactggacattcggtgagattaaattttatatccccctagcca

SEQ ID NO: 728175 - DNA, 127 bp, Homo sapiens
tcggtacactattcacggttggtcactcctagaagatgtttgtttacaagagggtagagggatgagaggagctggaagaccacgctgaggagccacgtggctctgatcccaagcactgagtgccctc

SEQ ID NO: 728176 - DNA, 122 bp, Homo sapiens
ttcattaacctgaaaataggtcacgagctctttcattccagtaaagggaggacggaaaaaaactccaattcaagagatccggccatagatagaggacacaacgtcgtgacaaggcaaaccgc

SEQ ID NO: 728177 - DNA, 722 bp, Homo sapiens
aggagccggttccctgtgtgtgtgtccgctcgccctctggtccgtcctgcgggtgccactgggctcctacggtccaccatgggcctgctgcactccgggcgcgtctccccgggatctgccgccgcttccacccgggcctcgcctgccgctgtgctctgccagagccagctcctgtgtgttgacccatgtgtgaaatgtggacctccagatcccattcttgggagtcactgaagcctttaagagtggacaccaatatgcaaaaatgatgaatctgggagtttgtgtgcctaccgggatgataactggagaagccttacgtgctgcctagcgtcctgcaaggcagaggcccagattggcgcaaaaaatttgtgacaaggaatacctgcccattgggggactggctgaatttttgcaaggcatctgcagaactagccctgtggttgatgaacagcgaagtcttgaagagtggccggtttgtcactgtgcatgaccatttcttggaacttggagccttaaggatcggagccagttttctgcaaagattttttacagttcagccgagatgtctttctgcccaaaccaacctgggtgaaaccacacaccatcttcagggatgctggcatgccgtacaaggttatcggtattatgacccccagactgcggtttgacttcacaggcgctgtgaggttttccaaatccgagccaggtctctctgtgccgga

SEQ ID NO: 728178 - DNA, 147 bp, Homo sapiens
tcatcgaagcactgtctcagagtctcagtgggatcaccttcatttgctggaaccagcagcctcctcctctgagacctttcagcttctgccggttccagcagtatgctctgcactccccgggggtacaacatgtagacaccgtgttgg

SEQ ID NO: 728179 - DNA, 349 bp, Homo sapiens
gttcttgtcacactggtccttcatacgcaggctgcccgtggagttgtggcggatctcccggcacacagggcggtcattttcaacttcttgtatgaatctctgttggcgggtgctggaaggccgggctatggaagaggatgtccatggcctgctgagcctcgtgtatcatctcaaggaagggctggaacatggcgtggaagttcaagggctcttacggagagaaaggcatcaagctgcggacgatgcgggacttgggaaaaaagaattgaggccttctggtggggcagctgcaaggccgtaatggtaggtattctggggctccctcggtgaagaaccagttccgaaaaac

SEQ ID NO: 728180 - DNA, 509 bp, Homo sapiens
  misc_feature (430)..(430): n is a, c, g, or t
  misc_feature (466)..(466): n is a, c, g, or t
  misc_feature (499)..(499): n is a, c, g, or t
acccggacgcatccttccaacatagcactctgacatgtgcagtactcgtctccttcgtacgatatcttctcgttccgtttgagctctcagaggatctgttcttcccgttcgaggaatgaattcaggagtcaagaacctgcgttccggttccacggggcggcgcgtgtccacgatgcccggtttcggcggcgggtggagcgctccgggctcggaaggcccagtgctctgcggcgggacaggccccgcgtggaccctgcaggcgatagaggccgccgggggcagcagagtcctggcggcttggaaaccccggcctaggcccattccagcccagtgcgccgctccaatgcaggccgccatgccagctcgtgtcgaattcctgcagtcgggggcctccgctagttctagagcggccgcccctccggtggagctnctaagggtcttccaaatctcggcggcgcgcctcctnccgctccgaccgcgctccgcgaacatcccgcgngcgcgctccg

SEQ ID NO: 728181 - DNA, 1377 bp, Homo sapiens
  misc_feature (572)..(572): n is a, c, g, or t
taggaaaagaacaaaaaaaaaaaaaactccatggcttttattagagtttggaatactggtgaaatttttcaaaagaaaagtaattggattcaccatttttggctggcttaattaacgatggagctggtggtccattaagctggtgtcaccccaactctggcatttccagaatagtccctaacccaattggcagcggggcatgtttttggagtgtgggtgtggcattctccatgttgtgcttgtgaatttggctccttagaaactgtggcaacgagggcctgtgcccttacctgtgcagcccctgtgggttgtggtggccctgtgttggcgttcaccaatgtggtgatttgtggcgacacccccggcgttctctataggggccatatattataattctcagcgccagagaaccttggagacacccttggaccacaagggcgcaggaaagcgcaattcaattcagagagcgcatataagagcgcttagacagagaacacgattgtgatgtggaccagcggggacaccccaccagaggggcccttctccgagaatctctgtggaagagtggccanacacagaggtgaacacgagagagagccttctccaaaggggccatctcagaaagagggtgtggtggggagagacgcaatgcacaacagagttcactctccaagaaaggagagtgtgagagagacagcggttgtggagacgccctgtgcctgtggggacgaagacgcagagggcctctgtgggccccaaaagtgcggcctaagtgtgtcaccgtgggggaaaatatcccggtgtggcaagacaaaggccccttccctagtgtggtgtctccccagcgttttggtgcgtttccccccgcaaaatatttaagcgaggaatcttcctcttgtgaactctttggagagcaccccaagtcttgtgaaaggtggggaggctccctacttaagctctacttttttacctaaatgcggggggggctttgtgggggcccactctgttggggcctgtacggataatcctcgttaggggcgccaaaagtgtttcctgggacaaccttttggatattgtggtcttttgaaaccaccctcgttgtgttcccaaaaacggttgtggtgtgggtcccctcccggtggtgagccctccttaaagagaaatggggggggttcgaaaacaagtgtccgagaaatgacccatatcacaataaagagtcactcacaaggggagagaattttaaaaccccgggggggaaatataaaaaggcgcataaccgagaaataataatgtggggccccccttttaaagtgggagaccccacaaccaaaaattgtggggggggcgcaaataaaaatatggagggtgagaaaatcc

SEQ ID NO: 728182 - DNA, 818 bp, Homo sapiens
ggtaggtcatagttccttatacacagacacctgcatcatcgaaggtctttttttcctaaaaaaaaaaaatgggatttagtcttatctgtgataatatcctcctcatataatactattcttttggacaccattggaaggaaccaatattgggaccttatttggaggtttgtctgtctcgaagaaaaagaaaataacaatgtataggcagggttccttcaatgtggcattttccccagaatttgtgagccaaagcctatagtaatgtgcagacagcaaatgattccaggatctctaaaaaggtctctcagatgaaaagggagtaaccgggaaaaaaacgaggtcaaccactgtgttctgataatgtacttgagttccatgtgtgctttagtgtgatcttataacaaaatgtttacactctgcagatggatttttttttaaagaacatggggttcactttccctatttttttgaacacaactgataatctttgggtcaacatgtgtcgtgggaatataacccctttattttttaaggaaaaccttgaagtgtgtgtaatagggaagtataacattcaggttaatcgcatctggggacgagcaattcaggcactacttatataagtaatcgggggggacactaatttaatgcaatgacccttttaaacccttgtgatttggttatttccccactagaagggaagggatcattcactgaagtattttaataggcaatttttgtataacaggaacctcggggtggggtgacaagcactattatttcgaactgtggcaaaaaatggcccttgggaagtggtttcc

SEQ ID NO: 728183 - DNA, 428 bp, Homo sapiens
gcgtattcccttgggccctaagttctcatctagactagacgaagcacctttacccagtgcacctggtggctgctgcaaatggactatggcagcttctagtatctgctcctcaaagttcaaggactcatctgcctcctatgggtttggcccggggctatcagctgctctagctttttggctgcagcctcaatggcggctgcaagctcccaggagctcatactacagcaataactagtaggtgttctctgggtctacccatatctgtacccttacaataggcttcagcagcctggatgagctcagtgacggaaccagccacacgcttagaatgtcctgtcaactgctagtacagttactagggctatggcttactagcagggtccagcagtacatggtccagcaattccaggtagccattgcactccgga

SEQ ID NO: 728184 - DNA, 382 bp, Homo sapiens
gttccccctgtttttgggatgtggccctttaactgggggggctccttgggtggattaaaaaactggcccagctgcaagccccttagtttcctgcgagggtgcccaaaatggagcttggccttagggggtttttcaaccctggcccccccagtccccaaaggcccccaggagcccttccttttattggaccgggtggggggtggtgggaggggcccccctaatttagctttttttgcccttttttttttttttaaattccaggttattggagggggccccccctttgcccaaatggttttatgctccttttaacaggaaaccagggttttggggggcaatttttttttttactttttttaaataaaaagtttcccccccccca

SEQ ID NO: 728185 - DNA, 417 bp, Homo sapiens
gtgttctcccggacgagggatctgatgcgggccggggtgttgaaagagaagccactgtggtatgacatatataaggcctttccacccctgagagagcctgtcttccgaagccccgcttgcgatacggcaaagcaaagctgacatccaggacatcttttaccaggaggatcagattcgagcgaaattctttgcaacctatggatctggtcagaaagcttttgatctcttcaacccaaacttcaagtctacctgtcagcggtttgtggagaagtacacagagcttcagaatcttggagaaacagatgaagagaagttatttgtagaaacggggaaggctctgttgggcaagaaggcatcattttaaagaagagttcgagaagccaaggactgtcagcgtgagactccaagcttcatcag

SEQ ID NO: 728186 - DNA, 680 bp, Homo sapiens
  misc_feature (245)..(245): n is a, c, g, or t
ctccaaactgcatgggcagaccgggcacgcaattttgtccacttctcagcgcaaacggaaacctgtgaagaaccgcttacatacgggggcctggaaccagtattggttgtgcatcaattcaacgccattatgtgccaaagtctccaagtggtcaacatattcattggtgacaagggcaacagcttcagaacctgggaaagtgaatataacaagtgttcacacagatgtactaaacagaacgttcncggtcgatgcagaactatgcgcactttggcacatgcagagcagttcattaaccaggtggcacttgttcagctggtgcaactcaagctggagacgacaatggcgcaattaggacctgttaggaatcacgttggagctctagtaaaaaagtctctatggacttaatctcagtagacaggctctcaataggagaggaacaacttcgctgcttcaaggcagccagcctgggtgtaaacgcttcacagttcgaagcataacagcttgccttgtttataggacttaatctgtgcagatcgatagcgtattcttctgattgtacaatgggctggtgtagatccaacttccttgtaagagcaacataacttcctgtaaccatcccgcctcagtttttatgcggatcattaaataacaactggcatgtctctaaaccttttgtt

SEQ ID NO: 728187 - DNA, 705 bp, Homo sapiens
cataatgtgagcatccagtgttagtattgcactacatctcagttggtgggtgttaagctagaatgggctgtgtgataggaaacaaatgcctatcagatgtgcctaggtgttctgtttacatagtgtcttactctgttatctggatctgaagactagtaataaactaggacactaactgggttccatgtgattgccctctcatatgatcttctaagttgatttttttcctcccaagtcttttttagagaaagtatactgtattttaccaaccccctctcttttctaatagatcctctgtggtgaattaaacgtacttgagttaaaatatctcgatttttttttttttttaatggaaagtcctgcataacaacactgggccttcttaactaaaatgctcaccacttagcctgtttttttatcccttttttaaaatgacagatgattttgttcaggaattttgctgtttttcctaagggctaataccttgcctcttattcctgctacagcagggtggtaatattggcattctgattaaatcgtgtgccttaacaaactgggagtttaaaaatgcccaagtccttacaatgatgaaggaattcatttatttagaaggtctttttcttagaaagccaaaatgtttgtttttttaagattctgaaatgtgttgtgccaccaatgacctatttatgataataaatctttttt

SEQ ID NO: 728188 - DNA, 665 bp, Homo sapiens
  misc_feature (25)..(25): n is a, c, g, or t
  misc_feature (88)..(88): n is a, c, g, or t
  misc_feature (162)..(162): n is a, c, g, or t
  misc_feature (164)..(166): n is a, c, g, or t
  misc_feature (199)..(199): n is a, c, g, or t
  misc_feature (264)..(264): n is a, c, g, or t
  misc_feature (269)..(269): n is a, c, g, or t
  misc_feature (304)..(304): n is a, c, g, or t
  misc_feature (320)..(320): n is a, c, g, or t
  misc_feature (442)..(442): n is a, c, g, or t
  misc_feature (470)..(470): n is a, c, g, or t
  misc_feature (477)..(477): n is a, c, g, or t
  misc_feature (479)..(479): n is a, c, g, or t
  misc_feature (543)..(543): n is a, c, g, or t
  misc_feature (556)..(556): n is a, c, g, or t
  misc_feature (592)..(592): n is a, c, g, or t
  misc_feature (659)..(659): n is a, c, g, or t
ggggcgacggcccggcgcagaggcnccgggagcgaggaacgcgttcaccaagcgggagggcggcaaggaagaagcggcggaacagcgncagcagcgggaagggcagggaacggggaaagcccagcccgcgccggggcaagcggcgggggcgggcggcgcggngnnnagccggggcgggaaggggggggcacggcggcgngggggggcgaaggagaggcaggacccaagaaaaagggccccagcgcgcatgcgtgaaggaaacgncattnagcggccagcgggcgcggggcgaaagggcattagnaacggagagagaagtngccttattcagggggggaaaaagcccggccaagggaaggactcttcgacccaggaccggggggagggaggcccaacacagggcagcggggtcgggaggataaacacaatctctgatcaagtncggggaggcggagtgtctgtacggcctngtccttntnctccctgatgcaaagtgagcttcctcagccgtgctgccttctcacacagaagcattcacctgtnatgggcctgagtnacctatcacatccccaaaaccaccaccttcctagtncttctccacaacgccaagaactcacttactcaccagattggtgaaatagtagccatcctctccagtnatcagt

SEQ ID NO: 728189 - DNA, 322 bp, Homo sapiens
cgtctcgatcatcctgaatctcaagatgatccacctgcctcagactcccaacagtgtatcggattacaatctatgcaccctctagcctggccattgctgattctttgttttgttttgtcgtgttgtttgcgacccagtcttgctctgtcgcccaggctgtcagtgcagtggcgcaatctcggctcactgcatgtccacctcctgaattcacaccattctcttgcctcagcctccccagtagctcggactactggcctccgccaccatgcctggctagttttttgtattttttagtagagacggggtttcaccatgttggcca

SEQ ID NO: 728190 - DNA, 755 bp, Homo sapiens
agcggatcggagtgatccaggcgatgcgaagtcccgggcgctaggcgaacttcgcaaccggttcttggctcctctcctctaggccgcgcttggggtctctcatctctatcgtcgttcgccaaggtgttggacggagaaggccagcagtccttcagggaagatgggaggcgaggagaagccgattggtgctggtgaacgacgaagcaaaatggaacggaggcaaataagaagaacaaagaaggactctggcagatggaggtcgagctgagttgaatcctgtgggctgaatatatttacacacgtcttgagatgtataagtatactaaaagcagaagcatgattccatatctggcacgcaaaaggcagagccaagatagcaagccaattaaacgtcacttagcctgatggtcaacaggtagatgcggaatcttggaaaactacaccatatcaacattgcctgtggaattagtcaaggcctggccgacaacgcaccgcttacttgcctaagaggtacactaactgttcgtgctgaggacccttgggaacagaccgtctgggaacagaccggcaattggtaccgttgggagaccttcttcaagactttgacgggaatgagcgacaagcttcagagccggtgctcacttagggcacctctaacattgccttcagcatacatggcctgaaagccaatgagagaaggagtcctaatgggtggcactgtctcaatgactacgggacccggcgaaataacaaac

SEQ ID NO: 728191 - DNA, 390 bp, Homo sapiens
atctattgaacctgcaagcactaccaaccactgtgacctacaagaatgatgattctaaaaagttttcctgaagaaatgaaaaagtattattgcagtcccttttcctttaatgatgttctttcacccttttctgtttgctaagtgaggatgaaaaaattacactgttctgcaataaggggagagtaaaccctgttctaatgaagcctgtgtctcatgagagtagagtcactggaacactaatgaggaaactgcactgttttattttaattcagttgttattgtgtcttaatgtgtgcaattttttttcttactaatatccatggtttgcaggttctgttaggccctttccttctccttacttattatccccaattctctaaccagtcctct

SEQ ID NO: 728192 - DNA, 282 bp, Homo sapiens
  misc_feature (34)..(34): n is a, c, g, or t
  misc_feature (65)..(65): n is a, c, g, or t
  misc_feature (113)..(113): n is a, c, g, or t
acagaagtaggtccagaatgtggataaaacaaancttcatggtgaaggagcacatttgtacccanggtaaggaagctaagaatcataaaacaatacaggagctgaagacaaanatagccagtatagagaggaacataatcgacctgacagagttaaaaaaattcactacgaggacttcacaatacaatcacaagtattaataccagaatagaccaaacaagaaaaaatctcagagcttgaagactgtctttctgaaataagagaggcagacaaaaaatagag

SEQ ID NO: 728193 - DNA, 156 bp, Homo sapiens
agaggcaacagaaattcaaaagcactttctttttcttctgtcagattccttagcagtaagatccatcttcgtcacgtgagaaatcattaatagggagaccttcaagcaatacttccaggtcttattcttgattacaacagggaatgagtagatgga

SEQ ID NO: 728194 - DNA, 812 bp, Homo sapiens
ggctcctcgtgagcaagcttggagggagacgggggaacagtgacagggactctgcaagagcatggtggatcctgctggtgaggggaaggaggtcctgtgtgagttctgccttgatgacaccagaagagtgaaggcgagtgaagtcctgtactaacctgcatggtgaattactgtgaaggagcacttgcagcgcgatcaggtagaagatcaaactgcaaagccactgctgaccgagccagtgaaggaccacaacgtggcgatactgcccttgcaccaccacagcccacttgtcctgccttcgttgctgccctgatcgagcagtgcatctagccaggacttgtgccaggagcacagtggccacaccatagtctccctggatgcagcccgcaggccaaggaggctagaactccagtgcacgccagttagacttggacgcggaaactcagcgttgccttgacaaatgccatctccaggctccaggggtaaaccaacaagtctgttctgctagtccggtgtcagaggtcaaagcggtggctgaaattggcagctaggcggaaatcattgcggctgtgaggaaggccaggccaaatgtgatgctcctgcttacgagggagagcgagcaaggctgcgctcgagccaggccaagggtcccaaggccacctgggagaacaggcagtgccgagatgcacacgagcccgcagagctggagacgaaaggcggcaccagcaaatggcccccactggccggcgccaagttagaccggagacacacctcccagggcactcccgcacccaacccggcacccacctcac

SEQ ID NO: 728195 - DNA, 1117 bp, Homo sapiens
  misc_feature (73)..(73): n is a, c, g, or t
  misc_feature (98)..(98): n is a, c, g, or t
  misc_feature (180)..(181): n is a, c, g, or t
  misc_feature (230)..(230): n is a, c, g, or t
  misc_feature (323)..(323): n is a, c, g, or t
  misc_feature (355)..(355): n is a, c, g, or t
  misc_feature (376)..(376): n is a, c, g, or t
  misc_feature (394)..(394): n is a, c, g, or t
  misc_feature (429)..(430): n is a, c, g, or t
  misc_feature (465)..(465): n is a, c, g, or t
  misc_feature (518)..(518): n is a, c, g, or t
  misc_feature (523)..(524): n is a, c, g, or t
  misc_feature (536)..(536): n is a, c, g, or t
  misc_feature (542)..(542): n is a, c, g, or t
  misc_feature (577)..(578): n is a, c, g, or t
  misc_feature (651)..(652): n is a, c, g, or t
  misc_feature (746)..(746): n is a, c, g, or t
  misc_feature (789)..(789): n is a, c, g, or t
  misc_feature (851)..(851): n is a, c, g, or t
  misc_feature (1068)..(1068): n is a, c, g, or t
  misc_feature (1110)..(1110): n is a, c, g, or t
attgcctgatattgtaagctcccattgtttagcctaatacagtttctgtgcgaggtcccgtcccgccttttcnaggtaggcacttttaaatttgagcnaactgcgagaagagagtggtgtctcccaggcttcaatgattgcaaatatgtttgcccagaggttttgtgtgttgcttcagtnncagtcaggttcatcgaacacttgcatgaacggctagagctttatgcatntgtcatgcattctcaaactactttctgcattccatcatgctgactgacctgaccaggttgtctggaatacgaccagcactgtagtaagcagtngcacaagctcgaggtgtgcctgtgcatctcanaagtatgggacttcatcagtntcatatgtgcactcttcntacgcctgctacggtacattttagcatcacagaanncagggccagctaggtcatcttattttcacataganactgtagagctttttagtctctagagctttttcgtgcaaggtcacgcagctantatanngtagagcctganccggancctatgtttgttgaccagcactgggtccttctcannaatgccactagtatgtcagtagtgaagttgacttggcatgaatatgctgcttgattaaagcttagaagcctannagcttaaataccagtctatgaagcattttcatagcatagttacttatttagtaagtttgtttccggctgggctggatggctcaaacctacaacnccagaactttgggtggccaaggcagtaggatctcctgagaccnagagttcaagaccagcctgggcaacataatgagacccacatccctataaaaattagaattanaattaaaaattagctgggctgtatggcaagcacctgtggttccagctacttgagaggctgaggtgagaggattgcttgcaccctggagggcgaggccatggtgaaccgtgatcacaccactgcacaccagcctgagcgacagagcaagaccctatctctttaatttaattttacaatgacattaaattaggccgagcatggtggctcacgccttgtntgagaattatgtgcttgttcctcgtgccgaattcctgcagcncggggga

SEQ ID NO: 728196 - DNA, 304 bp, Homo sapiens
tcggcttctaccttgtctggagacaaggtcttactcgtgtcactctagcctggactgacagagtgagactccgtctgagaaaaaaaaaaattaacggggggtggtgacagacgcctgtaatcccagctacttgagaggctgaggcaggagaatcacttgaacctgggagatagaggttgcagtgagccaaaacgatgccacggcactccagccggggcaacagagcgagagtccatctcaacaacaacaacaacaaaatttagtcatagaacattttccaggtcaggaccgatgagaagagctg

SEQ ID NO: 728197 - DNA, 203 bp, Homo sapiens
gtcaaggctgcagtgagccaagatcacaccactgtactccaacctgggcaatagagcaagaccctatctcaaaaaaacagtagaaaatttaatctggctggatgcagtggttcatgcatgtatcagtacttaattcctttttctttctgtcttaaaaaaaaaaaggaaagaaaaagaaattatgtatatgaacacaccagcgg

SEQ ID NO: 728198 - DNA, 382 bp, Homo sapiens
aaatcaacccataacttagaaactgatgatattcatagattccagccattgtatagaagaacattgtgaaattccctgccctgctctgtttctctctgaccaccggtgcatgcagcccctgtcacgtaccgcctgcctgctcaaatcaatcacaaccctttcatgtgaaaaccttagcgttgtgagcccttaaaagggacagaaattgcgcactcggggagatcggattttaaggcagtagcttgccgatgctcccagctgaataaagcccttctacaactcggtgtctgagaggttttgtctgtggcttgtcctgctacaagctgagattgcatcacatacccctgcactccagctagggagacagagtgagaccctatcc

SEQ ID NO: 728199 - DNA, 227 bp, Homo sapiens
caccatagcattatcccagttcacacatcaccagtgtttcatcacacagtgccaatgtatcatttcccttccccgtgtgccatcatgttcccatcattccaagtcattgcagcaatgccccagtcaacttcactcatcagccagcattcaacttttacaacacactgcccccagcacatttgctacgcacatttcaggtaccttccacacatgttttcacacatgtg

SEQ ID NO: 728200 - DNA, 415 bp, Homo sapiens
  misc_feature (231)..(231): n is a, c, g, or t
tctagcggatcttatgcaggagagaactgtggcatctgcgtatggcattaacggatgcgccctgactgcaagtgccgggacgatgccgctgtgtggggcagtgctcccactgcttccacatgcattgcatcctcaagtggctgcacgcacagcaggtgcagcagcagtgccccatgtgccgccagggaatggcaagttcaacggagtgaggcccgacctggctctcgctgnaaggggcatcctgagactccttcctcatgctggcgccgatggctgttggggacagggcccctaagctgcaacaaggtgaaaacaagggctggaaggtgcgtttggttttgccatcactatgtttgacactttaatccaataagtgaaaattcattaaagtattcaaatcttggaacaaaggggt

SEQ ID NO: 728201 - DNA, 312 bp, Homo sapiens
atcctattgtagctgactgctattgtcaccagaagctcctgcggcacgctgatcataatttcagtgtctgcagaacttgagcaggtacctatattcatgacagatacagacatcccaatggcgggtcctggtgcagtctataacattaggttcccaatccagacttccatattctctcctgatactgaggagcggtgcttagatgtgagccatgaggctggtggacagttgcagggagagacaatatctaagaacattctaagttctgctcagtccatggagactgtcatccggagctgtctctgtactgtg

SEQ ID NO: 728202 - DNA, 389 bp, Homo sapiens
agtatcagtgtagctcctggggacttcatacggcataaagtcagtccattcccatgaagatacaggggcttcggaacgacggtcctactagttggcactagcaaacacgaggccaaaaccatgagaccagtacggggacgggggatgccataggaccagacgtcgctctgaaccgtgtagaccaccagtcaaagatgctctctctgtctagccccaaagagcctggtttgctcagtatcagtgtagctccggtgggacttcataggcatacagtcagtccatttccatgaagataaggggatcaggaaagaaggttctactagttgggcatagcaaacatgaggccaacacgcatgagaacagtaggggagggggatgcataggaccag

SEQ ID NO: 728203 - DNA, 214 bp, Homo sapiens
acgtggctcccttggcggcagaaccatgttggacttcgcgatctttgtccttacccttttgctggcgttggttggagccgtgctctacccctatccggctttcagacaagctgcagggatttcagggattactccccactgaagaaaatggacccttttgaaaccatgctgaagttattattaaggtatcaatctggtggtggcagtttgagtt

SEQ ID NO: 728204 - DNA, 750 bp, Homo sapiens
  misc_feature (8)..(8): n is a, c, g, or t
  misc_feature (35)..(35): n is a, c, g, or t
  misc_feature (80)..(80): n is a, c, g, or t
  misc_feature (91)..(91): n is a, c, g, or t
  misc_feature (98)..(98): n is a, c, g, or t
  misc_feature (105)..(106): n is a, c, g, or t
  misc_feature (110)..(110): n is a, c, g, or t
  misc_feature (130)..(130): n is a, c, g, or t
  misc_feature (182)..(182): n is a, c, g, or t
  misc_feature (188)..(188): n is a, c, g, or t
  misc_feature (240)..(240): n is a, c, g, or t
aggttggnttttccacccttgttttggaaattttnccctccagttggtggtggatgccattttggttggcccttatggcnccaaatttggnttttccncaatggnncaanctggctttattcccccattnccctgaatcagggtttgctggtttggaacggattctggcaaaatgcctgtgntaaatnataaccaagcagtgacagcagcatgggaagcccagccgatattgactgaatncctgctttatgccaagttttatgttaaccctttccatgtattcattctcatgacaatcctatgatgggggttactatttttattctagaggtcatccaagtctgacaagacctcacaggctgttttgaaaggaaaatctgtagaaaagaggctatgatccctgcatttttctctgctctgctttctggctatcaaaatcaagactcttgaatgtgggttgccaagtgggcagtataaatgcatacagagctgccctaattgggtttctttgcacaggtgaggccagctgggatgcaggcccaggagctggctcagaaaactgcggatcccctgatcccaggtctcatacccaaaggaagagaaagttggggaaaggtcaaatggagggctgaacattggaggcatgcttattttctctcattaaagccattgtatttcattcatcagcccattcacttattcagcaaacccttagccctactataccaaacatttgctcgtgccgaattc

SEQ ID NO: 728205 - DNA, 234 bp, Homo sapiens
gcagattttggtttctaatacaatttttcaataaaaggaacaaggactccttggagaaatgagttgattactacaactagggcagaccataaggcaagttgaacatgaattcattatatagtaccaaaagtaaggaggtgttaaaataaataaataaggagttaaaaatctacaatgatgccaaaggacagaggagcaagtgccgagctctacgcccaaggaaggtatttcaca

SEQ ID NO: 728206 - DNA, 734 bp, Homo sapiens
  misc_feature (448)..(448): n is a, c, g, or t
aagttaaagaccagcgtggtcaacatagcgaaaccctgtctctacaaaaaatttgccaggcatagtagtgcatgcctgtaatccttgctactcggcaggctgaagcaggaggatcacatgaggctgtagtgagccatgatcacaccaccgtacttcagcctgggcacagagagagacccccgaactcttaaaaaaaaaaaaaaagtagctttgaaaagggaaaattgcgggccagtatcagtcttaattaatgatataaaaatccagaaacaaaacagacaagtgcaattccagttcagaaatcccaataggtagtgtttggggattatgggcttatatgattttgggaacttcacaagactgattctaaaggtttatacaagacttgcaaaagggcgcaagaagatcaaagagactcttaaagaacaataagacagggagggctaantctatatggcaagacttaataataagcaaagtataatactaaatgtaatttaagtcagggataaataaattcatgcatgtatgcttgaacctatgacacaggtagtatggctgaataagtaagagggggaaacgggaaatttacacggaaaatgggtcctgggaaagggaaatggtgttatcagtatagacaataagaaatatgccacggaataaagggtcccaatttggaaagggtttgaacaattgaattatatccagttcggagtcttggcgtgtacccagaa

SEQ ID NO: 728207 - DNA, 148 bp, Homo sapiens
tgattttatccaagaagttttttgggcgaaaatcatgctacataaaaatgatccaatgattttctgcccaaaaaacttcttggataaaatctaaaaaatactatttgcaatttgcgtctcttgaatgaacactcgtggtacctgagct

SEQ ID NO: 728208 - DNA, 1158 bp, Homo sapiens
aatcaacagagctcccggttaccggatatagcgtggaagtgattgaatcaggagattgaaataagtcattaaagagactagggagaaaagtgaagatcaactatataccgcaagatattccagatgtggcatcgtgctccaccacccaccttgtacagagaagtagcagcacgcgcagcattgacacacagacgcctgagtggggcagacaaggggaagcaacaacagcagccgtacgccagatccgtgatccccaacatcgaacctcaccatataccaatgaaggtagcgaggagagtccttgctcagcggatgaccagccttgtagaatcccagagataaagagcaatgggaacaacatatctccatttgccacaaatatgcaacaaatcaaacaaaacctaacaacagactatatgttcaaaagggaacctcctgagggctgtagaacagggtcacaagatctttgcaggaatgctcgccaaaaacaaggcttcatgaaatcccagaattataaatatgtcctgaccaacaaaaccaaggaggaaaaacaaaacactaaaaagtggcaatacagcataacaagcactccgacaaagcaatcacatccaaagcacaatcacatataacaaaaaccacaggaatcaaccacatcaaagagaaccaagaggaccacagagaaggagcagaacagaccaaatgagcacattggaacaaaaccactaccagcaagacagacataaacgaaaagaggagacatccccagtcaaaccaaaacacaagagacacagaccgcaaaacactcagaacaaaacacgaacaaggacacagccaaacagacaacacaaacatacacaaacacagccagaagcacaacgaaaggaaagcagcaggcataaggaaaacaaggacaacggagaccgaggacagggcaaaaaagagaacacaaccaagaaaacagacaaaaacaggagaaagagagagacaccgacaacgaaggaaccgcacaaaccagcacgaaaaacaagagagaagaaaggaaaaaaagaaacacaaaaaaacgaaagaagaaaaaagaacacacaaaaaaacgaaaaaaaaccagaagagaagaagaaaggaagacaaaacaccaccaaaaaaaaacgaaacaaaaac

SEQ ID NO: 728209 - DNA, 319 bp, Homo sapiens
gacagccgttacagcatgtaacaaacattttcaaagcagaatatctggcctcagcattgtttttcagaaaataagactggtctgttagcatgtttctgaaattcccgccaacatatggtatttataagtatattaagtattagaagagtcaaaaacggacatacagcccctttaaacgtacatgatgggcaaagtcttgtcagtttgagggtcccggactgtgtatttgtctacagtattaacattaactcatgaatattcctgttttgctgaaatggtattaatcaaccctgcgaaaataaaaacccatccaatgtga

SEQ ID NO: 728210 - DNA, 211 bp, Homo sapiens
atctacggatccttacagacagaaaaagaggcctctaagtggctaggtcttcagggctggtgccagaagaaaaaccgagttgtagaaagacctggggagtaggctcagagaatgtcctgaagatggggagatcaccccaggaagccttggcacaagggattggtaaggtaaggacactataaagagttaggcagagacaaagatcatataa

SEQ ID NO: 728211 - DNA, 101 bp, Homo sapiens
gtacacattgctaatataatgacttgttcgacgacacctattatttctcttctggcttaacatgaagagcaaagagaaataatggtggcattcgatgaaca

SEQ ID NO: 728212 - DNA, 389 bp, Homo sapiens
cagaacactttttttttcaagtccaaaacacaaatttctctttttttttaacagaccggattatttttactgcctgaatttttagggttttttttttcacaagtccggtttattactaaacttttgggtaagttaccttccctccccctcctgtttggattttatagccctttgtaattgagttttatgcttaaaattccaattaggcttaatacatatttgtgagtttcatctttacccgatactgaaatttcatgccttgctttgtgcatgtggcaccccatgtaagatgggccatttgtgctctggatgtcttttcttgacttttttttaaacttaatatttttttttttttttataaggggggttttactttttttgccccagtt

SEQ ID NO: 728213 - DNA, 210 bp, Homo sapiens
ggccccccccccgccccccgagggggtttgggccaagagggttggctttgggggggctggggccttttttgggggcccttgcccccccccccccgcccccaaaaagggcccttgggggggaaccaaacctttttccgggggggggccaaggggcccccccccagggggggggttttttaaaaaaaattttttttaattaaccccacccca

SEQ ID NO: 728214 - DNA, 127 bp, Homo sapiens
taaagcactgaccgcgctgataagttttgtttatcgagagactgtttgggatactccagaaaggtttgcaagcgccagcaccattgcgacgtagcatcggcccgtggccgtagacggggcacaggtg

SEQ ID NO: 728215 - DNA, 115 bp, Homo sapiens
ttctcctgcaccttttggagaacccactctggtggcccagaggagtcatcgggctgtccctgaagagcacctgtcacaacaggaaatgcagacgtgggagtcactattgttacca

SEQ ID NO: 728216 - DNA, 386 bp, Homo sapiens
catatatgttttaccagcagtatgaagaattgagaagatcgagatacttatctagacgcaagtacgttagctagagaccttctacgggccatggcaaatagatacttaagaagagcattctacactccaaggtacagtgtaaaaagagaaaatagctctcttgtatcttatgacttgtatcagtaatttaaaagtgtgacaaaaaaaaaatatttccacacctcacatccactgtattattcgactcatggtcaaagacttcaaatgcctctttgatttttttgcttgtgccgctgcagcgaaccaagcaattgggaccacttaagcaattgggaccaccatgcctgggcttggacagcctctaagatggacagggatctcataag

SEQ ID NO: 728217 - DNA, 190 bp, Homo sapiens
aaccttgaaaaatcaagatgtgaccctactgaatgaacaaattaaatctcaactaattgacaataaagaaatacaggtttctggctgggtgcggtggtcacgcttgtaatcacagcactttgagaggccgaggtaggcagatcatttgaggccaggagttcaaaatcagtttgccaacatggtgaaatac

SEQ ID NO: 728218 - DNA, 519 bp, Homo sapiens
agataggcttctctggccgtctaggtaaagagtcagtggatcaggctcctgagacgtcgccagggccttcagtaaacagacggactatgttagaagtgaagtagtacaacgtgctgatggctggaaagatgtagtacctttgtgattcctgataaggaacaatgccgtgctgactggctaaggggaggtttgccagccctgcagccattgactgccacatcagcaggattggaaagataccttgaaaagcttagcagtgccggatacaggataaatacaactcacagggccttacataagtgtcactgaaaataaacaacatagagttattttcctgaaacttggttttggtagaaaggtacgaaaataacttttcattgtccacaaaaacttcctcctcttgactttgtctaccctgagccttcttagcccctggaattgtaatggctaggtcagcacagcccagtgccaatgccagccaacaccagcctgcacggacagcttctcttcaccctgttt

SEQ ID NO: 728219 - DNA, 189 bp, Homo sapiens
caaatatgtggactcaatgcgggacacgcctgtggatacattttggaacattatcctgggtggtctggtgctagatgttcaagtgaaacagaaagccaggaaggatctgtgctatattccatcagttctagcaatttactatcacttagaaatttaacaacaccaatacatgtttgtatatcctaccag

SEQ ID NO: 728220 - DNA, 445 bp, Homo sapiens
  misc_feature (11)..(11): n is a, c, g, or t
  misc_feature (105)..(105): n is a, c, g, or t
  misc_feature (289)..(289): n is a, c, g, or t
attaaggaggntaggcctgggccattggtggcttcatgccttgtaatcccgagcacttttaggaaggccaaaggccaggttagatttgcttgtgcccagcagttnaagaccaagccttggggcaactggcaaaaccttgtctctacaaaaaaacaacagaaacaaaaaattagccaggagtggtggtgcatgtctgtagtcccagctactctggtggctgaggtgggaggatcacttgagctcaagggtttgagatcagcctgggcgacatggttgaaactctgctccnagaaaaattagccagtgtgagcctctggtcccagttgcttgggaggctgaggtgggaggattgcccttgagcccagcaggtggaggttgcaatgagctgtgatcacaccactgcaatccagcctcggcgacaaagtaagagcctgtctcaaaaaaa

SEQ ID NO: 728221 - DNA, 679 bp, Homo sapiens
  misc_feature (153)..(153): n is a, c, g, or t
  misc_feature (519)..(519): n is a, c, g, or t
  misc_feature (582)..(582): n is a, c, g, or t
  misc_feature (620)..(620): n is a, c, g, or t
  misc_feature (651)..(651): n is a, c, g, or t
gacgcatttatacaaccagagcaggggcggctcctgaggcgttatcctaacctttacgaaaccgtgtctcttgtttacctatgagatagatagaccttaatacaactactcaaaaaatatggtccgtagatgacttacacactgcctcccggntaacttttaacaaagcttttataggttaagggcctgagaaacatattgaggaattagactcatagcatcttgaacgaaatcttagagtttttctaaaacatgaacgacgtatgaatgaaggttctataaaaagaaaaaacgtatgaacgacgaaattgaagactccactctaccgtattcctgttaaatccccctagaaggccttcgagtttttgttaaaatggaagcgacctaaactgcttgcctcttaaaccaacagttgcacgaaaatgcaattttttctaaggccactttttctaaagtaaataaatcgggaggttcttaaaggatctttgattcctataacgcaagcacgaatagcggcgnttaaaggaataaataaacgcctttactgaaatgcttccctatataaaaaaacactaattttgnaatacgttggataataacactgtatggagaatttccgnccctcccaaaattgaaaacagcgccgcgcgnagatgtgccgatatatcataaaaaacca

SEQ ID NO: 728222 - DNA, 384 bp, Homo sapiens
  misc_feature (53)..(53): n is a, c, g, or t
  misc_feature (166)..(166): n is a, c, g, or t
  misc_feature (217)..(217): n is a, c, g, or t
  misc_feature (227)..(227): n is a, c, g, or t
  misc_feature (236)..(236): n is a, c, g, or t
  misc_feature (238)..(238): n is a, c, g, or t
  misc_feature (242)..(242): n is a, c, g, or t
  misc_feature (245)..(245): n is a, c, g, or t
  misc_feature (248)..(249): n is a, c, g, or t
  misc_feature (251)..(251): n is a, c, g, or t
  misc_feature (255)..(255): n is a, c, g, or t
  misc_feature (276)..(276): n is a, c, g, or t
actcgacctggggaaacggcccaccaaggacagctacacgctgacggaggagntagctgagtatgctgaaatccgggtcaagtgaaggagctgggggcagcctgcgtggctgacccccctcaggaccctcgctggcccccactggctgtgggctcccttcctcccnaaagtatcgggggctggggcaggaggggagtgaggcaggtgacagtgaggncctggggctnacctccccntncttnccngtnncncctncgtgccagcacccccacgccntcatcggctcctctctaacctcctttaccctcatctgtctggaggggagctctgtctgtccgtgttattattgctacttcctgcataatctcctggccccacacctgg

SEQ ID NO: 728223 - DNA, 528 bp, Homo sapiens
ccacgcgtcggtcttgctctgtcgcccagactagagtgcggtggtgcgatctcagctcactgcaacctctgcctcctggattcaagcaattctcctgcctcagcctcccagtgtataggatgtacaggatgaaaagatcccaagtgaggaccccaatcaggaggctgataaggaatgttaatctggattgggaagattccatggcactaggctgtaccacagtcatagaaagaggaactttaagaagactaaagagagcaacactgaacactttcctggacagtcctgtacatgttttattggtgatgcccaagcttatccctgaacactgggaaaagtgggaagatgtcaagagataaaagacagaggatgacagatctgagagggaccgagtgactaactttcctctgcaagctcaaagcaagaagttgactgctttttcatttgaactctgccccagcatcaacaaatcaccactctgggtttatgcaacttgtttcctaattgaataaaataagcctgaatatg

SEQ ID NO: 728224 - DNA, 117 bp, Homo sapiens
taggggccaggggcccttcccagaaaaacaggtgggttcctgtaacctgttccccatccccagggcctttgtggactaaccaaggctgtgagggccaaaataaacaactgctcccca

SEQ ID NO: 728225 - DNA, 132 bp, Homo sapiens
gacttggtgcggtgtcccgagagttaccttgatcctgctctgggttcttcttttctgcatgtgcgtgattgttcacctccttgtccaaatatgtacttctgtaagagaagaactgtcatttgctcgctcatt

SEQ ID NO: 728226 - DNA, 176 bp, Homo sapiens
tttacaagggcctttttttttcccctgaagaacataaacgggttttttcccttttccaaacccgccagaaattttttagggccagaaaaattcccttgaaaaattgggggggaacatggggaaggggaaatgtttttcatgggttttaccaatgggaaaaaaaatttaattttgga

SEQ ID NO: 728227 - DNA, 229 bp, Homo sapiens
tctgagtcgtctggggatcccagtcatccgtgcgtccacgtcgaccgtgcggcctggccatctgtgcggccacgtcgtccatgcatccacgtagtccgtgcgtccacgtcatctgttgcgccacgtgatctgtgcgtccgcgtcgtctgtgcgtccgcgtcgtgctgaggaccgcgcatctgagtcatctgtggatgagccatccgtgtgtctacgtagtccgagcatg

SEQ ID NO: 728228 - DNA, 1194 bp, Homo sapiens
  misc_feature (206)..(206): n is a, c, g, or t
  misc_feature (1194)..(1194): n is a, c, g, or t
agcgggcacgccactgcttacactgaacgagggaggacgggagaggagtgtgtgtgtgtgtgtgtgtgtgtgtgtgtgtgtatgtatgtgtgtgcgctatctcatggccctgtccgcgtcgtgtgggtgataggacacggggaggaggagctatgctatggacgacggcttgcgaacgacgctggacaagagctacaagaccatantcggcgccgtggaacgtcgccgagaatgagtaagatgcgtgaccaatgacacggagagggggttcgcctcgacggcaagcctccgctaatgtcccatgaacattcgtctcctggtcgtgtggtacgtaggcgtacatacgcgacatatggccaccgctaggacagagaagctagtagccgagacatactaatcgttcagactactttctccctaagcaaactagtctgtggtactctgacgtgtggtcgaacttggagacgttagtgaagcaggccgagtgccctcgagggatgttactctgcggctctcgagactcccgagagctggacattagctgtggcgagcgaacaagtacgttggcagagcttaacgatatgccctcactaccatatgtcaatccaaccatcgatcggctcgacaatagcccacatcgataacgagagtggccctgcgcacgaatgggggaacgcaagccacagagggagaggagagagaagcgaaaggcaccacaagagtcttatagcgacccaacccaagacaagatcgacggctcaccgcgcacgcctcgaagagcaccgccacggtacatcattaccaaccggaaaggaggggaactccgcgcccccctggacacacagcgactcgggtgtgacgaagcaaactcaattaaaacaagaaatagaccaaagctaacggcgtacgataggcagggagacggaacgcaaagatccaagaaagcctatagcgataaagtcacgcgcgaaaacggaagcgctatcgccgcacccaaacgtgcagggcggccaatatcaggccgtcgacacgacccacccatagacgaacacacgccacacagccggaaaacgacaaccaacttggcacacccgtaggtgcaaccgagaacgaggagggaggttcagcaccgcgcaccgggcgccagcccacacccactgcctggcacattaagggcgagtcgacatccacccn

SEQ ID NO: 728229 - DNA, 407 bp, Homo sapiens
agatgatccgagatcagatacatttttaatattttttaaagaagaacaagtacctaccctgtgacttgcatctttcacagtacaaatgacttgtatggatcctactcaaaagatgatttataatacacctatcggattttgacagcgctgctctcactgcaagattccattaactctggagattatgactattgcactaaatgcagtactcatgacgaactgaactgttcatgattatcactcaaaacaagagaacagaatggattgaactaatagaaaacaagtattatttttaaccttgttgcttgaaactgtggaagatccttgctttgatattctgagtcaaggatgcttattttgaactatttaaagcctttaataattgagtaaactatatgcctgtgaac

SEQ ID NO: 728230 - DNA, 1309 bp, Homo sapiens
cacgaggatttctagtagagacagtgtttctccatgtacggtcaggctggtctcaaactcctaacctcaggtgatccgcctgcctcagcctcccaaattgttgggattgtgagtgcatcgccccacagcctatccaacatctttttaaacatcatttccatgctcagtgcatgctagttcctatttcatttgtaatagctgcttagtatttgcattatatgcttgctaccataatgtattctgatccatttgcctcccagagctttctcactcacacactactgcacatcaataactatcgctctatatattgctgcctttccatatcaactgcttctctacacttcccagggctgatccactctacagtactcaacctgcatcaccataacattctcacgctctcacactctacttctggccctgttgcgctcccagctctcacagatcacaatcttctgtcacaagcaccctatgactcaacaaacttcactttgacacacatttactacaaggccccatctcgtcctacatgagctctaatatccaccatgtgtactcactaacagcctgctccatgccccctcaacctcttaacaccaatgactaactcagttcacataccatatatcagggctactcagctggtacccttctcaactccatggccattctgtcaaatccacacataccatttgcatccaaccaacacattatctcatccaaccctgactacactgtcggcccccttgcatacacgtctgagctcaattcggctagacccgcactcccttaccaccccacttgtactaacactactatcctcaggcgctacacaacgccgctgcgcagaaccccccaccaccagcgccacaccttccaaccaaacacacccaagacccaacgtatccagaccacccccacaccctcaccacactaacgacccaccactctcgccgccgcactccccacaccgcacagccacacacacgcaagaccatacaaccagcctcgcaacccccaccaccacaccacaccccggcgccacaccacctaccacaacaagacagccagacccaagcacccaccccctcaacaccagacaggcggcgaaacctgcaagcacccaaccaccaagcaacagtcaaacaccgcaccgcccacaccaggcccaacacgagcgacaacagcaccgacaccgcctaccgtccctccatcaaagcagcgtgccacaaaacgcgacgaccaccgtttgcagacaaacagccgcatctcacaccaaccgacaccactgaccgaacaccacata

SEQ ID NO: 728231 - DNA, 82 bp, Homo sapiens
ggatttgctggtgcagtacaactaggcttaatagggacatggataaaggttggggaggttgtgcattccagaaaggaaaaaa

SEQ ID NO: 728232 - DNA, 351 bp, Homo sapiens
gaacaaaccctcccccacgcatggtcctgcattacccgggggtgtcccctgttagacacttcctctctcttaacaccctgcactgttgcagtactgacctacttgcagattcttgaatctgcaatactcccctctttgttgctttgtgcatggtgcaatctccgccgcaaacacctttctgttggttaacaccttttcagacctcaagactcagtcaagatgtaacttccagaaagccttgactcagcctacgactagttcagatcagtaacacttctctggttttctcttttctcacagctctctgtgagtacttgatcataatacttatcacataggattgtagctatt

SEQ ID NO: 728233 - DNA, 206 bp, Homo sapiens
ttctgagtctggggccctctacaatgagcacaagagctgtgcggcgaagtcagtgcagaacaccagcatccgcgtggcgggctttggcaatgccacatttgaccatgagcaccacgccaccattgtgggcgacccgtcactatcacccgcctgaggtgctccttgagctgtggctgggctcagcccattgccgtctggagcattgg

SEQ ID NO: 728234 - DNA, 712 bp, Homo sapiens
tctctctctctctctctctctctcgctctctctctgtatctgtacaagtacatatacactagaaacaacacaaaacaaaaagtaagcagagacgcaaaagtcgaagacacaggcacacacacacacacacacatatacgccacagcacactcaatagcactcccgggtatacaactaggaaaaaacacaagagagaaaaagatcgggatccatataccctacaaaatcaagcgcacaccatcacgcacatgagaatgtgagagagtcagagaaagagaaaaaacacgaggcggggcccgagaccgacatcgcgctatagagagagctataaaaagacagagagcgcagaactacacaaccgtgagtacgaaaacgccagcgagagacatcgcaaaagccccgaggaacataccgccatatagagagatagcgatagagatcacacgcacgcagatagccctgctcaacacgcgcgcacactcaatcgcgaaagcgaaagcgtgagcgccaatatagaggcaaaaatcgcgcgaaaataaggtggaaaaacatcatactatatccgccaaggtcaaaaaagcgagacacccatatatatatcgatacaagaccgcgcaaaagggttggagtatataaacactggaacacacgttcacaccgccggtccctagaccaggaacctcaaccccataaataaagcttcgggggggcg

SEQ ID NO: 728235 - DNA, 486 bp, Homo sapiens
agaggatcctccacgggcaggtgtactcgtgttcgtaattacaagtatgctccatgtctctatatattaggttgaccataggacattgcagtttttggttatcacatgattctgcctaagaaatagattgtggcccggcgcagtggctcacgcctgtggtcccagcactttgggaggccgaggcgggcggatcacagagtcaggggatggggaccatcctggccaacactgtgaagccccatttctgctgaaggtggaaaaagttagccaggcatggtggcatgcgcctgtagtcccagctactcgggaggctgagccaggagaatcgcttgagcctggaaggcggaggttgcagtgagctgagatcgtgccactgcactccagcctggatgacagagcaagaccccgtctcaaaaaaacgaaaaaaaaaaggaattagagtggtttcatttttttttaaatcagcagtacaacctgccggtgggg

SEQ ID NO: 728236 - DNA, 229 bp, Homo sapiens
  misc_feature (21)..(21): n is a, c, g, or t
  misc_feature (27)..(27): n is a, c, g, or t
  misc_feature (54)..(54): n is a, c, g, or t
  misc_feature (90)..(90): n is a, c, g, or t
  misc_feature (185)..(185): n is a, c, g, or t
  misc_feature (219)..(219): n is a, c, g, or t
tcacagggcggttttctgcanccaggnggccccagtgttggagcagtttcggcnccctgcagtacttgggcatggctatccagcccccgnctgagtttttcagggtcagcggctggcactttggttctccggagcgccacctaaccccgccccacccgggctcgccgcctgcctcacgtgacgtnccgtggagtctcgtcacgtatccggggagagagnctgagagcgt

SEQ ID NO: 728237 - DNA, 446 bp, Homo sapiens
cgtggggcctggaatgggcatctggctgcagatcagtcactgggagcattgcctggcggctgccgtccattggcaccgagaacaccgaggtagaatccggcgcttctaccgccagttgctgctgacggctgacgaccgcgtgaacccctgcattgggggtgtcatcctcttccatgagacagctctaccagaaggcggatgatgggcggtccttcccccaatgttatcaaatccaagggcggtgttgtgggcatcaaggtatacaagggcgtggtccccctggcagggacgatagtggcgagacttcctacccaaggtgttggatgggctgtcttatcgctgtgcccagtacatggaaggacggagcttgcttcgcccagtggcgttgtgtgctgaagattggggaacataccccctcagccctcgccatcatggaaaatgccaat

SEQ ID NO: 728238 - DNA, 397 bp, Homo sapiens
acagtgctgtctagtggtgggatacgcggtaggacagtcgaattacaccaatgatcaccgtcttggtgtgatattacactacagttttaaaaaatattaccacggggtaactgataaaagtatgcaagatgtttatctgtactgtttcttataatgacatgcaaatcaacctacagttcaatcagtatttcaaaaaccccaaaaccagcaaggcacagtagctcacaactgtaatctcagcacttggggaggccgagccgggtggatctccggaggttaggagtttgagaccagcctggccaacgtggcgaaaccccgactctactaaaaatatgaaacttagcctgtagtcccagctactcaggagactgaggcaggagaatggctggttccgctg

SEQ ID NO: 728239 - DNA, 744 bp, Homo sapiens
atacctaatgcgatacctgaacgaaaaatactagtgctatatacaactacgcaaaggcccaacgatgtaggcccctacgtggctactacaaccctatcgctgcactgccataaaactactatacaccaaagagcccctaaaacccgccacatactaccatacaccctactacatacacctgccccgaccttagctactacaccatacgctctatctaactatagaacccccctaccccatacccaaacccctgtgtacaacctcaacctaggcctcctatattatatctaagccacactactaagcctagcctgtaatactacaatcctactagatcagtggtgagcatacaaactacaaactaacagccctagatacggctgcactagcgaaccacgtagcccaaaacaatactacataatagaaatgacacccctagccaatcatatactatctatcaatcattactaataagtaggctccttataaaccactaccgcccttatcacaacaccaagaacaactcatgataactacctgccactcatgacccatgggcgcataaatatgatataatactccacacctagcagtagaccaaccgcaacccccctacgacctttgcacctgatgggtggagtccgaaactaggtctccagggcttacacaattcgcataacgccgcaggcccctaacgccctaaattctacacaagcgtatacaacacacaataatatagttaac

SEQ ID NO: 728240 - DNA, 771 bp, Homo sapiens
  misc_feature (30)..(30): n is a, c, g, or t
  misc_feature (139)..(139): n is a, c, g, or t
  misc_feature (141)..(141): n is a, c, g, or t
  misc_feature (375)..(375): n is a, c, g, or t
  misc_feature (409)..(409): n is a, c, g, or t
  misc_feature (457)..(457): n is a, c, g, or t
  misc_feature (461)..(462): n is a, c, g, or t
  misc_feature (479)..(479): n is a, c, g, or t
  misc_feature (484)..(484): n is a, c, g, or t
  misc_feature (488)..(488): n is a, c, g, or t
  misc_feature (490)..(490): n is a, c, g, or t
  misc_feature (492)..(492): n is a, c, g, or t
  misc_feature (525)..(525): n is a, c, g, or t
  misc_feature (557)..(557): n is a, c, g, or t
  misc_feature (565)..(565): n is a, c, g, or t
  misc_feature (568)..(568): n is a, c, g, or t
  misc_feature (577)..(578): n is a, c, g, or t
  misc_feature (580)..(581): n is a, c, g, or t
  misc_feature (584)..(584): n is a, c, g, or t
  misc_feature (593)..(593): n is a, c, g, or t
  misc_feature (596)..(597): n is a, c, g, or t
  misc_feature (602)..(602): n is a, c, g, or t
  misc_feature (604)..(604): n is a, c, g, or t
  misc_feature (619)..(619): n is a, c, g, or t
  misc_feature (621)..(621): n is a, c, g, or t
  misc_feature (623)..(623): n is a, c, g, or t
  misc_feature (625)..(626): n is a, c, g, or t
  misc_feature (629)..(629): n is a, c, g, or t
  misc_feature (634)..(634): n is a, c, g, or t
  misc_feature (639)..(639): n is a, c, g, or t
  misc_feature (656)..(656): n is a, c, g, or t
  misc_feature (662)..(662): n is a, c, g, or t
  misc_feature (696)..(696): n is a, c, g, or t
  misc_feature (771)..(771): n is a, c, g, or t
tggtgatatagttgtgaacaatagcttttncttcccctataaactcgagttataggaagcgtttcagagagaggataacacatttgaatctattttttaaaaatcatcctgaaagctagcagtattgttgtcgtttaanangttcctcatatactcttaccctcagccaacccaccatgtttatcaattcaaattctagaactttcttgacccaagagattttgtaggaaaaatttctcttttcagatattcagcacgcaaggatcatttttcttggttttgttgctgatcttgctgaactttccatcaatggctgagggaggaagcttgcatgattcttatgagttcttctgaggcactttgactgtgacagtnttcacttcagtgtatgcctgcagcccgtactcgnccaactcccggccactccccgacatcttgtagccaccaaagggtgacngggnnccaaacacatcatagcngttgncccncncngtgcccgcctggcggggctggggcgggtaattngccttgtccaaatcctttgtcaagacagctgnggacagcncgnacgtggaanngnnggntctcccaanaanntcctntntggtcttgaacttcncncncnncancactngcccnaacctctcctccttggngatggncatgccatcctgcacatctccaaacacagtgggntggatgaagtaaccacggtcagcagcaatgcccccaccacacagcagcttcgccccctcttgcttccccgtgttn

SEQ ID NO: 728241 - DNA, 1543 bp, Homo sapiens
  misc_feature (578)..(578): n is a, c, g, or t
  misc_feature (1302)..(1302): n is a, c, g, or t
tggtaaaaatggggtctctcactggcgttgcccaggctgctcgggaactccgggcctcaagtgctggggatccaggcgttgaccccccacgcccggcgtgagaagtgttcccttttctccgtgggaactgtgactcaacacaaaactcctgtggaggccgtgggtggtggggtggtgttccctctctgtggggcagaattcctcaacgtgggagacacatcttctctgtgcccccaaggggaacaccattttctcaacacatctccgtgaggaacatttctccggaggtgtgtctcatctcaccaggtgtgtgtgcaccccgcccgtgtgtgttgtgttcccctgtgcacacaccgcactactgtggccaccctctcgcgcggaatatagagacgccccgagggagagcgcgcgtgtctctcaactatctcgcgctggccagcggagagaagcgtgtcaccgcgctcccgaggcgatctccctataggagaacgaggctctccgaggcgcagggctgatagagaaaggagccaagcactgtgaccgtgtggctgtggcgcctgtgcactgtgtggcgnccctgtgtctcctgtggagacacacacccccctgtgtgcgagacaccccgaggtgtgcccacccgaggggagaagtggtgggcctccgtggtgggggtgtgtgacggtgaatttctctgtgggggggccaaatgtgagggacacacagcggagacacccccaaaggtgtggcgtgcggtgtgcccacatgtctcccccgtgtaaaagagacggatgtgggcttctctcacaaaggctgtgaaaagaaaggccccccgggggggaggatataaatatccatctccagtggagaatgaaggggctgtgtggcaacacacgctgtgtggtgaggaaacttagatcttttatcaccttccggaaagaaaaacctgtggtggggttcaccccccacatggtggggtcggggggaaactacccctggggggttgaaaacatctcctatacttacaatatgtgggaacacgcggagaggcgaaaacacacttctccgctagggaacaattacttgcgggggggacaccccccaacaaaaaaggaagccggggttgctccgagaaagaaaaccccactacaagggggagcccccgagggggggaaaaaatttcataaaatacaggcaggggggcagaaaacccacgacgagaaaaccacacggagtggatgagtatgcacaaacaaagagacgacagagggggatccccccagataattaatagtaggcacnccaaatgatggactcaaaattgatgccaacgcaggaagggggggggcaaccaaccaaagtaaaaaggcatggtgggtgggcccccccaacaattaattagaagaacacacattcttctccaccaaaggaggcaactgtgcgtcttagcacaccaactgtggtgcacacgaaggtggaagaaaccgccctatcctgatgataacgatgcgcgtgagccgaaacacaatacgggtgcaagcac

SEQ ID NO: 728242 - DNA, 629 bp, Homo sapiens
cacgctaaaaccacccgttgatttaaaaattgggaaaaccggccaccccgggacgcctttaaaggtcctccccagaaaatttgggttcccaatccattccttattaaaagcccaacatccgtaactttaatttccctttttttgggaaaggcgcggccccctcctttttaacgagggcgaaactttatctacattctcgggccccgggttttggggcaacctcttccgtggtaaaaaattcccctccaccgggggtgggggaggaaaaaaaaccacacatataggttaaccggccccattggcccgtgccacttaccccggcccataagggccaagtcccgggtccccaaaacaagggggcggtcccggagaaaaaaaaaaaaggctggcccagatccggggcctggcggaaagaagggacaatgtggttcctggtgagaaagggaggcccgcctcacaatcgcctggaggccctttatcttttgggggcttggggctccacccaaaacccccttggacttttccaccgggaaacacggggtaaaagccttaaccggggagacgggggataaaaaaacttcacccgattcctcggtttttggccgaacccccctccccttggaacaccg

SEQ ID NO: 728243 - DNA, 1293 bp, Homo sapiens
  misc_feature (392)..(392): n is a, c, g, or t
  misc_feature (438)..(438): n is a, c, g, or t
gcttcgttcgcgacgtggtctggcggctagaagactagagtgtcggtggaaaattgatgctccgtagaacatggccaagatagggaagaggtaatagaggaatatgcataagatatgtgggtcattcgtgacaccgctaagatttcaggaggcaagtgcatgctatatagctggactagtgctcgagtcttatcaagatgatcggtgcgctgttcgtagaataacgaagcgatagataatcgatttgtggatgactgtgagtgtttagcctcgtacgtatggaggtatacaaggggttcgtttgtagagctcattagggtaggatgctcattgcgtatcacaagatgcataagcgtggaggcagtggaatctgtaaggaatacctcccaatntggactatcgtcgcattggtggggctaatcttgggggaatctcatncaagtttactggtaatttgattgcattcatactactagtgcggtactaggtcacccaaacgcgtgaaaagcaaagaacgaaacggtgtatgagtacccattgggaggaaaccacgtcgaattgtaaaccccaggtgtggcaccttttttcgtgctaagtggcaatggaacctccggtaagaaccgtcggtcccactcggaattattggctttccgacgtggacctttgaagttgggtggggtgcttgtaaactctgtgcgccatagcgactttggaagagtggttccattccctacgagtacaccatggcggggcaacgccaatctcccgggagttcagaatctgttgactgccattttcctggggtttattaccaatctaccggtggcaggagtttcgaaacattgctttaaacattggaatctcgtttcccgcgttgtgttttgagaacccagaacatacctggggtagttaactccgaacgtagacaaatgtcctcgcaaaagccacccttaaaggatgtttccaagggacacgtatgcacctaagttgtatccgcgcataggaattagatatcaaatgtggagaggggatacaggatggtaggctctcaaaagagttttagggagataagagaaattgtggcgtttgaagccaaagatcggaactgaacccaattacagtataggccattgattgggttggccaaaatatttgaccgggggagatttgaagagataattgtggcttgtaccaaacgagacgatgggaataggtaggagaggcagagatgtgtgggctatagagagtattttgaccgttttgggcaattgagaagtgggggagagtggggag

SEQ ID NO: 728244 - DNA, 371 bp, Homo sapiens
atgggtctcttcaccatttcttgcccacacagcatggtcatttctatggtcagcagtttcatggccaccagcctgtagtctagacatcacataaggtagagccacattatagtcttagcattaacatctacaaacgactaatttattgatttgctaattgttcctccttgttgtgtacaggtatcattaggaaaaacaaatacatttaggcttcagtgactaaaatttcctgctttgtgcttattgaatttcactgagactggttctataatttttgacgattcatgatgagtgtctaggcccgcagtgagtgagcgaattaactgattcgttcttgtagagagcagagaggttgcttaaaatgtgcaaaa

SEQ ID NO: 728245 - DNA, 596 bp, Homo sapiens
ttccaataaagaaagagagaaagaaataaacaatgatgataagtaaaagccagtccacaagtgtctgaatttcctctcgaggtagcagcatacccatgaaaacccttgggatagacggttcaaaaaatatatatatatatccggacaatgggatgtcaattgggtggaaaattaaatatagcctaatctcctcaaaatattcctaggtcacgggaaggcagaggtgtgtaatttcacatgataaaaagcacatttgaacacaacttctatgggtgttccctttccaaataataaacaagatggaccctgggaagtcaacctgatcttggccagtcccctactaaccctttttctatggtttctgaaatccattctctgaaactctggaaattccattatgaacaaactaactctcagagggagtacattacattgtttaaaagcatggacttgaatcaggcagacctggattcaaaatttagctctattatctaagtaccctgtgtgtgctatggaccagttaacttctggacaccctagtttccttagctgtaaaatctctcatttgtccttagctgcttctctggcagctgaaa

SEQ ID NO: 728246 - DNA, 844 bp, Homo sapiens
  misc_feature (186)..(186): n is a, c, g, or t
gatgttggtcccagcggtgtcagctgaggtaggtgatcgtgtccatgtatggccggaatgttaccgagtcatgtgcgtagtctgcgtggatgaggaggtacggatcctgacgagacggaggcacttgtcctggaaacttggttgttcccaattgtagcaacgaaccagcatatagttgtagtgagngcaggacacatatgtctaggctctcgtgctggcgcaagaatccccagattcaccaaattctaatcagccgagagttagttatgaagagtggcttgggggaagaaaaactactgtctggaactaataattctatgagcagtagcaagcaatgatggtgaaaaaagtaggtagacgaggtgcattttgttagaattgagactttgggggtgaagcgagagtgactgctggggtaggagaatgccttagactggttcagccccaaagggctgtgaagaagggatctgtatggaagagcagtgtgggcatgaggagaggtctagtgaataagcgggggttggctcatcatagctgtggtatcaaggtggaagtgcatcgagttgggccctctttacgaaggctgtagttggagcaatgttttgaaagttggcgacaaagagaaggggtggtacacattctctggaattctatcaggttagcagtgggttgaagaaggaaccaagctgaggaatttatggcgaatgaagtcggcattgtgtgtcaatggtggggatagctgtaatggtaaatgaaggggtttggaatgccttcgaatgtttaaggaggaaggtgaattcttgataattctttgaactggggataattcattataagctgaatg

SEQ ID NO: 728247 - DNA, 141 bp, Homo sapiens
cgaaggtactactaacagagtatgtgcgtgcatttctctgatttctcttcagaacgttctagaatgtcttcctcaaggacctgccatggagcaattccaccagaggagttcagcaagagaagggatttaagaaaagactgt

SEQ ID NO: 728248 - DNA, 129 bp, Homo sapiens
tcgatacgacttttttttcttctctttctctttttcttccttttctcctttctttttcttcttatctttcttctttttgtccccttctgtcgtcttataagcagccgtatagtagtagtaggcggccgc

SEQ ID NO: 728249 - DNA, 578 bp, Homo sapiens
  misc_feature (5)..(5): n is a, c, g, or t
  misc_feature (17)..(17): n is a, c, g, or t
  misc_feature (51)..(51): n is a, c, g, or t
  misc_feature (79)..(79): n is a, c, g, or t
  misc_feature (81)..(81): n is a, c, g, or t
  misc_feature (118)..(118): n is a, c, g, or t
  misc_feature (252)..(252): n is a, c, g, or t
  misc_feature (309)..(309): n is a, c, g, or t
  misc_feature (367)..(367): n is a, c, g, or t
  misc_feature (369)..(369): n is a, c, g, or t
ggggntttcattaaagnttgaccaaaccaaaccttgaacaaggccttcacnacctgaaaaaaaacaaaaaaatttttangngaaaatttgcccagcaattccctgtccaatgtccaantggcaacatccttgttatgatccttgtagccaaggataatttttttcaaaacaatcatttttgctttaaaaaccgttgtcttccttgacttccctgtatatgcacatagtttaactgtggcacttgtatttctnattgcaatgcctacttcctgaataaaacatcatttttcttttcagagagtctccctnttctgttattttaggtgacaaggatatgccaagaagtagcttggatatagcagttaantntgcctttaggatatgtgtatggggatataagagttaactaaaagctgacctttgagttggtccttgaataaaagaagaatagattccaaaaataagaggaataaataatgatcctgagctaggagagtacattttgcagacctttggtttccatattaagaaattcagatttttatgtacaataaagaagttctggaattcaaaaaaac

SEQ ID NO: 728250 - DNA, 401 bp, Homo sapiens
actctgcgcggcctcatcacggacacggttatccatcgtggaagatcctgtttcaaagccggtcatggcgcgctcgcatccagacgatcacgcagatgccgcagggtgcggatcatatacttttccaccatgtttttagacagccccaggcgtgtggcgatttcctgctgggtgagcccttcgatcttttgccagatgaaaatcctgcgacagttgagcggcaactcggccagcgcccgctcgatggcgtcggccaactggatcgcgtgcatgtaatgctccgggtcgctacttgtgaggcgtgctgtgatcagccgcctgcagcgtcaacgcctcgcggcggtcttcgcggcggtaggcatccaccgcaatattgcgcgcggtttgatgcaggtaggcgc

SEQ ID NO: 728251 - DNA, 1080 bp, Homo sapiens
agcgggccatcccccgtcctccatctttgagccactaggcgttcgtcacagtctcccaccccgccctgctcgcggagcctgccaggcctcggcctcatggcggtgctctgagtgcatggggcctggagggcttggtacctgaccgacccactgaatgcgttctggtggcggtaccctggtcacagaaatgcacgtgaccctggtgcgatgggctgacctgtgcggactctgtgcatacagctgacatggggaccactggtgcagagctgtctacttatgtgctacacaatgcgaggtgaagcggccatctcttgaacctatcacagacgcaatgtcatggtacgccaagcaccggactcagacgtcactgacacggaccggtgacgtgctgaccgctaagttgcctatccgcctctgtggcaaccctctgactacccctctgcctttggcgcggtcactcctaaccaactaacatggcggtacccacacctgcctggggtgcttggccgtgtgctccacaaattcctcgcctaaggcaaccatgcctccgttgccgcgacgcgcacagaggcacctccaccaacacacgcacggaacccctcatagcctgactcgacgtcctgcgcaactcggcgcctggcaacaccgtagcgccgctcgcggaacacggcacttttcaaccccatagttgcacacggtctagccgccgcgtcgatctaccccttgtcacaaccccgcgttcctctgccactaacggtatactgactccctcctatagatgcttcctaccggtgcgccttcggtcaatctccgcggactttccaccagagcaccccatggggttttcaccgagggccccccctttggtggttagtcgaccaccactacaacccgacttctaaggatggctcgccgacaaacgccatgcagcggtgcccactttcgtcccctctgcacttcccatgtccgaaacgcgtagttagttatacacccgaaatacttacacgatcgttcactcgtgccgctacatgccgattcatcactcgtaagacttacgtcagaagtctagccgatggactc

SEQ ID NO: 728252 - DNA, 329 bp, Homo sapiens
tacgtggcccagtgagaagctggccagttgcggaggcgctacctgtgtgccccagtgctcgctgccagtgtgtggcttgtgatgagagcaatggccaagctgatcatcggacgtgcgttgactgcttgctctatcaatgcatgtacgttgcctgctgagatgctggtgtcctgcaaccgtgcattaagttgagacttgggacaaggtgttgtatagttggaaacattacgagagcataaggtgacgttgtacaggactgagtgaaggaatgagagatgatgtaggaagagatgaagaaaagagaaaaatgaaaaagtgaatgatgggag

SEQ ID NO: 728253 - DNA, 150 bp, Homo sapiens
actctagaggatctcactcctaccacggagcatcgtcttctgacccagaatgtagattacgacagttgacatgtgctgaaaagtcacagacatgctgctgtgaaagcagcgggacagagggctgtaccctgcaaagccacagggacagag

SEQ ID NO: 728254 - DNA, 242 bp, Homo sapiens
tcgtctgcttccgttaggtgagctttgtttgctcgtgccccgtttccccgatggatacgactgccaggtgtagagcacgaaagtcggtcgccctacacggtcgatccattcaccacgggagagagggcacagcaaacgaggtccccaccttctcttttaccagaactgaagcttctgacaatctggccctggatgtaccgtgtatttccacacttgcccagggtaccgaagctcgacattcg

SEQ ID NO: 728255 - DNA, 944 bp, Homo sapiens
  misc_feature (226)..(226): n is a, c, g, or t
  misc_feature (228)..(228): n is a, c, g, or t
gatgaaaattctatacgctgagaagaaagctgaatgacgttcatatgcttctctgcatacgcctcaaactacgtacacattggtgaaggacgcttgagcggatagtatagaacgcacaatagatgaatcactggaggaaagcgactaccacgaactctgtgtagtcggttggttcaagctacggtggtaggcagaagagctcttgagtagtctgtatgacctcaanancgggtctgctaacagggcacgtagaataggtcgacgctctgtggaagacctacaaaactaaggaatctcatgtatgtgcctccaggacgctaggtctaccaatcgttcacagacgtacgacgaacttgagaggcgcacatggcgtggtgctgtgccaagggcgttgtccgaagccttgaatcctggtgagttgacatggctatggaaagcgctcgcaccgtggggccactgcatgaaaccctccgcggtgagtcaatgaaacaagtagcactatggcttccaatcattgacacagcatgagttgtcctgggagcatgaagactaactgacattcatttgttggctcgagaaatcgctctataactcgtgagtagtagctacgcacatttgtcctgacatggtttaaaggcatcggaggcacgggaaggacctcttgtgagtgaccccctggggctgttctcatcgattgaagtctccgtggtatacctctgaggtcaatccatgcgcatcgactctaagatgtgcaggttgtgatccgtgtaagattattgcatggtctccaacaccaagagtgaaacgagtcagagtcgcaagaagtccatgtgtacgtggccctcagccgaattccttgggcagccaaagatgggtagcaggcctggccgaagttgttcttggtgggattcgtaatgcaggccttactttgggggaaattcctg

SEQ ID NO: 728256 - DNA, 216 bp, Homo sapiens
  misc_feature (159)..(159): n is a, c, g, or t
gatcgatcgagccggaccctttatccttacggctgagtagtattccactttatggataataccacattttatatatctattcatcagtgagggacatttgattatttccacctttgcttattttgagtagtacttctctgaacattgcatacaagtttnggtctgaacatctgatgaatagatatataaaatgtggtattatccataaaatggaat

SEQ ID NO: 728257 - DNA, 275 bp, Homo sapiens
gggattagaggcatgagccacggtgcctggcctcggtaatggtgctttgaagttattgggctgtgtcgggctgcgatggctcggcagtcctcatgcgtacctgggaatcctggcaaggggagaagatctaacttactaatggttttcagatgtcatgaaacatttcagaatccggcactgaacaattagtagagtccacatgatgtttccctgggcagacatttaattaaaatggtatggattttcagtctggtagttttactttggtattggcg

SEQ ID NO: 728258 - DNA, 373 bp, Homo sapiens
tgggcgtatggagcatatcatcattatagtcagatggcgagacggtcaggatgcagtttgtgccatacagtggcacaaagcaaagagaatagatccctgtcataagtcctgtgtttgaacttaacagcactactaagcagagagcttgggttccatactcgaaagctagacctttcagggatttaccaatatagtagaaaaaagatcagataggacaacccacatgtacttaaaaactacaaactactcagtcattctcccattacaagccacatatccccaatcacaactcacatccaaaaatctcaaagcatagctaaagtccagtcattatgcacccccattcattttcaatattcatcagttccatcag

SEQ ID NO: 728259 - DNA, 278 bp, Homo sapiens
tgctgaaagcacacccgcctgggaaccgcaccccagaggggccacagtcagcgtgaagcagttattttctacgctacctgtgcgccataaggaatttcaaaggaatattaagaaggtacagtaaattaatcttggttttcaagagtattggttaatgcacatgagcaaaagatttactaaagatgtttattcttcagttgattctcttgccataatctattgagaaatgctttatttgcatttctcgttaaagacttaacattaaagacttaacttta

SEQ ID NO: 728260 - DNA, 875 bp, Homo sapiens
tataaacatctgcatataacaaagcattgaagcctatttatctgtgtaaaacattcaagaacgtgctgacgtactgatgtgaggtagagttataaaatcttgacatgatagcgggagtgttggagatggattaatgaggtatttgtgtcgcttttagtacgtttagtgcgcaggattgttctataagtctaagatgatattaaacaggtattgtagatcatagagaatatacataagacatgaaccaaagtgaaaggattacttcctggtaggatcttgtctattgtaacctggtaatgttagggaaatatctagtgatgttcttctaaagtagtgatggtaaaaagcttctttcataaattaccttcttgcctcagacctgccttgaccagagaactcaagtgtaagctgtgatgaaaactacatgctttcccacggtagtatttggctaggtatgtgtgtaactctctcgagattacacaggctgacagtacgatatgtagtatgacatacctgttaatggtcggattcagttccacatttgtcaaccatgttctatgagccaggcctgaagggacggtcagcattgtggaaaaaaccaggtaagtgtcgatcctacctactctccagaactacggtgtccagagaagaaaaggtgttgagccttaccgaggtagtgactgctcagtaatatggtccaacgcacgtttggttcccaatgtgacccattgagctaggtatgcatttgtgtatattcataaacattgtttgtataaatgccctaaataaattagccttccaaaatattccgtgtacgatcttaaaaaaaaatacggtggacactaacaaaaaaaaaaataatgtggtgggcgcag

SEQ ID NO: 728261 - DNA, 278 bp, Homo sapiens
actgggggaaactccccagacaccaaaacttctttaaagaacagtttactatgtagaatttagtacctgcaaacatgggcttaaacacaaaccggagactgaagtggaatgatacttcgtttggccctccactctccccattttgcactacttctcttccctacagaaatatctatataatcatgacactttactcatctacacaagacttagacctattcggatggcactctacaaccagtcctggagccctcagacaggagaatatactcccacgt

SEQ ID NO: 728262 - DNA, 125 bp, Homo sapiens
gtgattaaggatcccaagacgaactcttgggaataggttatgtgataggagtagggtaggatgagttggaagaagaaacgagaggagtaaagtttaattatgtgcttttgggttgagagtgatga

SEQ ID NO: 728263 - DNA, 455 bp, Homo sapiens
cccgggttcgagtgaagctaatttgccaaacccatatctctcctatcctcaatacctccctctactacccattattctgttctggatctcaaacatgcttatttttatactattcctttgcacccttcatcccagcctctctttgctttcacttagactgaccctgacaccagtaggctcagcaaattacctgggctgtactgctgcaaggcttcacagacagcccccattacttcaatcaagccaaaatttcatcctcatctgttacctatctcagcataattctcataaaaacacatgtgctctccctgctgatcgtgtccgattaatctcccaaacctcaatcccttacaaagcaactcctttccttcctaggcatggttagtgcggtcagaattcttacacaagagccaggaccgcaccctgtagcctttctgtccaaacaacttgacctt

SEQ ID NO: 728264 - DNA, 329 bp, Homo sapiens
gtttttgctgtttatggaggattgccatacacatgaatgaaaagctaatttttttactaatctttgaaatgttaatttcttttgagaaacaactagaacctcaagttatgtttttgatgctggtttttgaggaaataaatatctttactagtattgatacttaatttcatcttttatctttctacataagtatttttcatgttttataactgaggatcatgtaaggttttttctcattgtattccaatttcatgtgatcgtcattccatcttaggaactctttgcagttagtctgaagtaagtttatgtttgactattttatgatgcct

SEQ ID NO: 728265 - DNA, 148 bp, Homo sapiens
tttttagggccctttttttttaaattaaattcccaaccaaaggggaaattgtttcccaaaaaaggccctttttttttaacccctgttttgggaggttcccccccgtttagggaaaggaaaaaaaaagggggaaccttttttttcccca

SEQ ID NO: 728266 - DNA, 517 bp, Homo sapiens
cactgtgttgccaggctgtctcaatctcctggtctcagcctcgtgctcccaaatgtgctgggattactggaatgagccactctgcccaccccgtatttaactattctaagtacctctcatacagatggaagcatgcaatatttgtccttttgtgtctggcttacttcatttagcacaatgtcttcaagctccatctatgttgtagaatgtatcagaatttcattccttttggaggctgaataatattatgctgtgtagatagatacatcacatttttgcttatccactcatccatctatggacagttaggtttgcttccaccttttggctattatgaataatgctattacaaacatgggtatacaaatatctgttcaaatccctgctttcagttcttttaaatagatactcagaagtggaactgctggatcaaatggtaatcctgtttaattttgaagaaccatcataccattttccacagtggctataacatttcacattcccagcaggaatgcac

SEQ ID NO: 728267 - DNA, 222 bp, Homo sapiens
tcagaggattccaagaagatataaaaagtaattaggtagaatagtcagaaacattttctaaaggtaatttaggcacctgtaatcccacaactttgggaggccgagatgggagaatcatttggagccaggagttcgagatcagcctgaccaatatggcaaaaccccatctctactaaaaatacaaaaattagctgggcgcaatgtcacacgcatgtgcggtaa

SEQ ID NO: 728268 - DNA, 262 bp, Homo sapiens
cctcagcagccccccccctccttggcctttgcttggcccgggggcccttgcctggcttgttggttggtttcaccccagcaggagccctggggcccagcccgccaccaaacccgcccatgtgcctgcccggcctaaggcaggacagggtgtttggggctgggaggtgcggggacggggggtcggggggtatccctgttttttttgttgaattggggatgggccccagcgatatccaggctttttctgaacattgcttttctcc

SEQ ID NO: 728269 - DNA, 951 bp, Homo sapiens
  misc_feature (14)..(14): n is a, c, g, or t
  misc_feature (83)..(83): n is a, c, g, or t
  misc_feature (183)..(183): n is a, c, g, or t
  misc_feature (263)..(263): n is a, c, g, or t
  misc_feature (325)..(325): n is a, c, g, or t
  misc_feature (327)..(327): n is a, c, g, or t
  misc_feature (343)..(343): n is a, c, g, or t
  misc_feature (346)..(346): n is a, c, g, or t
  misc_feature (365)..(366): n is a, c, g, or t
  misc_feature (402)..(402): n is a, c, g, or t
  misc_feature (406)..(406): n is a, c, g, or t
  misc_feature (475)..(475): n is a, c, g, or t
  misc_feature (586)..(586): n is a, c, g, or t
  misc_feature (590)..(590): n is a, c, g, or t
  misc_feature (624)..(624): n is a, c, g, or t
  misc_feature (633)..(633): n is a, c, g, or t
  misc_feature (637)..(637): n is a, c, g, or t
  misc_feature (639)..(639): n is a, c, g, or t
  misc_feature (651)..(651): n is a, c, g, or t
  misc_feature (676)..(676): n is a, c, g, or t
  misc_feature (700)..(700): n is a, c, g, or t
  misc_feature (706)..(706): n is a, c, g, or t
  misc_feature (722)..(722): n is a, c, g, or t
  misc_feature (756)..(756): n is a, c, g, or t
  misc_feature (764)..(764): n is a, c, g, or t
  misc_feature (772)..(772): n is a, c, g, or t
  misc_feature (806)..(806): n is a, c, g, or t
  misc_feature (829)..(829): n is a, c, g, or t
  misc_feature (832)..(832): n is a, c, g, or t
  misc_feature (934)..(934): n is a, c, g, or t
tgacctcgctcccnttctccccagtagacccgccccacccccttctgtgtgcgctgggcttcaggacaaggggcaagagaggnaaccagggagacaaagggcgaagtgtctcggggacagggggccacaggcagttgtggccacatggtgagccccagggccgacgcagggccgacgggcaanaggctgtgatctccagcctggcgcttccgggcctttcttgaggccaccatgaggaatgtgatgtgtgacacaggggctangagagaaaaagacacgacgcaactcgggatcggcgcgtccgagacaggggcagggaaaccanangccctacaaagccctnccnataaaacaatacccagaannactcagatccctcagtgcctaaagaaaacaggacantaangcctgggcgagtgtaggggacgggggtcaggagagctggggcagggcccgtaagaggtggagggtgggnagagggagggaggggtgactgtatggtggtgctgcctctgaagcaccctccccttcgcccagtccccagccctatggtgatttaaaggggctgaaaagccaagaggcagcnggcncatgggaagcagggagacctgggggtggcgaggnaggccactnacancncagcagcaccangcgcagggcgatgcggttgtaccangctacaggcaggatgcgcacatancgagcnaggatgggcgtctcanacaagttcttcttgtgggagtggttgtcccagtngccagggnaagatctnactgctgccagttctggggtcctggtactcagtncagttcgcactgtcatttctgtnggnaccttgtcggatgccacaaactggacagagccaaagttacgggcccctggggtgatgatgctgtgactccttcgagagcccaggtcacctggcagcacttancgttacgtagctcccgc

SEQ ID NO: 728270 - DNA, 109 bp, Homo sapiens
aacagcagagccagaggcatattcatggagtctgaaggcttgaaaacccggagttcttatgtcaaaggcaggagaagacggggtgtccaactccagaagacagcaaatt

SEQ ID NO: 728271 - DNA, 762 bp, Homo sapiens
tgggtccattcaacggcttttatttaaagccccttttctcttacaaggccccctctttcaaccctttaatgaacaaccaggtatttcttttcggccaagtagttccccctgtacatgattcctcccccctcgcctttggccccactctctacaagtgagtttacaaacatctttctataccactagtttcctcgggagccctttccacattgtaccacccatagacctaaaaaattagcagaaaattggatcccaccccctccatgggttggacaaacctctccacacatggtgacaacccacgaacataccccttagaaagttccctcacatgagccgccaataccaacataattttgtcccacacaaatcacacacacattgagggccatcagtgcgcagtttttttatgttcccaccaagcctcttccggttggacacacgccaactaggcagtacccacaacactcgttgttaccgtacatattcttttcttttaccaactcctatgtttaactcacccaaatgcttccaaatttcacgcccgtatctgtggatggtttaccacacagcaggccccttcctaccacgcgagggtcggagaaagccacccctttctatcccctggtgacggaacagcgccctgatcttggccttttcgggccagcatccatggctttgtactgaaagctacattccggagacgtccacccccttgttacttctttgtaatattcattatactaacacctgacatgacgc

SEQ ID NO: 728272 - DNA, 222 bp, Homo sapiens
ttccctcatttgaccaactccatctaagtttagatgtgcagaagggcttagatatatccagagtaagccacatgcaacatgttacttgatcaattttctaaaataaggttttaggacttcattcccccatgttttcttcccttatcttactgtcattgtcctaattactatacatgcatatttttttgacagtagggagaaaccttttacagataagttaca

SEQ ID NO: 728273 - DNA, 894 bp, Homo sapiens
gtagtatcctgctcaggcaagatctgcctaagattatgattcaggagcatttggtgctgttaaaagctggagccgaatttagaagttcccttaaaaagaaacacattaagacttaccaatggaggcatgtgaatggttgcagtggagcttgaggtatacacatcatcacagtgtgttcagacgcggcggtcgagtatgtaaattggatgtgtccacgcgtgagataactgcgagtattggtaaccatcctgtgagagtagattgttctagtagtggctggaactattcagaggttacatctctctggaagtaatctgtaatttacttgcatcaaagacccctctgtgttctccatcatctttaatagcaactggagaccactttgcgtcatgggtaaagcgggttggatactcctcacaaaggggttttatgggacttcctcagtgcgggacgagcttctgagaaccacaggcgacgcgatggaacaaagactactaggcactttctgctttctgaaacccccttaatgccgatccttgcatgtcttgctgggcttactcttctgctggcacagtaccattttgggtctgtgtcccagagtggaacaaaatgtggcctgtcccattctagatatacttcaagaattctgaggagctagaagtcaactgttggcactaaagtgttcaccatctgtctaagcccctatgtacgtggaggcaactcttggaataatgtgttgaaatctcttgctattatcataatcttggggagaagaacccattttcggtgagaatccttccggtaagattttggttttgggccccttgttccgagaactgtgtggaccctttgagttgggggcctggtccgcctaagggggagaatcaatgtgag

SEQ ID NO: 728274 - DNA, 336 bp, Homo sapiens
  misc_feature (79)..(79): n is a, c, g, or t
  misc_feature (286)..(286): n is a, c, g, or t
aaacaacgaaatttatatacgatatcgcattgcggcgttcgccggcgttcgcccagccaagtccccgcgcggtttttgngcggagcgtaacatttgcatcaataatgttacaccggcgcgtcccagtattagatccagccagtttgaacccaacagattatttaggtattacgtttcatgttcacgtttaataacttggtcgacccccagaccgttgcggtagctacagcggcagccccatgaagtagtaggctcggcgctagccggtgcgcataaaacccgccgngcacatgctcaatatttatattattgtattgcacgcgtttgccgtggttt

SEQ ID NO: 728275 - DNA, 118 bp, Homo sapiens
gcgagcggctcttcattcttctgacattgccttctgcttgtttgcccttcagctgtatctggagcagtagttcaaacccagccacggtgccgtgccttgggggtccttcttatcagcc

SEQ ID NO: 728276 - DNA, 544 bp, Homo sapiens
ataatttcttgtcacagatattgcctgtgattggtaaattggtctaattctgtcattcagctaattggcccattagctgaatggtcacactaagttgcatcctccaactcaatttgatcagtaataaaagtttcatcctgccccctgtctgctacttaattttttatcgtttagatggggggaaattaagtagcagacatggcctgccccctgtctgctacttaattttttatcgtttagatggggggaaattgtgctatttatttggggcccttcagagaacccaatatgaacatgatttatctatttattcagtttttatgtccttcaggacagataaatgtatgtatacacacatatacatgtgttaatatatgtaagtatatacatatgtttaaatgtatgtgtatgtgtatactgatcttgctcttttcctgtgaaatgtattaatagtcacttcaaagatttggttgctattgtgaaagaaattaagttacctttcactttgaaactaatagagtaaagaaaaacaaaaatacctaaa

SEQ ID NO: 728277 - DNA, 1085 bp, Homo sapiens
agcagcctgccttggcctcccaaagtgcctgagagtgcagcctctgacccgcgcaccccgtctgggaagtgaggagcgtctctgcctggcctgaccatcgtctgggatgtgaggagcccctctgcctggctgcccagtctggaaagtgaggagcgtctctgcccagacgccaccccatctaggaagtgaggagcgcctcttacccagccgctattccatctaggaagtgaggagcgtctctgcccggtcgcccgtctaactgaggagaccctctgcctggcaacctgcctgtctgagaagtgaggagccccgtccgacccagacagccgacccgatctgacaagctgacggagcccactccgccacggcagaacaccccggcgctggcaagctgagcgacgcgctactccgcccggcagcgagccccagtcggggagcgacgacagcaccgcggcgctcaagaccgcaaccggccccagacacagaccggccccacgagcccagccaacccccgcaggcgccgcacacgcacacaggccagccgcgcgacaagccaccccacatcacgaacgcaagcacagcccgaccgggcagcacccccctcggcctgccgggccggcgcaggcgcgccggggcgccagtcccgcaacgcgtcggcgagggagcaagccagcggggaggcgcgccagtcacaggcgaggccggagcggcgcgacaggggcaaacggccgaccacgcaactcagcgagcccgcaccgcaccaacccgacagaccgggacgggggacggccagagaaggcggccagcaggaggaccgagaggcgcagacccggagacgggacgcgaagagcacggggaggccacggagagaggcgacggagtagtcccatcaccgcgcgtcagcgcagcggcgagcagctcgaggggtgagcgcggcaaagcagcggctcagctaacacacagccagacgccgagtagaccgacggcccgcagcaggaagcacggcaccccaagccagcgcacggtgaacagacccagcaataggactgtcgaagggcgcgtgcagaggcacggccagggcccag

SEQ ID NO: 728278 - DNA, 196 bp, Homo sapiens
tggacacgcgcaaacagggtcaggcatgtttctggtggtgtttgctcagtatggaagcaaatcagctacaacttcctgttcttctatgccggctgcaatccattccccgttcgttgatcgaagccgcagccatcgacggtgcatggccgaattcgtcgccttctttaagatctgcgctgccgccttaatcgccccc

SEQ ID NO: 728279 - DNA, 481 bp, Homo sapiens
catgtaagaccttgactttgccataattgtgaggcctcctcagccacgtggaactggtctcactctgtacccaggctggagtgcagtagagcaatcacggctcactgtagcctcaatctctggggttcaagcaatcctcccatctcagcctcctgagtagctgggaatgcagcaacatggaagcagctggaggctactatcctgaatgaaatactgcagaaacagaaaagcaaatatcacatgttctcacttataagtgggagataaccttgagtacacaaggacttaaagatgggaacaatagacactggggactccagaagacgggaagatgggaggaggaaggaaagggctggaaaactgcccatcttgtactactattatctggatgacgggatcaatagatgcccaaacgtcagcatctctcaatatatccttgtaacaaatctgcacatgcaccccctgaatctaaaattaaaat

SEQ ID NO: 728280 - DNA, 170 bp, Homo sapiens
gatcgttaagggagttcgggtatggggagaaatgggacaggaacaagggcaggaattgagccggagttaaggtggagtgggtcgaaggctaagtggtggcctgggaaatcggttcctgggaggactggaggcggggtggtgtggttggttgcttgggaattttgattggg

SEQ ID NO: 728281 - DNA, 259 bp, Homo sapiens
tgccatcatcgtggatagacacagacgtggcaggagctgtgcaaggcctttggccaggccgaagcacctagaccaacagaccatcattgccaagaccttcaacgggccgaagggatcacggagggtagaaagataaggagctcttgagcactgggcaagccccgtcccgcaaagaacgatggcctgcagccagcatcagtccagggaggaatctacgaggccacgagtccacgagccaaaaagagcaaggagtccgtgg

SEQ ID NO: 728282 - DNA, 346 bp, Homo sapiens
tatgctattgtattttaataatttcaattttaccgtcttactttccatgcttataggtacagcttgtcaggaaatgatactgaataaggtgatctctcaccacattaaaaaaaaaaaactacggaatataaaaaatgttttggtttcctttttaaatgacaaatcctacagtatgctagatatacaagggttattacttcccttcaagtaattgacattcaaaaaaaagttaaatcagtacagtgtaaatatcggaaagtctttttttctggtggcaggaagactagtatagggtagttattttctacatttaagcacaattatgtgtgggtctccggcgtgtgca

SEQ ID NO: 728283 - DNA, 106 bp, Homo sapiens
gttggacctgtcagctctccttgatgcgtcttggagctgcataaatcattttgctcttaaggggcgcagactcgggtgccagaagataaacaccagatctccttct

SEQ ID NO: 728284 - DNA, 350 bp, Homo sapiens
atcggtgtgaatcttgtagccttcacctcctaatccccaccattgtgtggcaggtgtgtttgcctctttctaattgttgagccggaccagttattgggtggaggagatagttcaagttggtggtggtggacttgtttgggggtcctcccaccacaaacgtgggatccgtgcacgttaacgattactaggactatgcagtatcctgttgttttttcttcaacttccttttttttttttcttttttttctttcttttgttctttttttttttttcttttttttcttcttcttttgttttttccttttctttctcttttttgttttttctttttctttttctctttttttctt

SEQ ID NO: 728285 - DNA, 2532 bp, Homo sapiens
ctcagcctcccaagtggctgggactgcaggttctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccacgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactattttgattcttcagagagaactactaataaaaatctaaaaggta

SEQ ID NO: 728286 - DNA, 334 bp, Homo sapiens
aaagaaaacgtctctggtgattttaaaaaggaggcatcaagagaccattgctggctggctgccgtggctcacgcctgtaatcccagcactttgggaggccgaggcaggcagatcacttgaggtcaggggttcaagaccagcctgggcaacatggtgaaaccccgtctctactaaaaatacaaaaaaaattagccaggtgtagtagcggacacctgtagtcccagctactccagaggctgaggcacgggaattgcttgaacccaggaagcagaggtttcagtgagctgagactgcacccctgcactccagcctgggtgacagagcaaaactccgc

SEQ ID NO: 728287 - DNA, 457 bp, Homo sapiens
  misc_feature (370)..(370): n is a, c, g, or t
gggcttccgttccttccctcctcccttctttcgttccacttttacttccttggccaggagcttctcttagaagctcaccgttctgtggtagatgaagagtttcctatcctggtctccgagagttccactctagattttaccattaagccgaactggatccggattccaaatctggaactaaaaagactccagttaacttatggttaccttaattagtattaatccatttgggtatctggtgggcaccattctttggttaggtggctaatataagctgtaaagggcattctctcccaggaactttaaattattatcactggtaacagcaaagttaacaatgttattttccccttaaaagagtccggtgttncaggaaaacacactccgtggcagtgttacccttttaactggatcttggaaactggtcctgttggaacagtagggtaccgaactcgaa

SEQ ID NO: 728288 - DNA, 162 bp, Homo sapiens
gaggagaggggggatgtgggctatgcagcccccagggaagatgctgcctgtggacagtctgtggacctgggggaaaggcgcagctgtaggcaggctctgggtaggagctctagggaggctgagctggctctggagtgggcatgtgtcacccgatggaggggg

SEQ ID NO: 728289 - DNA, 1214 bp, Homo sapiens
  misc_feature (13)..(13): n is a, c, g, or t
  misc_feature (25)..(25): n is a, c, g, or t
  misc_feature (395)..(395): n is a, c, g, or t
  misc_feature (415)..(415): n is a, c, g, or t
  misc_feature (965)..(965): n is a, c, g, or t
  misc_feature (984)..(984): n is a, c, g, or t
  misc_feature (1214)..(1214): n is a, c, g, or t
cccatttaattangaccaaccgganaagccgcccgcccatttggtggtctgaggtaccacaggcgtcaatgtcggtgactcatacattgggctccggtggttgatacttttatacttcattatttagtgtggagcatgagcttcgcccttctgtgggctacccccgcgcggtgctctgcctctttctcctctcctcacatgtgctctagcgtacttttcatggtagctgccccataacgcgtataggatactgtcgagggtggcctcttgtgcgtattgtttgcgtgatgcatggatgggaagtgtaaagatggagtaacgctctatcactcgcgcctgtatcaagattacgagtaagagcgagaggacgacatgtgagaaagcgcatactcatnaaataggagaattattattntttgtattgtgttgtgatgttagttgtgatgggaggttttctgggttggtgggacgagggtaaggtgaaccggccatcgacaggaacatacgctacacacaacagatcaccgctaatacccgcaaagactccgatagataaatgtcaacaaggagacacgcagaccgaagcgcaccccaccacactactgaagggggtatttgctcgctatgctttgtgaacgggtgggtgtggactgtgggaggttggggttcggccgtttattaccgattgtgcctatccggtgctcatgctagttttgaggggttgtatttgacgcgttccgtgacctcggcgtcatcctcaccgctctccgtccgacctcctcgaaacgtcatatggtgcaacatgagctgtcacggagaggagacgagtaactacgggggagtaatgtcaaacgacgggacggaacgaacttcgtgcgatggtaagggacgaaacaatgcctacgcctacatatctgtgtagtcttggagtgcgctgctcgctatcctgcacattgtagacatgnaagatccacacttcttgtntgctgctcaccaacgattatactcccagctttgaagcatgatcgcttagtagtatgcatgttagaagatgttctgctataccctcatttatttagttatatctagtactgtaataatatgagaagttatccatgcagacacctacacataatacataatcttagatatgtcaaatgtaggtgtagtataatagagagttcaatggacgagtaatctaactttgcatcacn

SEQ ID NO: 728290 - DNA, 392 bp, Homo sapiens
  misc_feature (10)..(10): n is a, c, g, or t
  misc_feature (136)..(136): n is a, c, g, or t
ccatacaagncacaaatcaaatcctatccagtatctgacggcctgggtggggcggagaacggacttcacacactagtttgttgaggtctcttggaaagcacagcaaagagcagcagtaggtgctaaaccccttgtntcttttcttagattctcgactatctctttgcacatggacagctttgtgagaagggcttcgaccctcttttagtggaagaggctctggaaatgcaccagtgttcagaagaaaaggtgggaatcttcatgtttcttgggaaccctctggaaaaggagggaccaagtatccatcctggttttctcccttggcccacacacaacctttttgctttgccagtgactacaggtacaagtatttgaagggcagaatctcccaa

SEQ ID NO: 728291 - DNA, 187 bp, Homo sapiens
  misc_feature (174)..(174): n is a, c, g, or t
aagtattcccagtttcttaaagagttaaacatccatgcaccatacaacccattgacttcactcctaggcatttacccaaaaaaaggaaagcatatgtccacacaacgacttgtagacagatgttcacagcagctttatttgtgacagccccaaactacaaacaactcaaatggntccatgaaaacct

SEQ ID NO: 728292 - DNA, 260 bp, Homo sapiens
acgcgtccggcggtgcgaggcgtgcgggttgtcggaagctcaccgggtctcttgctggggagagggatgcgggccttcctgctactgctgtggcttgcagcccgcggaagcgcgctgtatttccacatcggagaaacagaaaagaatgcttcattgaggagattccggacgagaccatggtcatcggaaattaccggacgcagctgtatgacaaacagcgggaggagtaccagccagccacccctgggcttggcatgttc

SEQ ID NO: 728293 - DNA, 2702 bp, Homo sapiens
  misc_feature (61)..(61): n is a, c, g, or t
  misc_feature (83)..(83): n is a, c, g, or t
  misc_feature (95)..(95): n is a, c, g, or t
  misc_feature (127)..(127): n is a, c, g, or t
tggaagtaggacttcaacatggcggctgcggcactggcggtggctacggtgacggcctggnccggagcgggcagaagttgganggtggtggcgtngctctccctaggggctgtcgggagctcagcgnggaccgagcctgggaggccggccggtgccagcacctttcggcttctgagacggcggcagcagcggcattcaggttctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccacgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactattttgattcttcagagagaactactaataaaaatctaaaaggta

SEQ ID NO: 728294 - DNA, 399 bp, Homo sapiens
gagtatccccttggcaggcactagtgccgagcaaagggggaagagccccttataaatctaacacatcttgtgagaatgcactcactatcactgagaaaaggatgggggaaccacccccatgattcaattatctccacctcatctctccttgacacctggggattgtgagtcaagatgaggtgtgggtgtggacacaaagcctatccatatcacaaagggtgctagggggcgtccattttcttcttaccaatctacaatatttaattttttcataataaacatacatttcatttcatatttaaaatgttccatatttatttatttagagacagggtctcactatgttgcccaggcaggagtgtagtggtgcaatcaaagctcactgcagcctcgaactcc

SEQ ID NO: 728295 - DNA, 351 bp, Homo sapiens
ggaaacctggatcgttcacttgggaaaccgacaggttaagtcgtcatttcagaatagtaaatattagaacgatacaatactcggcattcctcaaaggtcagtacatccaatgtgctcgcacacatctgatgacgtcagaagaagcagctctgcccagaatcaggtatcagtaccatgcacatgctctaaaaagtactcatgccatgttatctgctcatttctgccagccttagaaacagtcgtcagaaaaatagcatccagagaggcaacttcgccttttaactgagctgtcttctgaccaatcagcagggcccagccaaaaagagcgtgacaatactcgacactagttct

SEQ ID NO: 728296 - DNA, 1080 bp, Homo sapiens
  misc_feature (17)..(17): n is a, c, g, or t
  misc_feature (102)..(102): n is a, c, g, or t
  misc_feature (398)..(398): n is a, c, g, or t
  misc_feature (512)..(512): n is a, c, g, or t
  misc_feature (515)..(515): n is a, c, g, or t
  misc_feature (811)..(811): n is a, c, g, or t
  misc_feature (888)..(888): n is a, c, g, or t
  misc_feature (960)..(960): n is a, c, g, or t
  misc_feature (976)..(976): n is a, c, g, or t
  misc_feature (996)..(996): n is a, c, g, or t
  misc_feature (1009)..(1009): n is a, c, g, or t
  misc_feature (1013)..(1013): n is a, c, g, or t
  misc_feature (1016)..(1017): n is a, c, g, or t
  misc_feature (1020)..(1020): n is a, c, g, or t
  misc_feature (1079)..(1079): n is a, c, g, or t
ccctcctccaccctctnccccccattccaaccttccaccctcccacctccccacaaaaaaaattacttattttcttcccccatacataccttcaccccaccnaaaaaattaaattttaaccatcacccaaatcctccacatccaccctcctcactctcccaaccacatccctcccaacttctcccacctcatcactcatcaacatcccatccaccccacccccacctaccacccccacacccacctccacctccaccccatctctctctactacaatcaacccacacctcccaaatatcttcctcctcccatcctcctccatctacaacctcccaccatccactctcttccctcacctccttttccccacatctttacaccacacaactttctatttnctcactctcccccacctaacaactcccccaaacccactacacacaccccccccacctccttcattctctcctccatctcctacccaaccacccacacacctctcactccctccnccncttccacctcacccactcactccccccccccacaccctctccaatccccactctccttatcaccaacatcccacaacaataccctcatcccatcatcaataccttcactctcctcccttcacccaaactctctcacaccctcctccacccctacaatcccaccctctccctccatcacttcctacacaatactcatcacacctattccattcacaaccaccccctctatcatatctccttccccactctcaacctcaccacaccaacctacccccatctcaaccaccttctctcanccaccatcacttctctcaacacctccctccctttccctccccacctcaatcctcacctccccaacttcccactcaanatcctccccttccccacctctccatttctttatccctcccttttcccctcttcaccacccctccaaccaacnctatccactctcacantccccactcacccaccactnttccatccaaaanatantcnntcntttaaccccccacccccaaactcacctcctcttttttccctctccattcataaacactnc

SEQ ID NO: 728297 - DNA, 2676 bp, Homo sapiens
  misc_feature (3)..(3): n is a, c, g, or t
aanaatcatgctggccccttacagtatttcttacatgtttggggctatcattccctagcatgggatttgtttaggacattgtgctagataatagagatccaggagggtctgtagccaggttgctgcccacaagaggcttgtgggaacatagtttggttaaatcttacaaggacattggaagccttactctttttaagtggggatcatcccacacgccttaaatgctgccttgtcccggttatccctcttgcccccaggagtgaggaaggagtgaattgggtggtggggtaaagatggccaccctggttcacacccccttcctctgctatatctttgcagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccacgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactattttgattcttcagagagaactactaataaaaatctaaaaggta

SEQ ID NO: 728298 - DNA, 1339 bp, Homo sapiens
  misc_feature (873)..(873): n is a, c, g, or t
  misc_feature (906)..(906): n is a, c, g, or t
  misc_feature (946)..(946): n is a, c, g, or t
  misc_feature (957)..(957): n is a, c, g, or t
  misc_feature (987)..(987): n is a, c, g, or t
  misc_feature (991)..(991): n is a, c, g, or t
  misc_feature (1011)..(1011): n is a, c, g, or t
gatgcactgatctgcacagatgacttcattgccaaagttgttcaaagatgtatgtccatccctgtgacgatgagggctattcggaggaaagctgaaaccattcaagccgacaccccagcactgtccctcattgcagagacagttgaagacatggtgaaaaagaacctgcccccggctagcagcccagggtatggcatgaccacaggcaacaacccaatgagtggtaccactacaccaaccaacacctttccggggggtcccattaccaccttgtttaatatgagcatgagcatcaaagatcggcatgagtcggtgggccatggggaggacttcagcaaggtgtctcagaacccaattcttaccagtttgttgcaaatcacagggaacggggggtctaccattggctcgagtccgacccctcctcatcacacgccgccacctgtctcttcgatggccggcaacaccaagaaccacccgatgctcatgaaccttcttaaagataatcctgcccaggatttctcaaccctttatggaagcagccctttagaaaggcagaactcctcttccggctcaccccgcatggaaatatgctcggggagcaacaagaccaagaaaaagaagtcatcaagattaccacctgagaaaccaaagcaccagactgaagatgactttcagagggagctattttcaatggatgttgactcacagaaccctatctttgatgtcaacatgacagctgacacgctggatacgccacacatcactccagctccaagccagtgtagcactcccccaacaacttacccacaaccagtacctcacccccaacccagtattcaaaggatggtccgactatccagttcagacagcatnggcccagatgtaactgacatcctttcagacatngcagaagaagcttctaaacttcccagcactagtgatgatngcccagccatnggcacccctcttcgagattcttcaagctcngggnattctcagagtaccctgtangactctgatgtctttcaaactaacaataatgaaaatccatacactgatccagctgatcttattgcagatgctgctggaagccccagtagtgactctcctaccaaatcattttttctcatgcatggagtagatttcaatcctgatttattgaacagccagagccaaagtggtttggagaaagaatattttgatgaaaagcagcaaagtggggataatgatgatttccacaggatttgcctccccaggcccctaatactttgggggtgccaatgctgccaggggacaccgggcacaccagtttagggcaataccaagcggaaagtgatcc

SEQ ID NO: 728299 - DNA, 2579 bp, Homo sapiens
  misc_feature (61)..(61): n is a, c, g, or t
  misc_feature (83)..(83): n is a, c, g, or t
  misc_feature (95)..(95): n is a, c, g, or t
  misc_feature (127)..(127): n is a, c, g, or t
tggaagtaggacttcaacatggcggctgcggcactggcggtggctacggtgacggcctggnccggagcgggcagaagttgganggtggtggcgtngctctccctaggggctgtcgggagctcagcgnggaccgagcctgggaggccggccggtgccagcacctttcggcttctgagacggcggcagcagcggcattcaggttctaaatggcttctaagaagttgggtgcagattttcatcagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccacgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactattttgattcttcagagagaactactaataaaaatctaaaaggta

SEQ ID NO: 728300 - DNA, 1322 bp, Homo sapiens
  misc_feature (856)..(856): n is a, c, g, or t
  misc_feature (889)..(889): n is a, c, g, or t
  misc_feature (929)..(929): n is a, c, g, or t
  misc_feature (940)..(940): n is a, c, g, or t
  misc_feature (970)..(970): n is a, c, g, or t
  misc_feature (974)..(974): n is a, c, g, or t
  misc_feature (994)..(994): n is a, c, g, or t
ctctagaggatctcgtgctccttccgggtgcatccttccgggttgtgcatccggtagtcggtggagcaggaaagctgaaaccattcaagccgacaccccagcactgtccctcattgcagagacagttgaagacatggtgaaaaagaacctgcccccggctagcagcccagggtatggcatgaccacaggcaacaacccaatgagtggtaccactacaccaaccaacacctttccggggggtcccattaccaccttgtttaatatgagcatgagcatcaaagatcggcatgagtcggtgggccatggggaggacttcagcaaggtgtctcagaacccaattcttaccagtttgttgcaaatcacagggaacggggggtctaccattggctcgagtccgacccctcctcatcacacgccgccacctgtctcttcgatggccggcaacaccaagaaccacccgatgctcatgaaccttcttaaagataatcctgcccaggatttctcaaccctttatggaagcagccctttagaaaggcagaactcctcttccggctcaccccgcatggaaatatgctcggggagcaacaagaccaagaaaaagaagtcatcaagattaccacctgagaaaccaaagcaccagactgaagatgactttcagagggagctattttcaatggatgttgactcacagaaccctatctttgatgtcaacatgacagctgacacgctggatacgccacacatcactccagctccaagccagtgtagcactcccccaacaacttacccacaaccagtacctcacccccaacccagtattcaaaggatggtccgactatccagttcagacagcatnggcccagatgtaactgacatcctttcagacatngcagaagaagcttctaaacttcccagcactagtgatgatngcccagccatnggcacccctcttcgagattcttcaagctcngggnattctcagagtaccctgtangactctgatgtctttcaaactaacaataatgaaaatccatacactgatccagctgatcttattgcagatgctgctggaagccccagtagtgactctcctaccaaatcattttttctcatgcatggagtagatttcaatcctgatttattgaacagccagagccaaagtggtttggagaaagaatattttgatgaaaagcagcaaagtggggataatgatgatttccacaggatttgcctccccaggcccctaatactttgggggtgccaatgctgccaggggacaccgggcacaccagtttagggcaataccaagcggaaagtgatcc

SEQ ID NO: 728301 - DNA, 3391 bp, Homo sapiens
  misc_feature (61)..(61): n is a, c, g, or t
  misc_feature (83)..(83): n is a, c, g, or t
  misc_feature (95)..(95): n is a, c, g, or t
  misc_feature (127)..(127): n is a, c, g, or t
  misc_feature (3391)..(3391): n is a, c, g, or t
tggaagtaggacttcaacatggcggctgcggcactggcggtggctacggtgacggcctggnccggagcgggcagaagttgganggtggtggcgtngctctccctaggggctgtcgggagctcagcgnggaccgagcctgggaggccggccggtgccagcacctttcggcttctgagacggcggcagcagcggcattcaggttctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccacgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactattttgattcttcagagagaactactaataaaaatctaaaaggtaaaaaaaaaaaaaaaaaaaaaaaaaaaaaagagggggggcggcgatcgcgcgcgaactcatagaaaccatgaggggcgccatattcatctatatagtataaaacccccgagcccacagtggacccctataaagagagggggccccctctctcgagacccctctctctataagggaacccgcgcggcccaagcccgagggtgatttctacactctcacacactccaacataagcgccctcctcaatatacaaggagggccatactaaaacacaaaacactataaaccatatattacccaaggagagtgggcgccgaagcgtctacacgagcggaagaaaagccaccaattaccacaggggcacacaacaagaaaaccacgcgtggtccccaaaaagggggccttgcgaaaaaaggaggagataaactcctatatattgtatttataacccttcaaaaagaaagtgtttttattaccatctttacacgaaaggaggaagttattatctggaaaacgcctttttgttagccaccttccaacggcacatatagacgccaatattaaacccccagcaaaatattaagaggaaggggcgcattgtgagtggcccccacaaaaaggaggagtattaacccccccggtgtaaaaaatttctcccctttaaagaaacggttccacattatcgtgataan

SEQ ID NO: 728302 - DNA, 4796 bp, Homo sapiens
  misc_feature (61)..(61): n is a, c, g, or t
  misc_feature (83)..(83): n is a, c, g, or t
  misc_feature (95)..(95): n is a, c, g, or t
  misc_feature (127)..(127): n is a, c, g, or t
  misc_feature (4569)..(4569): n is a, c, g, or t
  misc_feature (4596)..(4596): n is a, c, g, or t
tggaagtaggacttcaacatggcggctgcggcactggcggtggctacggtgacggcctggnccggagcgggcagaagttgganggtggtggcgtngctctccctaggggctgtcgggagctcagcgnggaccgagcctgggaggccggccggtgccagcacctttcggcttctgagacggcggcagcagcggcattcaggttctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccacgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactattttgattcttcagagagaactactaataaaaatctaaaaggtatgtcttggtgtgataacttctttattaccaaggctgttttatgggagtgggggggccatgtggtgtataaagagatttcttgcttagatttgctggggatagaataggacctaaccgttttctatttcggagctttcttcccacttcagacctgtcctcgtttttggtttgcaaaggcaagcctagactgagtcttttaaacctggcccagctccgtctgtggaccaaggacgtaggccttcctgactgtggagttgggataggctgggccttcagggggatcacccagtaaaagaggaagaagcccttttactgtgagcagcaggcatttatgcatcatttgccacaagcagaggatgggatttaaactgtttcaccagctctcagtggtgctgttgtatatgatgatagaatagggttcattcctaaagtaagtaagtttttgtccttgaccttaatactgtgccattgtcccacttgagcttttggctagactgggtctttgaaggtttttagtgatcatgtgagggaggggccgcagtgccctgcagccgggaagcaccaataaggatgccccctggcggtcagatgaggcactgtcaggctgacaaagggtgactggaccaggctgctagtgtctcaagagagccatttaaccctcttcttgccttttaattaagccctccttttaaaaccgtaaaaagttatcctttatctgaaggaaataaaggctcacatagtaatgggcgttcggggccaggccgtgactcatgaatctccatttgacccaagagtggcttcaaagtaattggcacctggaggctactttgtcttccctgtcctgagctgcttcctgctaaaaagatacacagcaggcagaacttggctgaaggtttgtgtgtgaattctgtttcagaggcctcagactgttgaacagagcactctgttcaactgccaaggttcccaacacagacccctgagaggcagggtggctgggcagggtgaactggatgaaggccaggctaggagatggactattccatgagggggctgggtagtgaggtgtcccagataggagccaggagctgccatggaagcatgagagtatcggcatgtacagagcctttcacccgagcaaaagtcaggagaaaattgatgtgtgacacaggcaccctcttctgcctcaacactggattgcaggaagggaagggagctgtaaatataaggcctgtctcacatctgctgctgtcagtgacacatcaagtcaaggtttatgctatttacattttcaaaacgcctctgaatccccaaatcaatctccaagggctgatggggcagagctcaccccacccctgtccccctagcaccaatggttaagtttgggccagtgtttagtcttctaagttaggcacagaattcagctggtgaagcctctggtctcagcatgttgtcttctctgtcttgtgacctctgacctctaggctaccactgaccaccccatcctctgatccccaaacttagaaacttcagggttattagacccaaatatattcccacaggcaaggggttagttaatcatattctctaggcacaagggaaaggcattaggttcttcggcctggcccacccttggaggcactcctgtgcatggaactgagggacaggggcctgtccctgagggagaagctgggacctatctgaagccacgtggggctggggtgacgctagcataggcaggaccagcgtgtgggttctggtgtgtgcagggaggacctggcagaggctcctccagcctgagagcccagcacagactcctgcagggcccccaccatctcggcacagggtctggctctaagacggcactgtnccctcaggggctgcggtgggcccgtgncaggtgagatagagctgcagctggctcctcagactctgggatacccttggatttcagaaccatgattcatccagctgggtcacaaaatcttcaaaatcattagaagccagctggctcatcagcgtctcctccttgagccgagatcagccattcatccagctgttcctggtgtgtcggattgacactgttggcttgtccag

SEQ ID NO: 728303 - DNA, 269 bp, Homo sapiens
cgccgaaaatgaatagaggcaggattttgaacaaattatacttatttttgatagagtctcgctctgcaccaagctagggtgcagggatgatctcagctcagtggaacctccacctccggagtccaagcgactctcccaccccagcctcctaagtagctgggaccacaggagtgtgccaccacgccggactaactttggcattttcagcagagagggggcttcaccacgctggccaggctggcttcgaactcccgacctcaggtgatcca

SEQ ID NO: 728304 - DNA, 4711 bp, Homo sapiens
  misc_feature (61)..(61): n is a, c, g, or t
  misc_feature (83)..(83): n is a, c, g, or t
  misc_feature (95)..(95): n is a, c, g, or t
  misc_feature (127)..(127): n is a, c, g, or t
  misc_feature (4569)..(4569): n is a, c, g, or t
  misc_feature (4596)..(4596): n is a, c, g, or t
tggaagtaggacttcaacatggcggctgcggcactggcggtggctacggtgacggcctggnccggagcgggcagaagttgganggtggtggcgtngctctccctaggggctgtcgggagctcagcgnggaccgagcctgggaggccggccggtgccagcacctttcggcttctgagacggcggcagcagcggcattcaggttctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccacgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactattttgattcttcagagagaactactaataaaaatctaaaaggtatgtcttggtgtgataacttctttattaccaaggctgttttatgggagtgggggggccatgtggtgtataaagagatttcttgcttagatttgctggggatagaataggacctaaccgttttctatttcggagctttcttcccacttcagacctgtcctcgtttttggtttgcaaaggcaagcctagactgagtcttttaaacctggcccagctccgtctgtggaccaaggacgtaggccttcctgactgtggagttgggataggctgggccttcagggggatcacccagtaaaagaggaagaagcccttttactgtgagcagcaggcatttatgcatcatttgccacaagcagaggatgggatttaaactgtttcaccagctctcagtggtgctgttgtatatgatgatagaatagggttcattcctaaagtaagtaagtttttgtccttgaccttaatactgtgccattgtcccacttgagcttttggctagactgggtctttgaaggtttttagtgatcatgtgagggaggggccgcagtgccctgcagccgggaagcaccaataaggatgccccctggcggtcagatgaggcactgtcaggctgacaaagggtgactggaccaggctgctagtgtctcaagagagccatttaaccctcttcttgccttttaattaagccctccttttaaaaccgtaaaaagttatcctttatctgaaggaaataaaggctcacatagtaatgggcgttcggggccaggccgtgactcatgaatctccatttgacccaagagtggcttcaaagtaattggcacctggaggctactttgtcttccctgtcctgagctgcttcctgctaaaaagatacacagcaggcagaacttggctgaaggtttgtgtgtgaattctgtttcagaggcctcagactgttgaacagagcactctgttcaactgccaaggttcccaacacagacccctgagaggcagggtggctgggcagggtgaactggatgaaggccaggctaggagatggactattccatgagggggctgggtagtgaggtgtcccagataggagccaggagctgccatggaagcatgagagtatcggcatgtacagagcctttcacccgagcaaaagtcaggagaaaattgatgtgtgacacaggcaccctcttctgcctcaacactggattgcaggaagggaagggagctgtaaatataaggcctgtctcacatctgctgctgtcagtgacacatcaagtcaaggtttatgctatttacattttcaaaacgcctctgaatccccaaatcaatctccaagggctgatggggcagagctcaccccacccctgtccccctagcaccaatggttaagtttgggccagtgtttagtcttctaagttaggcacagaattcagctggtgaagcctctggtctcagcatgttgtcttctctgtcttgtgacctctgacctctaggctaccactgaccaccccatcctctgatccccaaacttagaaacttcagggttattagacccaaatatattcccacaggcaaggggttagttaatcatattctctaggcacaagggaaaggcattaggttcttcggcctggcccacccttggaggcactcctgtgcatggaactgagggacaggggcctgtccctgagggagaagctgggacctatctgaagccacgtggggctggggtgacgctagcataggcaggaccagcgtgtgggttctggtgtgtgcagggaggacctggcagaggctcctccagcctgagagcccagcacagactcctgcagggcccccaccatctcggcacagggtctggctctaagacggcactgtnccctcaggggctgcggtgggcccgtgncaggtgagaggcaaccaactcaggagtcagatcctctggtccagatctaataagctgaacattcaggctgtaatttggggttttaaagaaatgttttaggagggttgtgtttaca

SEQ ID NO: 728305 - DNA, 2652 bp, Homo sapiens
  misc_feature (61)..(61): n is a, c, g, or t
  misc_feature (83)..(83): n is a, c, g, or t
  misc_feature (95)..(95): n is a, c, g, or t
  misc_feature (127)..(127): n is a, c, g, or t
tggaagtaggacttcaacatggcggctgcggcactggcggtggctacggtgacggcctggnccggagcgggcagaagttgganggtggtggcgtngctctccctaggggctgtcgggagctcagcgnggaccgagcctgggaggccggccggtgccagcacctttcggcttctgagacggcggcagcagcggcattcaggttctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaagagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccacgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactattttgattcttcagagagaactactaataaaaatctaaaaggta

SEQ ID NO: 728306 - DNA, 1664 bp, Homo sapiens
cggccgaaactcaggaaacaggcagtgacggattcaatatacgaatcgttcaaaagagcacaattcaagcaccagagcggaagcgtatgatataataaacaccactaggcgggcactgttacatacattaccatgccctgaatgtccttctgttcctcaaactgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccacgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactattttgattcttcagagagaactactaataaaaatctaaaaggta

SEQ ID NO: 728307 - DNA, 441 bp, Homo sapiens; identical to SEQ ID NO: 404193

SEQ ID NO: 728308 - DNA, 722 bp, Homo sapiens; identical to SEQ ID NO: 265030

SEQ ID NO: 728309 - DNA, 417 bp, Homo sapiens
ttcctttcacctggggaaggatttggctttggggaggtaagagcttgaaacatgggatgagagaggagtcactgctacctctgatttgctcaaagccatgggagttgtttagaattctctacctctactgtcacctaacaggcaggcttcatctgcaggccttccaagtagtggaagttcacaggtagaaaatttaggtccctgaatccgtgggttcgctgtctcagcccattcagaacaattctttaggtactggcctcactggagaaagaagtgatccagaagaacagtctagtgaccaggagatctgagggtagggtgggagtgacgctagagcaccaaggggggctttacagctgtgttctcatggaggacaggcttctgctcattctggctttcccactcttgtggttccca

SEQ ID NO: 728310 - DNA, 663 bp, Homo sapiens
gcttcacaattggtttcatgttctgatcccccatcttactaaacatgtaatctgggacaagccactggctctctcagaacctgtttcttcatctgtgaaatgggaatgcaaacaccagtttcaccagctgtcttaaacccaaatgagataatgcataactacaaaatgatacacaaatgaggttgactgtactattcttattccttgatggcattaaaggttttttttttcataattagtactttttctttgaatgtgtgagtggtagatgcaattggaacccttttgcaactcttcttggttggaaagttatctaaagttgctaatcagaccctctgctaatgtaaattctatatactgagacactgctaaacacccattaattttaactttctcattaaaaaggatgacatagaaacccttctttgtagtcaatatagatgtattttctcaaagtgaatcattaaacttaagggctttgtcatgtgaggcctctgaaaattgtacaatattagaaacatcaatgtctgtgtttaataaacttactggtagctttactgtgttgaatgtctccacctaattttgtttgtttaaaaccttgcttttggaaatttagcccttcaacttttctttaacaaaatcttggaatgaacttctgattta

SEQ ID NO: 728311 - DNA, 289 bp, Homo sapiens; identical to SEQ ID NO: 264196

SEQ ID NO: 728312 - DNA, 464 bp, Homo sapiens; identical to SEQ ID NO: 264197
  misc_feature (406)..(406): n is a, c, g, or t
  misc_feature (415)..(415): n is a, c, g, or t
  misc_feature (440)..(440): n is a, c, g, or t

SEQ ID NO: 728313 - DNA, 308 bp, Homo sapiens
  misc_feature (250)..(250): n is a, c, g, or t
  misc_feature (259)..(259): n is a, c, g, or t
  misc_feature (284)..(284): n is a, c, g, or t
gccggcccgccgccggagccggccgagcttagagaagcgcccggagccaggcgcgcggggccgccagcgaggacctcccccgtctcctccccgaggccgccgcagccccctgctctccttaagggtctttcccagatgtgaaggtccctcccaggctctactgaggtcagaccaattcccagtggcttgggtaccctcgttcactccagcaccagcccctgccctccttcttcccgggccaagcaggggnctgtccatngaagaacgctccttggagttgcagnctggaggggcgagccccggcagcc

SEQ ID NO: 728314 - DNA, 535 bp, Homo sapiens
attggtttcagtgtgactttcatttctctgatgattcactgttttctttcactttcttgagccataccagctcatctttcatctcttcctgttctcttgccatattttttcaaagctctttgtctttgctttaagattttttttttttggaggaattgttttattgagtggtgttaaattgtgacagtatccttggtcataatttttatttgctctgtggcaacatttttctgctgagttttctttcactgccatgtgtcccctacctttgctctctgctgattattacttatatttgaatatcttgagttcttcttggactagctatttgctagtccagatatacaaaagggaaaggtcacaatcatgtccccgaccagcaggaaataacccaatttacttaagactcagggttacatgttgagttactttaggttttattagtacacataaacagagatcagaaactttaggggtgcttggagtgtagagtgctgtgcccatagtctttttttgaaaatacagtgcacctgta

SEQ ID NO: 728315 - DNA, 711 bp, Homo sapiens
taaagtaaatttgagacattatgtcatttcataactccatatgcatttaaaaagtaaggacattttcttatacaactatatgccatcatcatctctaacaaaatcattaacaaattattgataccatctaacagccagtctatgttcaaatttccctggtaaatttggcttcttaaccttatcatcacataaaaaggggttcttcctgttttttaaaaaagctataaagtatttttttaatctcaccagaggctttgatggcagaatttttttttctacctgttaatttggcaagagagtttcctttatgcaggagcacagattattaatcttgggtctgaattctagctgtgtttctgcttctaatttacgtatccttaggggactcattcaaccctcctcagcttcccacctgcatcctccttcggcctaataactgtatacgttaagctaccagcctgctggattcatgagggcatttgcaatgtgaaatggcccttcctgtgtgttttccacggccatcttctgggtagggaggctgaagactacttcagggtctggaggaaggagctgtgtaccaggtaaaggtggcactgagccggcaggggaagggagcagagatgaggcagagaagcgaccagaggcaaaattggaggatctcaggccagactccatccccatctctttcattaaaaatacaaaccaaacaaa

SEQ ID NO: 728316 - DNA, 849 bp, Homo sapiens
ggcgggcagatcatgagttcaggagatcgagaccatcctggccaacatggtgaaaccctgtctctactaaaaatacaaaaattagccgggtgtggtggcgcgtgcctgtgatcctagctacttaggagactgaggcaggagaatggcttgaacctgggaggcggaggctgcagtgagccgagattgcgcctctgcactccagcctgggcgacagagcaagtgtctgtctcaaaaacaaaacaaaacaaaacaaaaaacagtggagctaggactggaaaccaggtctcccaaatccaagtccagattaaaccaagctgctactttttcagccttctttgaatttttcagttttgtgttatattacctgagttgtattgcaaggaacagaaaccaactctagctgacttagccaaagggaagtgaatggaaggatggaggaagtttgcagaatcaaaggaaaagccaaaatgtcagaaatcagaagaatgtcacaaatctggataggaaaaaccaagggatagcaaggctccattgtcacgatggttgatgtgggctgtaaacgtaggccatccctgaacactctcaccactcagatcccgggaaggagtcggctctgctgggcacgtgactctgctcggccagcccctggtcgggaagatggggcctctgaattgagactcacaaaagaaaacatggaaccagaggaaatggtttctcagagaaagccagcaccaaaagaagggaaagtgagatgttgccaggcaaaaaaaaaagatgtcatggataaggaaactacatttttccaactgaaaattggggtagaagcacgtgtaataccattgcttgttc

SEQ ID NO: 728317 - DNA, 810 bp, Homo sapiens
cgaggagtgccgaccagagaggcagttcatgtagcctcattagtaaagcccccaggggctgtgactgtcctgcgcgggcttccaagtccacctgagagttctgatgctgtgctgaccccatggcacatcaggggcagcgagcctgctgtccacactggctgggagaagcagcagccaggcaagagaacaacaaacaggggcaggcagccacccaccaagaggacatgtggaaccaggcagcacgccatttggaaagcaagtctatatgggagtggtcactatcatggaaaggaaaaagaatgggaaaacctgagatttaagaaagacccaatgctgttctagaagcatcttcagaaagagcaataaagcttctttggggaagtcacaggacacagactctccagggtggaagggatcttgaagagcacagaggccaagtcctcatccatctctcgacttccttcatgactcatctgaagacggctggattggtctatgtctgtaccctaccctcaccccacaatcccagtccaccctatctcagaacaatttcaaatgcaggggaggatcagagatgaagatgttactccaaaagtatacatgcaaagatgttctggaagtgctacttcttaacttgtctggtcttatagtctgtggttgaagtgagtttctccacttctagaacgctttaggtcttgtttcctgtcctctttgaaaagttttattaataattacgtgctgcccttctattactcctactttccataccctggaaagtatacacggttctagaatattccattaggaggg

SEQ ID NO: 728318 - DNA, 906 bp, Homo sapiens
cgaggagtgccgaccagagaggcagttcatgtagcctcattagtaaagcccccaggggctgtgactgtcctgcgcgggcttccaagtccacctgagagttctgatgctgtgctgaccccatggcacatcaggggcagcgagcctgctgtccacactggctgggagaagcagcagccaggcaagagaacaacaaacaggggcaggcagccacccaccaagaggacatgtggaaccaggcagcacgccatttggaaagcaagtctatatgggagtggtcactatcatggaaaggaaaaagaatgggaaaacctgagatttaagaaagacccaatgctgttctagaagcatcttcagaaagagcaataaagcttctttggggaagtcacaggacacagactctccagggtggaagggatcttgaagagcacagaggccaagtcctcatccatctctcgacttccttcatgactcatctgaagacggctggattggtctatgtctgtaccctaccctcaccccacaatcccagtccaccctatctcagaacaatttcaaatgcaggggaggatcagagatgaagatgttactccaaaagtatacatgcaaagatgttctggaagtgctacttcttaacttgtctggtcttatagtctgtggttgaaagagtcctccatggagaagtctactgccgaagtccactgattttcactgccgtatgatattccatcgtgtggcacgtggaacaatcaggatcatatttcaacatgagatccccacgttgatgtctcagtcttgggtagacatggtagggctggtaggaagtggtctaatgacttccattcctctgttggaacatttgggttgcttttgggtgttttgttattaaaaacactgctgctgctatca

SEQ ID NO: 728319 - DNA, 144 bp, Homo sapiens
  misc_feature (117)..(117): n is a, c, g, or t
  misc_feature (119)..(119): n is a, c, g, or t
agcatgccatgccaggcacagggactcaggagcacaagagctcttgctagttgactttcccaggaccagaggtaggggaacctccagatgttgccgaggcccacagagaagccaatntnggccaggatgtactgcagcttactg

SEQ ID NO: 728320 - DNA, 470 bp, Homo sapiens; identical to SEQ ID NO: 163192

SEQ ID NO: 728321 - DNA, 278 bp, Homo sapiens
aaattccatggaattatagttggtctactctgcaatgtctctatttaaaagcccaagtgaggacagacaagatgaacgtagaacatgagagatatctgcaagccaacaacaaagaattcaacagtatttttggatatccgaaaaggcatcaaagtgacgatcgagtcaacaaccagcctgttctgctactggtgaatggcaagataaaggaggacaaatggatgaatgttcaagtgggagatataataaaactagaaaataatcagcctgtcatggtg

SEQ ID NO: 728322 - DNA, 354 bp, Homo sapiens
actaatcaaacatgacgctgccatcgtaaggggtggctgagagtttctgtttatgaacgtgggacagtaagtggggcacggagcgggggtgcagggaggtgccagctggtgatcattgtgcagaaagctgaagaatgtggcttaacaagattctgactcctcccagtttattacctagcatggatttccttcaaaatacagatttcgtgtgaaaagtccaactgccacaaactgcttgggaagggtggatgctgacaggcagggcttttgtgaaagacgggaatgaaccctgacctgtcgctaataggagttgtgccaaactcatcacatacattaaaaaatagaaaaggattt

SEQ ID NO: 728323 - DNA, 590 bp, Homo sapiens
cacatatttatatgtatttttaaagataaagaatatctaaaatgtgtttttttcttagctttttagttgtctagaacatttagagaaagagtatgaatatattaaatccacaaacacactatatacttcctcaccactgactattttatcaaatttgccttaaaataatgaaaaagaaaagtatagttaatggtttcaaatatgctaagaaattgactctgcggaggggatcttaaaatgcctgtttactcatgttttcgtatttttcttgtctctaatacttttgtctttgtctgccttgtgtgttcttttctgaatttcatttcagcaatttatgctgctaaatagaatcccgcatgtctgcattcatttacattcaacttattgtaaattttgagattttatttagaaatgaattgtctaattaatttatgtagagtccttttttccaaagagctcaaaacactacatccacattattgacttttggaaaccaaccaaattacttaagaaatggaaaagtagtcacagagaaatttagtaatttgcaaaagccacaacagtagtggaagaattaaaattcataaagt

SEQ ID NO: 728324 - DNA, 562 bp, Homo sapiens
aaagcaaaggtttgtttagagacataaaaagtgaaacatattatctccattgcactcaatagggtaagctttattgaaattcactttataatgtattatctttaaaacaaagtctaactgtaatgcatacacacagtattcctaacgtatttgtagcttcatgtcattaaggaattttgcatattccttaaaaatggaagaaaaaggcattagaaaggtgttaccttacgctctgtcttgaactaactaaactatttaagtaacaaaaatatttatgtgttaggaggagcatgccagagactcatatctggataatttttctttagcttgtcattttttcttatttgccatgagagtatgatgacaataaaaaattcccaaccctggtcactaaagtaattaaagactatattctaactgacaactgtatttctttattgcagaataaatcattcggaagtaaatttggtaaccttattgtttaaaaaactttgttttcatgctctaaacttaggataaattatattgtgtcactgaaaaacttactttctatgtttctgta

SEQ ID NO: 728325 - DNA, 662 bp, Homo sapiens
gatgtggaaatattactgcatatacaccacatatgtgcagaatttaaaggttaaacatttctatctcctattaaaatgttatgtaattaaatgctgaaatttaaaaagctgatttttgtttaaaatacacatgttctaaatttagaaattctaaaataaaatgttactacctcattagtatttttcaatttaaattaattttttggtgctttttagcttttaggttcagggatacatgtttaagtttgttacatatgtgactttcaaactctaacttcaggaagtcattacttccagtaggttatgttctggtcattcattcctctatcactattaccacccacagagctcatatgagctatgctggccctcaacatttctgatggaagagaataaatacacggttttgttgctctcttttacaaaatcaaatgttactttacactagaccaatgtttcctaagcctaactgtgtaccacaaagcacacttggagagatttttagtttgtttcgtttgtttgttaactgtaaatttccagattctatttcaaatctaatgaaaaggaatctctatatgtggaattcagggagatatatatatatatatatatatatatatttttttttttttaagcacgtcttctagtgtttctaatgccac

SEQ ID NO: 728326 - DNA, 2824 bp, Homo sapiens; identical to SEQ ID NO: 288696

SEQ ID NO: 728327 - DNA, 656 bp, Homo sapiens
ctttttagtatactataattcgtatgtcatcaatatcagttaaataaacagatataaatagcctaactgctctctcagagctgcagttattacctaatgctatcccagaatgagttagaatatgcaggtcctctgcttttgtagagtcctgtgatatagccccagaccaggagttagaagatctggctctgccttaactaacaatgggcaggttgcttcagctctctagtcttcagtttcctcccctgtaaaattagagagggctggacataattatctgcaaggtcactttcactttctatgatcattcaagacaagcattaagatgcaaggacaaaatgtgctcattgtaagcctgcctgtcctatagacaaaggcattctcagtacactaaacacttgttaagagtgttgttaagagccagagtgagtatcatgtaagacacagaccctttcttcctaaaggctttgtggcatcagacacataaagggtatatgtagtgtggagcactaaccatggcagggtaatttattccaggcacagagtcataattctggaaacatctagactcactgcattaacagagcattttgtttctaaagtagacctcttatgtcatccagatttcactcattctgaccacagccaggaagctg

SEQ ID NO: 728328 - DNA, 574 bp, Homo sapiens
aggacctgcatggtggggtgggccctctcctggctctgtggaggagggaaaaggcttatggagctggaggccccgtctcccagccccactcagcccacagaggcaggagaaacccacttgcccctgatagctgctgctgctgctgtgagccaccgcactactgccttgttcccagcctgtgtgtgcagattcttttctggcacaatgccttacatgttttatttgtaacagaagtgggggatcaaatgcaaaaaagaaaactgctctccataagaatgtcatccagacttcacctttctccatccagcaagcaataatgatgatgatggtgattattgtctcattactcacttgtaacacatctggaatctattccagtatacaggatgaaatagggatcctagccatactttcccctcattggttgggggccccagtgagtagcctcctcctccaatggtgtaaaatgctactttccccataatgtcagtgcttataaggaacacatctgggactatttctggactttctattctgtctcatccacagtgggatgctaggacctgtgcacact

SEQ ID NO: 728329 - DNA, 666 bp, Homo sapiens
agggggatggcttgagcctgggaggttgaggctgcagtaaaccgagattacgccactgtactctagcctaggtaacaaagtgagaccatgtctccaagaaaaaaataaaagaaaacaaaaaaacttgaatccgtaatttaaagatcttcccatgaagaaaataccaggtctagatggttttgcagaagttcaagtaagggtaactctttaaaaaaaattattattattattttttttagaaatggagttttgctgtattgcccaggctagtctcaaactcttgggctcaagagatcttcctgccttagtctcttgagtaactgggactataggcatacagcactgtgcctggttagtaattctaattttataaaaactctctctgagaatggaaaaaatgaaaacattaactctttccatgaggccagtgtaaccttaatatctaaacaagacaagtacaggaagagaaagcaatattagaggccagtttcactcatgactataaatgcaacagttataagaaaaatactggtaaatcaaatccggcagtgtaaaaaccaaaaggcatcacattctagttgggtttatctcaggtttgcaaggatggtttaacaacgaagaaatgtctataaacattatttattatgttggtaatagtagactttg

SEQ ID NO: 728330 - DNA, 1267 bp, Homo sapiens
ccctgggatactcccctcccagggtgtctggtggcaggcctgtgcctatccctgctgtccccagggtgggccccgggggtcaggagctccagaagggccagctgggcatattctgagattggccatcagcccccatttctgctgcaaacctggtcagagccagtgttccctccatgggacctaaagacagtgccaagtgcctgcaccgtggaccacagccgagccactgggcagccggtgatggtcccacgcaggagcgctgtggaccccgctctctgggcagccctgtcctaggcctggacacctgcagagcctgggaccacgtggatgggcagatcctgggccagctgcggcccctgacagaggaggaagaggaggagggcgccggggccaccttgtccagggggcctgccttccccggcatgggctctgaggagttgcgtctggcctccttctatgactggccgctgactgctgaggtgccacccgagctgctggctgctgccggcttcttccacacaggccatcaggacaaggtgaggtgcttcttctgctatgggggcctgcagagctggaagcgcggggacgacccctggacggagcatgccaagtggttccccagctgtcagttcctgctccggtcaaaaggaagagactttgtccacagtgtgcaggagactcactcccagctgctgggctcctgggacccgtgggaagaaccggaagacgcagcccctgtggccccctccgtccctgcctctgggtaccctgagctgcccacacccaggagagaggtccagtctgaaagtgcccaggagccaggagccagggatgtggaggcgcagctgcggcggctgcaggaggagaggacgtgcaaggtgtgcctggaccgcgccgtgtccatcgtctttgtgccgtgcggccacctggtctgtgctgagtgtgcccccggcctgcagctgtgccccatctgcagagcccccgtccgcagccgcgtgcgcaccttcctgtcctaggccaggtgccatggccggccaggtgggctgcagagtgggctccctgcccctctctgcctgttctggactgtgttctgggcctgctgaggatggcagagctggtgtccatccagcactgaccagccctgattccccgaccaccgcccagggtggagaaggaggcccttgcttggcgtgggggatggcttaactgtacctgtttggatgcttctgaatagaaataaagtgggttttccctggaggtacccagc

SEQ ID NO: 728331 - DNA, 1319 bp, Homo sapiens
ccctgggatactcccctcccagggtgtctggtggcaggcctgtgcctatccctgctgtccccagggtgggccccgggggtcaggagctccagaagggccagctgggcatattctgagattggccatcagcccccatttctgctgcaaacctggtcagagccagtgttccctccatgggacctaaagacagtgccaagtgcctgcaccgtggaccacagccgagccactgggcagccggtgatggtcccacgcaggagcgctgtggaccccgctctctgggcagccctgtcctaggcctggacacctgcagagcctgggaccacgtggatgggcagatcctgggccagctgcggcccctgacagaggaggaagaggaggagggcgccggggccaccttgtccagggggcctgccttccccggcatgggctctgaggagttgcgtctggcctccttctatgactggccgctgactgctgaggtgccacccgagctgctggctgctgccggcttcttccacacaggccatcaggacaaggtgaggtgcttcttctgctatgggggcctgcagagctggaagcgcggggacgacccctggacggagcatgccaagtggttccccagctgtcagttcctgctccggtcaaaaggaagagactttgtccacagtgtgcaggagactcactcccagctgctgggctcctgggacccgtgggaagaaccggaagacgcagcccctgtggccccctccgtccctgcctctgggtaccctgagctgcccacacccaggagagaggtccagtctgaaagtgcccaggagccaggaggggtcagtccagccgaggcccagagggcgtggtgggttcttgagcccccgagccagggatgtggaggcgcagctgcggcggctgcaggaggagaggacgtgcaaggtgtgcctggaccgcgccgtgtccatcgtctttgtgccgtgcggccacctggtctgtgctgagtgtgcccccggcctgcagctgtgccccatctgcagagcccccgtccgcagccgcgtgcgcaccttcctgtcctaggccaggtgccatggccggccaggtgggctgcagagtgggctccctgcccctctctgcctgttctggactgtgttctgggcctgctgaggatggcagagctggtgtccatccagcactgaccagccctgattccccgaccaccgcccagggtggagaaggaggcccttgcttggcgtgggggatggcttaactgtacctgtttggatgcttctgaatagaaataaagtgggttttccctggaggtacccagc

SEQ ID NO: 728332 - DNA, 832 bp, Homo sapiens
tgcctctcccatgggactaccctgaagccccatggaggcgtctccacagcagccctcctcgcccatgcccacgggcactgcagggtggcgggaggagggggcccaaccctgacccccggggatccaagggcttgaagcagacagtgggggccctgaaccccaacctacatctctggggcatctgcagctgtcagttcctgctccggtcaaaaggaagagactttgtccacagtgtgcaggagactcactcccagctgctgggctcctgggacccgtgggaagaaccggaagacgcagcccctgtggccccctccgtccctgcctctgggtaccctgagctgcccacacccaggagagaggtccagtctgaaagtgcccaggagccaggagccagggatgtggaggcgcagctgcggcggctgcaggaggagaggacgtgcaaggtgtgcctggaccgcgccgtgtccatcgtctttgtgccgtgcggccacctggtctgtgctgagtgtgcccccggcctgcagctgtgccccatctgcagagcccccgtccgcagccgcgtgcgcaccttcctgtcctaggccaggtgccatggccggccaggtgggctgcagagtgggctccctgcccctctctgcctgttctggactgtgttctgggcctgctgaggatggcagagctggtgtccatccagcactgaccagccctgattccccgaccaccgcccagggtggagaaggaggcccttgcttggcgtgggggatggcttaactgtacctgtttggatgcttctgaatagaaataaagtgggttttccctggaggtacccagc

SEQ ID NO: 728333 - DNA, 650 bp, Homo sapiens
cggacgcgtgggtagatcgcgatctagaactagagagactttgtccacagtgtgcaggagactcactcccagctgctgggctcctgggacccgtgggaagaaccggaagacgcagcccctgtggccccctccgtccctgcctctgggtaccctgagctgcccacacccaggagagaggtccagtctgaaagtgcccaggagccaggagccagggatgtggaggcgcagctgcggcggctgcaggaggagaggacgtgcaaggtgtgcctggaccgcgccgtgtccatcgtctttgtgccgtgcggccacctggtctgtgctgagtgtgcccccggcctgcagctgtgccccatctgcagagcccccgtccgcagccgcgtgcgcaccttcctgtcctaggccaggtgccatggccggccaggtgggctgcagagtgggctccctgcccctctctgcctgttctggactgtgttctgggcctgctgaggatggcagagctggtgtccatccagcactgaccagccctgattccccgaccaccgcccagggtggagaaggaggcccttgcttggcgtgggggatggcttaactgtacctgtttggatgcttctgaatagaaataaagtgggttttccctggaggtacccagc

SEQ ID NO: 728334 - DNA, 884 bp, Homo sapiens
tgcctctcccatgggactaccctgaagccccatggaggcgtctccacagcagccctcctcgcccatgcccacgggcactgcagggtggcgggaggagggggcccaaccctgacccccggggatccaagggcttgaagcagacagtgggggccctgaaccccaacctacatctctggggcatctgcagctgtcagttcctgctccggtcaaaaggaagagactttgtccacagtgtgcaggagactcactcccagctgctgggctcctgggacccgtgggaagaaccggaagacgcagcccctgtggccccctccgtccctgcctctgggtaccctgagctgcccacacccaggagagaggtccagtctgaaagtgcccaggagccaggaggggtcagtccagccgaggcccagagggcgtggtgggttcttgagcccccgagccagggatgtggaggcgcagctgcggcggctgcaggaggagaggacgtgcaaggtgtgcctggaccgcgccgtgtccatcgtctttgtgccgtgcggccacctggtctgtgctgagtgtgcccccggcctgcagctgtgccccatctgcagagcccccgtccgcagccgcgtgcgcaccttcctgtcctaggccaggtgccatggccggccaggtgggctgcagagtgggctccctgcccctctctgcctgttctggactgtgttctgggcctgctgaggatggcagagctggtgtccatccagcactgaccagccctgattccccgaccaccgcccagggtggagaaggaggcccttgcttggcgtgggggatggcttaactgtacctgtttggatgcttctgaatagaaataaagtgggttttccctggaggtacccagc

SEQ ID NO: 728335 - DNA, 702 bp, Homo sapiens
cggacgcgtgggtagatcgcgatctagaactagagagactttgtccacagtgtgcaggagactcactcccagctgctgggctcctgggacccgtgggaagaaccggaagacgcagcccctgtggccccctccgtccctgcctctgggtaccctgagctgcccacacccaggagagaggtccagtctgaaagtgcccaggagccaggaggggtcagtccagccgaggcccagagggcgtggtgggttcttgagcccccgagccagggatgtggaggcgcagctgcggcggctgcaggaggagaggacgtgcaaggtgtgcctggaccgcgccgtgtccatcgtctttgtgccgtgcggccacctggtctgtgctgagtgtgcccccggcctgcagctgtgccccatctgcagagcccccgtccgcagccgcgtgcgcaccttcctgtcctaggccaggtgccatggccggccaggtgggctgcagagtgggctccctgcccctctctgcctgttctggactgtgttctgggcctgctgaggatggcagagctggtgtccatccagcactgaccagccctgattccccgaccaccgcccagggtggagaaggaggcccttgcttggcgtgggggatggcttaactgtacctgtttggatgcttctgaatagaaataaagtgggttttccctggaggtacccagc

SEQ ID NO: 728336 - DNA, 685 bp, Homo sapiens
tttttttgtagagacgaggtttcaccatgttgaccaggctgatctcaaacatctgacctcaggaagtcagaggcaccaatgtgaggttccacctgctttccagcacattcttggtttcctcacttctgctagacaacgtttgatcagaaggaacagggaacgagaaggagctgctggatgacaataagcctgggaaagggaggctgggtgagcagagacagaaaagaaacacctacctgctgtgacctcacaaacacccaggctgagttttgataagacaggttgaatcacactggggtgacagcctcatccctccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtcca

SEQ ID NO: 728337 - DNA, 357 bp, Homo sapiens; identical to SEQ ID NO: 57922

SEQ ID NO: 728338 - DNA, 357 bp, Homo sapiens
gtgggttggtttatttttgttcacgggtgttcatgtgcattcccaaacaaaatgagggtgaagagagaggaagtgtggaaaagataatggctttcagatttccacagcaccttttgcctggaccacttttcagcatttagtggtggggtttcagtttctaatacacagagcaatcacccaggcttttcccacagctaaggctttgagagatgaagtgacgtccaagcacagtatataatcaagtggtcaaggctgacacatggagtaaagctgtgattcagtctttccacctaaaattgtatgacccaactctccaacttaaatagacctttgaatatatctccagagaataagtga

SEQ ID NO: 728339 - DNA, 1461 bp, Homo sapiens
cgggatacgggtgtacacagcagcggcgtcgcggcccgcagccccgcggcggcggaaaggtaaccgacccgccctggggtgctgcgtgcgctgcctgctcccgcctgaggaaaacactgcccatggcgcaaggccgggagcgcgacgaaggcccccactccgccggcggcgcgtccttgtccgtgagatgggtgcaaggattccctaagcagaatgttcattttgtcaacgacaacaccatttgctacccttgtgggaattatgtaatatttattaatattgaaaccaagaaaaagactgtactgcagtgtagtaatggaattgtgggcgtcatggcaactaacatcccctgtgaagttgtggctttttctgaccggaagctaaaacctctcatctacgtatacagctttccaggattgaccagaaggaccaaattgaaaggcaacattctcctggactacactttactttcattcagttactgtggcacctacctggctagttactcctctctcccagaatttgaactggccctttggaactgggaatcgagtatcattttgtgtaagaaatcacagcctggaatggatgtgaaccaaatgtcttttaaccccatgaactggcgccagctgtgcttatcaagtccaagtacagtgagcgtgtggaccattgaaagaagtaaccaggagcattgtttcagagcaaggtcggtgaaattacctctagaagatgggtcattttttaatgaaacggatgtcgttttcccccagtcgttgccgaaagatctcatctatggtcccgtgctgccactgtcagccattgccgggctggtaggcaaagaggcagagactttccggccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattggaagacagaagaaattttatcagtccagtaaccttggtatatcagaaggagggcgtgctggcttctggaattgatggctttgtgtattcttttattattaaagatagaagttacatgatcgaggattttcttgagattgaaagacctgtagaacatatgacattttctcccaattatacagtgttgctgattcaaacagacaaggtatgttggatggtaatttcttgatatgtgattttcagatagtattattatcatcattacatgacaggaatgaggagcagagtatgctgcacagtggtactctacttgtcaagactctaggttgtaaatgaaaaaatacccaatttaaaaggcctaaattacaaagagctattggtttatttttgtgcatgtaactgaaagggcaaggagtgaatctgaataaaagagctatcatgatgcc

SEQ ID NO: 728340 - DNA, 2938 bp, Homo sapiens
  misc_feature (1704)..(1704): n is a, c, g, or t
  misc_feature (2438)..(2438): n is a, c, g, or t
cgggatacgggtgtacacagcagcggcgtcgcggcccgcagccccgcggcggcggaaaggtaaccgacccgccctggggtgctgcgtgcgctgcctgctcccgcctgaggaaaacactgcccatggcgcaaggccgggagcgcgacgaaggcccccactccgccggcggcgcgtccttgtccgtgagatgggtgcaaggattccctaagcagaatgttcattttgtcaacgacaacaccatttgctacccttgtgggaattatgtaatatttattaatattgaaaccaagaaaaagactgtactgcagtgtagtaatggaattgtgggcgtcatggcaactaacatcccctgtgaagttgtggctttttctgaccggaagctaaaacctctcatctacgtatacagctttccaggattgaccagaaggaccaaattgaaaggcaacattctcctggactacactttactttcattcagttactgtggcacctacctggctagttactcctctctcccagaatttgaactggccctttggaactgggaatcgagtatcattttgtgtaagaaatcacagcctggaatggatgtgaaccaaatgtcttttaaccccatgaactggcgccagctgtgcttatcaagtccaagtacagtgagcgtgtggaccattgaaagaagtaaccaggagcattgtttcagagcaaggtcggtgaaattacctctagaagatgggtcattttttaatgaaacggatgtcgttttcccccagtcgttgccgaaagatctcatctatggtcccgtgctgccactgtcagccattgccgggctggtaggcaaagaggcagagactttccggccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattggaagacagaagaaattttatcagtccagtaaccttggtatatcagaaggagggcgtgctggcttctggaattgatggctttgtgtattcttttattattaaagatagaagttacatgatcgaggattttcttgagattgaaagacctgtagaacatatgacattttctcccaattatacagtgttgctgattcaaacagacaagggatctgtttatatctacacttttggtaaggagccaaccttaaataaagtcctagatgcttgtgatgggaaatttcaggcaattgactttatcacacctggaacccaatacttcatgacacttacatattcaggggaaatttgtgtttggtggctggaggattgtgcttgtgtaagcaagatttatctgaataccctagcaacggttctggcttgctgtccatcctccctctctgcagccgtgggcacggaggatggctcggtctacttcatcagcgtatatgataaggaatcccctcaggtcgtgcacaaggcctttctctcggaatcgtccgtgcagcacgtcgtgtaagtcctttctgcctccaggagcggctccgtgtcacacccgtctgttgaaaattctagtgaagccatcctttcttttaattttaagttttacgtgtttcatttgttttgaatgttaatatattcacacagttcancactcaaaaggtacagagggctgtgtagtaaagtaccccccatacccaggtctgtccttgcaggcagcctggtaccaatttctcatgtctctcctgagatgttttatccatgaacaagcaaaacataataagcacttctttttacttgtatcaatggccatcatgtgtgtatagtgtgccaggcacttctgctgtattaactccatgaggtaaacactcttgttgtctctatttgacaggtgaggaagataaggcacaaggattttaaataacttgctcaatagtacacagatagtgaatggcaaatgttgggatttgaacccaggtagttgggctgcagagtcactgcctttgctcttaaaaggagaaaactatgtacaatgcctcatttcttttttcacttaatcgtatatcttggagaatgttttatatccacacataaagaccagcctgattatttgtatagccacatagtattccattatatgaatatactatcattttttaaaaacggtatattaatgaacatttagagtatttcaaaacttttgaagcaatacttttaagatgataatatagagacattagatttggacttgtaggtgctatcattattactgtttctttttaatttattatattattaggtattaataagaacagacatttgtattctgctttacagcttgagatcactgtagcttgtggcatgtgatcctcaaaacaccagtcanaaaggtgttattcttatccctattagacaaattagggaattcagggttagagaggtgaggaaaagcattgtccaagattacacattacacagctagcacactgaggagctggccctgccactgtggactgcccagctccaccaccctagctcagtggggaaggatggataacctccttccatttaccccctgcctttctgcactgtcatttttttgtgcctttcctttctcagatcctcttattctaatttacatcttcccactttttctaatttgataaagttgtagacatgtttcactacattcttcctcccactgccaggtaccagacacagggtaatgaaatgtcacacccaccactaatttgagaattgcttatttgcgcttgaaacatcaagaaagctctaccgacagacatgtttcattcacttatgatgaaccaactgcccatctttactgaatcttcttgactgtatttattaaagttgcaatttggaaat

SEQ ID NO: 728341 - DNA, 1688 bp, Homo sapiens
cgggatacgggtgtacacagcagcggcgtcgcggcccgcagccccgcggcggcggaaaggtaaccgacccgccctggggtgctgcgtgcgctgcctgctcccgcctgaggaaaacactgcccatggcgcaaggccgggagcgcgacgaaggcccccactccgccggcggcgcgtccttgtccgtgagatgggtgcaaggattccctaagcagaatgttcattttgtcaacgacaacaccatttgctacccttgtgggaattatgtaatatttattaatattgaaaccaagaaaaagactgtactgcagtgtagtaatggaattgtgggcgtcatggcaactaacatcccctgtgaagttgtggctttttctgaccggaagctaaaacctctcatctacgtatacagctttccaggattgaccagaaggaccaaattgaaaggcaacattctcctggactacactttactttcattcagttactgtggcacctacctggctagttactcctctctcccagaatttgaactggccctttggaactgggaatcgagtatcattttgtgtaagaaatcacagcctggaatggatgtgaaccaaatgtcttttaaccccatgaactggcgccagctgtgcttatcaagtccaagtacagtgagcgtgtggaccattgaaagaagtaaccaggagcattgtttcagagcaaggtcggtgaaattacctctagaagatgggtcattttttaatgaaacggatgtcgttttcccccagtcgttgccgaaagatctcatctatggtcccgtgctgccactgtcagccattgccgggctggtaggcaaagaggcagagactttccggccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattggaagacagaagaaattttatcagtccagtaaccttggtatatcagaaggagggcgtgctggcttctggaattgatggctttgtgtattcttttattattaaagatagaagttacatgatcgaggattttcttgagattgaaagacctgtagaacatatgacattttctcccaattatacagtgttgctgattcaaacagacaagggatctgtttatatctacacttttggtaaggagccaaccttaaataaagtcctagatgcttgtgatgggaaatttcaggcaattgactttatcacacctggaacccaatacttcatgacacttacatattcaggggaaatttgtgtttggtggctggaggattgtgcttgtgtaagcaagatttatctgaataccctagcaacggttctggcttgctgtccatcctccctctctgcagccgtgggcacggaggatggctcggtctacttcatcagcgtatatgataaggaatcccctcaggtcgtgcacaaggcctttctctcggaatcgtccgtgcagcacgtcgtttatgatcagcaaggaatatttctgttagttggaacagcagaaggaaaagtctttattatcaatgccaactcctcaagctcatttcagattattggattcacaggtacaacatagaatgct

SEQ ID NO: 728342 - DNA, 284 bp, Homo sapiens
aacagcctgggcccagggctccggatccctctctctgccaccacaacctccagccaaggtttttaaacactcgaggaagtgcctggctaagaggggacaggaaaaaaggaagaactggtgattttccaaggaaaacagggccaaaggcaaagaagaaagagaagtcctggaagctctgaagagaacaggtcctgcctgagtcccgatccccatataggatcttggaaacagcaagcagatgaccccaactgggattcctatgctaccactatgaggactgcatt

SEQ ID NO: 728343 - DNA, 106 bp, Homo sapiens
aacagcctgggcccagggctccggatccctctctctgccaccacaacctccagccaacagatgaccccaactgggattcctatgctaccactatgaggactgcatt

SEQ ID NO: 728344 - DNA, 546 bp, Homo sapiens
ttcggcacaggcgggccagcagcgattggaatttcaaatgccttggaaagaggaatcagaatttacaaagcaggataaggctgccagagtcattcagcaggcctggaaaagtttccttaatgtcgctatatttcaacactttaaaagtctgattgatttaagaagacaaggagaaccacgtcagatagtgaaatatattaatcccaaagaggttaaatttccacctgatatatactataagatttttactcacagacctattgaagatctctgtgctaacagccctagaaattatgcaaaacttccagcaaagcatacatctcataataaaaatgatcatcttcaggaagaggatcatagtggctggtatcatcgtatagaaaacaatggctggaggccagtttctgatacattttggctatctactgatggtatggtggtggaagacaaaaaggaaagtgaattccatttctctaaactgaagagaaggcaagatttggaaaagaaaagaaaacttagaaaaatagagtggatgaggcaaatgta

SEQ ID NO: 728345 - DNA, 827 bp, Homo sapiens
tgcgcgtccgctcccgccgttgcgacggacgggtaggggaggcgaccccggcgttctgctccgcactgtggaggaggtggggaggtgttgggccagggctgaggtaggagggagtctgtccctcgacgcctcctgcgacgccagcccctgagcgatgatgcgaacgtgcgtcctactctccgcggtgctctggtgcctcacaggagacaaaatatatgtagagttacatcaaaatagtccagtccttatctgtatggattttaagctttctaaaaaagaaatagtggaccccacctacttatggattgggcctaatgaaaagacgttaacaggaaataatagaataaatataactgaaactggacagctgatggtgaaagattttttggagcctttgtctggactttacacatgtactctttcttataagactgttaaagcagaaactcaagaagaaaaaacagtcaaaaagagatatgactttatggtctttgcctatcgggaacctgattattcatatcagatggctgtacgttttaccacaaggtcttgtatagggagatacaatgatgtattctttagagtgctgaagaaaatcttggatagtctaatttctgatttgtcatgccatgtcatagagccatcatataaatgccattctgttgaaattccagaacatggcctcatacatgagctatttatagcatttcaagttaatccttttgcgccggggtggaaaggtgcttgcaatggatctgttgactgtgaagataccactaatcataatatcctccaggtgagaatttcatggtaaggaagaagtattt

SEQ ID NO: 728346 - DNA, 893 bp, Homo sapiens
tgcgcgtccgctcccgccgttgcgacggacgggtaggggaggcgaccccggcgttctgctccgcactgtggaggaggtggggaggtgttgggccagggctgaggtaggagggagtctgtccctcgacgcctcctgcgacgccagcccctgagcgatgatgcgaacgtgcgtcctactctccgcggtgctctggtgcctcacaggagtccaatgcccgcgttttaccttattcaataagaagggcttcatttatggcaagacaggacagccagacaaaatatatgtagagttacatcaaaatagtccagtccttatctgtatggattttaagctttctaaaaaagaaatagtggaccccacctacttatggattgggcctaatgaaaagacgttaacaggaaataatagaataaatataactgaaactggacagctgatggtgaaagattttttggagcctttgtctggactttacacatgtactctttcttataagactgttaaagcagaaactcaagaagaaaaaacagtcaaaaagagatatgactttatggtctttgcctatcgggaacctgattattcatatcagatggctgtacgttttaccacaaggtcttgtatagggagatacaatgatgtattctttagagtgctgaagaaaatcttggatagtctaatttctgatttgtcatgccatgtcatagagccatcatataaatgccattctgttgaaattccagaacatggcctcatacatgagctatttatagcatttcaagttaatccttttgcgccggggtggaaaggtgcttgcaatggatctgttgactgtgaagataccactaatcataatatcctccaggtgagaatttcatggtaaggaagaagtattt

SEQ ID NO: 728347 - DNA, 438 bp, Homo sapiens
gcaaggtgtgcaactccttcccagtggggaagcgactgttccaagagccagttttggaattgtaggcacaaacacaggagaatgtggtcagtgtttcagccagtgcttgctgctgaggcaggagagaataattgtgtaaagagggggctcccgcagtgcaggacaggaagccaccatgtgagcaccacatccacgtgcaggtcgcaggcttcatcatgtcctgaataccatgccttagcattttatggaaactgaatagtggaagagctgccttttagctggtgttacgcagaaagaaatgcaaaagtgaaaactagcaagatgtatgggaattcagatttctgtggtattttgattacatcatcaaaatgtggccagaaatttatatactaaaaattatgataatatggaaagaaatattaaggtgcaacaatagtt

SEQ ID NO: 728348 - DNA, 535 bp, Homo sapiens
ggggaaagccagctgccatcaggtggggacactagaggagccccagggagctcccatatggcaaggaactgagacctgctgccaacacccaggaccaatttgccatccatgagagtgggccgtctcgaaagtgggagaatgtggtcagtgtttcagccagtgcttgctgctgaggcaggagagaataattgtgtaaagagggggctcccgcagtgcaggacaggaagccaccatgtgagcaccacatccacgtgcaggtcgcaggcttcatcatgtcctgaataccatgccttagcattttatttagatgagatcatgtgactggatccctcatgatgagatgagtgcccccaaaagaagacaccagagagcttgcttctcattccacacgcatgctccaaagaaaggccatggcagagcacagagagaaggagagctcccaccagaacctggcaaagtgtgctgctggcatgcttgtctcataattctgccctccaggactgtgagaaaataagtttctgttgcttaaaccacc

SEQ ID NO: 728349 - DNA, 438 bp, Homo sapiens
ggggaaagccagctgccatcaggtggggacactagaggagccccagggagctcccatatggcaaggaactgagacctgctgccaacacccaggaccaatttgccatccatgagagtgggccgtctcgaaagtgggagaatgtggtcagtgtttcagccagtgcttgctgctgaggcaggagagaataattgtgtaaagagggggctcccgcagtgcaggacaggaagccaccatgtgagcaccacatccacgtgcaggtcgcaggcttcatcatgtcctgaataccatgccttagcattttatgtgagtaatcttagatcattcatcaaagaacaggttatgtttacaaatataatggttttaaggaatattataattcagcatcttgaccactggtactggtacgacatgttataatatactgtgcttttaagtatt

SEQ ID NO: 728350 - DNA, 495 bp, Homo sapiens
ggggaaagccagctgccatcaggtggggacactagaggagccccagggagctcccatatggcaaggaactgagacctgctgccaacacccaggaccaatttgccatccatgagagtgggccgtctcgaaagtgggagaatgtggtcagtgtttcagccagtgcttgctgctgaggcaggagagaataattgtgtaaagagggggctcccgcagtgcaggacaggaagccaccatgtgagcaccacatccacgtgcaggtcgcaggcttcatcatgtcctgaataccatgccttagcattttatggaaactgaatagtggaagagctgccttttagctggtgttacgcagaaagaaatgcaaaagtgaaaactagcaagatgtatgggaattcagatttctgtggtattttgattacatcatcaaaatgtggccagaaatttatatactaaaaattatgataatatggaaagaaatattaaggtgcaacaatagtt

SEQ ID NO: 728351 - DNA, 381 bp, Homo sapiens
gcaaggtgtgcaactccttcccagtggggaagcgactgttccaagagccagttttggaattgtaggcacaaacacaggagaatgtggtcagtgtttcagccagtgcttgctgctgaggcaggagagaataattgtgtaaagagggggctcccgcagtgcaggacaggaagccaccatgtgagcaccacatccacgtgcaggtcgcaggcttcatcatgtcctgaataccatgccttagcattttatgtgagtaatcttagatcattcatcaaagaacaggttatgtttacaaatataatggttttaaggaatattataattcagcatcttgaccactggtactggtacgacatgttataatatactgtgcttttaagtatt

SEQ ID NO: 728352 - DNA, 478 bp, Homo sapiens
gcaaggtgtgcaactccttcccagtggggaagcgactgttccaagagccagttttggaattgtaggcacaaacacaggagaatgtggtcagtgtttcagccagtgcttgctgctgaggcaggagagaataattgtgtaaagagggggctcccgcagtgcaggacaggaagccaccatgtgagcaccacatccacgtgcaggtcgcaggcttcatcatgtcctgaataccatgccttagcattttatttagatgagatcatgtgactggatccctcatgatgagatgagtgcccccaaaagaagacaccagagagcttgcttctcattccacacgcatgctccaaagaaaggccatggcagagcacagagagaaggagagctcccaccagaacctggcaaagtgtgctgctggcatgcttgtctcataattctgccctccaggactgtgagaaaataagtttctgttgcttaaaccacc

SEQ ID NO: 728353 - DNA, 343 bp, Homo sapiens
  misc_feature (293)..(293): n is a, c, g, or t
  misc_feature (326)..(326): n is a, c, g, or t
  misc_feature (337)..(337): n is a, c, g, or t
cccggcagctatccgcggccatccggcggtggtgacgcgagaggctggggtctccagcctttagtctgcctgcgcgttcacatgcacccacttacttcttgaagtctactcctcacaagtaagggctatggtgcggggtgcccgattcctgagaaatctgaagatgtggaagtttattttttcttcccaaaatcagcagtagagggactcaggtgaggagaccaaagtacaacacacagctcttttattgccagtagaaacattaaacatagagagacctgaaccatctctanagatagtccgaactgggatggattttggtgctntttcatggatntgtcca

SEQ ID NO: 728354 - DNA, 800 bp, Homo sapiens
cccggcagctatccgcggccatccggcggtggtgacgcgagaggctggggtctccagcctttagtctgcctgcgcgttcacatgcacccacttacttcttgaagtctactcctcacaagtaagggctatggtgcggggtgcccgattcctgagaaatctgaagatgtggaagtttattttttcttcccaaaatcagcagtagagggactcaggaccaactcctcttcatcttcgtcttcctcagcctgctcaatgtgaagcccctgatcatgattcacttccacttaataaataaagtgtttacaaatcagaataacttttagacaatattaaggtggtaatcatgaacagaaaagattttgtagttcttccatggggaaaacctggaaattctgtaaagctaaaatatagaaatgctcaagaactgcgaatggagaaagtacagttagagtttgagaaccaagagatggagaagaaactgcaagaattccgatccacaagaaacaaagaaaaggaagatagagagtcaagcgagtattactggaaatctggaaaagtgggcaaattggtcaatcaatcatatatgatgtcacaaaataacaggaaatgttgttaagttttctgctggaaaagtgaaattaaaattgctgaaggaacagattcaagagccagtgaaaccaacagtttaattataaatggcaaattcttcagaatgtgaaaaacccaagataaatgggaaagtttgtggacccaggtgagaacaaaaggtggtcttactggaatgcctgaatgtggcgaca

SEQ ID NO: 728355 - DNA, 630 bp, Homo sapiens
agccaccgctctccaaggactctcgagcagctccatctacagattcacatggagaagaattaagggttcctgccaatcaccagcaccactttgccagccttgtaagtgggccaccttggaattggagcctccagttcctactgacatctgactgcaacatcatgagagaccctgagtttgaaccacccagctgagctgcttctgagctaacccactgaaaccgtgaaagtacctgaatgaaacaacacccagtagccactagcacacctagctcccagatctgtttttgatgccattcttcagtaaaaggaagcaaggctgcttggagaaattgctatcaaggactggggtagaaaatatacaagatgaaattggagcatcttgtagtgcttgaaaacagttggcatctgtgtgaagatgtgaatggaggaggcagagtaggcagtgagtgccgcagccacagcttgtgttctctgcagccctggcacagaagataggaacactcatgggggatgcggccactgtgatgtcttcccacacaagaagtgccaagtgcttttctcatgcttttctggattgtcccatggtggacgagtcagcaggagtgagatggagcagcacagtagaggg

SEQ ID NO: 728356 - DNA, 755 bp, Homo sapiens
actcacctaaggatgcgagctagcaggtcttgcagcggctatcacgcccctcacgccgctatctctgtgcagccgactgaggatccctagtcgcataaggctgtgcctggcctgttggcgtccctggcagttgttgggttctggcggttgttgggtccctggcagttgttggcggttgttgggttccttcattgaaactgcactaactgggcttccagtcagcgtcagtcagcggatccttgggccgtggggcagccgcaggtcggttaggccaccagggcggctctcgtgccagtgaggcccctgagagccctttggtcagacagaggctaaatctgaacagtcaggcggtgagattaagcatagtcagggagttcgccaggagccagcgttcctcagcctccaccacgtcagtcacctggtcagccagagggcagctggggcgacatccatctaccaagaaggtgaacaggccttcacgatgaccagagacagaagcccctgacttggctaaagatacttctgctctccccatccccacatcctctttcagttacgcatcacctcactccttctgaaccatatggttctgatgtcagagccagtgtagtaaagagcttctgctgttcctgagaactgttgctgctggaagtgatgcttccactgctacagctgggaagagtcttggtgccaggctcgggaagggtgacaggggctacatggggaaaggaatgggcggcttcctgtctccttca

SEQ ID NO: 728357 - DNA, 830 bp, Homo sapiens
aatggactttggaacacaacgtgctacctcaaggctccacctggccacacagcaggcactgaggctgggagacagcccccagacagatgagtgtccgcgcctctctgagaggtgaatgagcccggacggtccctacctaccaagtcctgaggagcagcggcaccaacgacgcaggcccgccccagcccgccagtgagccgcccatgccctctgctagcccggcccgcccgggcccccgccatgctgatcaccgtgtactgcgtgcggagggacctctccgaggtcaccttctctctccaggtcagccccgactttgagctccgaaacttcaaggtcctctgcgaagcggagtccagagtccccgtcgaagagatccagatcatccacatggagcgactcctcatcgaggaccactgttccctgggctcctacggcctcaaagatggcgatatcgtggttttactgcagaaggacaatgtgggacctcgggctccagggcgtgccccgaaccagcctcgtgtagacttcagtggcattgcggtgcctgggacgtccagctcccgtccacagcaccctggacagcagcagcagcgcacacccgctgcccagcggtcacagggcttggcgtcaggagagaaggtggccggcctgcaaggtctgggcagccccgccctgatccgcagcatgctgctctccaaaccccacgatctgtccctgctcaaggaacgcaaccctcccttggcggaagccctgctcagcggaagccttgagaccttttctcaggtgctgatggagcagcaaagggaaaaggcttgagagagcaagagagg

SEQ ID NO: 728358 - DNA, 805 bp, Homo sapiens
gaggtcacagccaacattcagaggcctcccagggccccctctccctggataaaccacttcagctgccccccatttttctcgagggagaaaaaggggaatcctctgtccagaatgagcaggaaggagagccaagcctacagtcacccagcttagagctccagtcccctgcgtggccacgccatgcaggagtggctcaggagcccctgaaagtgtccagcagctacctcagtgacacccagagcagcgagagtcatgtttccagcgtgcagcacccgaggccagaggagggcagccatgccagcctgagcagcgggtacgcaggggacaaggagggcagcgacatcagcttggtgggcagccaccggagagtgcggctgaacagaaggctcaacacccaggcggccagtaaccaaaccagccagctgggctccatagaccctcccagctctctaaagagccggctgactggccccgcccacagcaccaagcagactggagggaaagagtgaggccagcctgcccggcagcggcagcggcagcagcatcctgtccagcgccagcttcatcagcttgggcagcagtgccctcacctaccaggtgagcagcgggctgctgacttccacagccagccttccctccacccaggccagcagccgtcagagcgtccggctggatggcagtgcccaaaacaggcagagcagccacaccagcgtgcaggaggacaagacgggcggcaacgtgaaaaccagtgagcaggtcaccacgggggagcagcctgcccaggtgtgcatgcctttgtgagaat

SEQ ID NO: 728359 - DNA, 616 bp, Homo sapiens
catgggctggtgatgccagtccatgctcaaaagaagcccagccttacagagtctagcttcagaaataaaattaaatgttttctgcagcatattaaccccaagacaaaaggcaaagggcatgaggactccatgttctcagccgctgcgaaggtggccaaaaccagaaaagaaaatgttgcaaagagcctggctccagccaagagccctgtggggagaagtaagacggagaagccgacagggtgctccaaggcccaatctcgtcctgctcagaagctggtgggcccagccttcttggatggtccccaatccctagacgataagctccggctacactccagacaacctggctctgcctcagccctgggctacccccgccactgccctcgtcactgtcctcgagaggcttgtgccaacaaaccagggcacccaacctagctcctgaccctcacctcagatagaaacattggtccgctcaaggagaacatgcagagccatgaaaaagagtttataggctccccaactgctgcagccctccagaggaccagtattgtcatttccataaatgtgcaggtgggacagatgccactagaaatacactctatatttctcagcaata

SEQ ID NO: 728360 - DNA, 863 bp, Homo sapiens
ggagcggcctggctttgtctgagtcaggcagcccagcgtgtgggatgccaggctggatgtgctgggcctgaccagccgcccgctttcctcttctcttgcctctgcctgccccctggtggacagctggggtaaagcatgggagtgcgcctttggggtctcagtggggctgaaatacgactcctcccctaggacagcctgccttccccagccttgttctccggcaaagtcaatttcctggagaatcgaggctctgcctcagatgttcggagcctccgcaggatgaacacctccatttcaattccaggggctttgatcaacctgtgcctcccttgatccccaacttgtgggcaccttcccttgagcagtgcccccacgaggtacacctttcccgggaaacaaaaatcattccttctttgggtcctgcaagctgtaaagaaccaatacagcactgtgctactgaacatgttgccactatagaagccccttgtgttttgaagagtacatctctatagccattcgtttattcatcagaaaccagctagaagccaggccctgtgctgggcgctggagacatggaagaaactgggctgaggctcccgccttgaagagcttgtggcccagggaagggacagttcatctgtcattgattgccacgtgacagtgtctatgatgctaaaaagatgccagtgctgtgctgcaggagcaaaggccgtggaggaagaggctttggctttgttgcgagtccttgccagagccaggcaaagccagtcaccgctttgttcagatgactcaggtaaataaatgaggccgcacaggctgtcctgacaccacacacctctagaataccctggctgtgctgggag

SEQ ID NO: 728361 - DNA, 1033 bp, Homo sapiens
tcccaggcaacgcgccgcgcggggctccaggttccgcccagggactaactccaggtctgcgcgcgtccaacgagcacggctctcaaccggcctcctggcgcccaacgaccatggcttccaaccggcctccgtgcgcccaacgaccatgactcccaaccggcctccagtttccaactgtttctcgaacagggaagccgccatgacacagctgactacgcccttggtcacaggggacctgagatcctccacgatttacgggaccggcgccacctcgggctcgaaccaccctctcgatagggccgccgctaagtaatcggcgtaggggttcagccgcacatctccttcccgcgccgcggaccgagcagtcgttggtgctcttcaggtgcggcctgggtgcccagagccttcgttagactctcggacccgcaagggagcccgaactctttcagactcgctctccctcagccggacctcggccctttttcacaccccaggggagtctggatttctcatagtcctgggcaccagccccttcccagtctagctcttgggactccctgaagccggaactccctcgcctggactcccgggagaacctggaatccccatctccagtccacattttctcagaatctgtcctagcccttcagtctcccaggcatgacatcgtgtggtcccagcgccctaggtggtgagctgtgactctccttagagcctggcgaggccgaggtcctccccagctcgaacccatcccacactccccttctcagcctctgtgttccccagtggtcctggaaaagcccccagttccctctgcctggccccaatcctcacaaacccaattacccacgctcctttccattccataacccccatcactgcatcctccaggctcccatccatggaggacttgaggtggaaagcaatttggttcaaaataaccattatttattacttgaaagggaatatttccagtcgttgccagcctcctccccttctagtattggtaaattttttgcaccactgaaaaagt

SEQ ID NO: 728362 - DNA, 1157 bp, Homo sapiens
  misc_feature (435)..(435): n is a, c, g, or t
  misc_feature (447)..(447): n is a, c, g, or t
  misc_feature (450)..(450): n is a, c, g, or t
  misc_feature (464)..(464): n is a, c, g, or t
  misc_feature (472)..(472): n is a, c, g, or t
  misc_feature (494)..(494): n is a, c, g, or t
tcccaggcaacgcgccgcgcggggctccaggttccgcccagggactaactccaggtctgcgcgcgtccaacgagcacggctctcaaccggcctcctggcgcccaacgaccatggcttccaaccggcctccgtgcgcccaacgaccatgactcccaaccggcctccagtttccaactgtttctcgaacagggaagccgccatgacacagctgactacgcccttggtcacaggggacctgagatcctccacgatttacgggaccggcgccacctcgggctcgaaccaccctctcgatagggccgccgctaagtaatcggcgtaggggttcagccgcacatctccttcccgcgccgcggaccgagcagtcgttggtgctcttcaggtgcggcctgggtgcccagagccttcgttagactctcggagccccctgttccnataccgggtagntgnttgtttgggacgangcgccaangcgaggggaattcgcccgaagngggggggggggggggggggggggggggggggggggggggggggggggggggggggggggggggggggggggggggggggactcgctctccctcagccggacctcggccctttttcacaccccaggggagtctggatttctcatagtcctgggcaccagccccttcccagtctagctcttgggactccctgaagccggaactccctcgcctggactcccgggagaacctggaatccccatctccagtccacattttctcagaatctgtcctagcccttcagtctcccaggcatgacatcgtgtggtcccagcgccctaggtggtgagctgtgactctccttagagcctggcgaggccgaggtcctccccagctcgaacccatcccacactccccttctcagcctctgtgttccccagtggtcctggaaaagcccccagttccctctgcctggccccaatcctcacaaacccaattacccacgctcctttccattccataacccccatcactgcatcctccaggctcccatccatggaggacttgaggtggaaagcaatttggttcaaaataaccattatttattacttgaaagggaatatttccagtcgttgccagcctcctccccttctagtattggtaaattttttgcaccactgaaaaagt

SEQ ID NO: 728363 - DNA, 1884 bp, Homo sapiens; identical to SEQ ID NO: 67097
  misc_feature (1872)..(1872): n is a, c, g, or t
  misc_feature (1876)..(1878): n is a, c, g, or t
  misc_feature (1882)..(1884): n is a, c, g, or t

SEQ ID NO: 728364 - DNA, 1790 bp, Homo sapiens; identical to SEQ ID NO: 67096
  misc_feature (1778)..(1778): n is a, c, g, or t
  misc_feature (1782)..(1784): n is a, c, g, or t
  misc_feature (1788)..(1790): n is a, c, g, or t

SEQ ID NO: 728365 - DNA, 930 bp, Homo sapiens
ctgcagtgaaggtcccaaagtcccagacaagtcccctcttgttgcccaggctggagtgcagcagcatgattacagctcacatcagcctcgacctcccgggctcaagctatcctcctacctcagcctcccaagtagctgggactataggatctttctgctgatgcagctgttaagagtgtttcataaactgtgacaacactaagcaaaatcatagaaggaaactctatggacaatttcagatggagaagaagaaaggactggaagttcaatttggccatgacaattagacttgaagaagctgagtgagaaggccatgcagatatcttggagaagtgcattccaggcagaggaaaagccagtgcagagacactgaagcagggcatgactgatgtgtataaggagcatcatatacatgatcatctacagtccactgaggagaatagcagacgagaggccaggtgcagtgcatgtaatcccagcactttgggagactgagatgggaagatcgcttgaggccaggagtgcaagaccagcctgggcaacacagcaagaccttgattctactaaaaaaaaaaaaggatccttcaacttcaacaataataacacaagggaagtgaagaaaaacactttctaaggaaatctctctctgagctaccatcctgctagggagagcctgaaagcagaatgcatgacttgactagctctggtcaatgaaagaaatcaccagtggaaaggctaccagggggctttctcaaaagagagggacagtaaactggcaagatgaacaactcaatgccatccaggtctggatgagaaagaacagtcgagagactgaggtttcaggagtggaaacactcaaagcatcatcttccactttcttctccggctgctaggaagaaggggaaaacacagaccttctgaggacctgcg

SEQ ID NO: 728366 - DNA, 2035 bp, Homo sapiens
agcggcggggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgaggccaaccaatcaatggctcagacagataagccaacatgcatcccgccggagctgccgaagatgctgaaggagtttgccaaagccgccattagggtgcagccgcaggacctcatccagtgggcagccgagtacgtgctcctttctcgccttcaccccttggaggacggccggagacagagggtcctgtaaaaccgcggaggttgtcatggctgcagctaggaagtccggactaactggcatcgtctttgttttagctcttgcattgctttgatgctttaaaatccacacataaatgctacatctagctgggcaaggatgggatgcctcccctaagggagccagattgagcagtaggacgccaggtcaataggccgtgtcctggggcaagcagcaagttagatgaccgcgtcacaccagcgtatgcacacccacctcctccctgcacgccttttcccactcccggtggaaagaagggctgggaatctccgaagcttaatctgcctttcttcgttctcctgtctcaccactagatggcagcagtgcagccgggggagggaagcgacagccctgggtggatggggtgggaccagtcctgctagttcactcctttaaggagacacttcctcccctgctgttaaaactcatacttggacccaaccaaagaccctttatatcttgtcttggaggaaattattgttattttctttagtgtttctctgaactgattttgttctgccaacataaagatgtccgcacagtacacactgcattctggggaaaggccaagcagagtgatggggtcctcaggcatggctgaaaacagtgtgcctcaaacacgggtgccttctttcaggagagacctccagaggctgctcagtagatggagcttacacaacaatcgctgcgggcctggattgaagtagctttgcacagaaagcctctcagctatgaaattgctccttggacaaacttgcctgcttgaaactggggaaccaggacttgagacaggagttggaagataactagacctcacggaccattttcaggctatttttactgtttgatgattccctgcttaggagggtttcagtgggaaagtgagagtgagagaggccgttgagagaaagccagtgagttggggaagggaagatgtcctcaggctgaggttgtgagtgggtgtcctgggcagatggtggggagagtgtggacacctttgagaagacacaaaatggcatctaagaggggcctttcggagtctctgggccagtgctgtgctcctggactggattaggatgtagcttttacaattggaaggaaaataagccagtggtgctcataaaaagaaacataaatgggggttgctttgcctagtaatgagccctgtttagttctccattttaaattttatatattgcctctaagattgaactttagcttcagaagactaatttattttggcatagtcagatagacagactttatcttatacgttagtttcaaacccatttgattgttcttgtgctgccgttttatagtaagcaaactgacattgcttagtattgtccctgacatttatggaagaggcattccactattgtagactgcttgctctcgtattgtatcacgtgctataatttttttagacatccatgaaaacttagtttgtagtttaaccacaatgaaaaaggagggcatgacctaagagccccctccattctatccagacatgaaaagcactgctcagatggttgtatgtgacttacttaaaacctgtagcattttagagaataaaactctgcaaagtgtttccaagac

SEQ ID NO: 728367 - DNA, 600 bp, Homo sapiens
ttcgcggtttgattctggggtggggcggcagcgggagcgcgcccgcttttcctaggccagcgggcggttgtctgtggctccgcgactgggcgccccgtcacgtaggttacacacacaatcactccccagggacggcccggagtccgtccaggcagctgcgccctccccagacccgggcaccgcggaggctggagccgcaatggtgctgatggagggcgggagatggagctgaccaggggccggaggggctgagaagagcctgcccaagtctgggccaagcacgaagccctttcccacccgtcgggctcctgggttcccgccagccgatttccagccgtcagggtcacgccactcgctggaaaccctgaactctgtgccccccaagccctgggccccctgcgggaatgttcaaaaatgagtaccagggaggtgcatttgttgaaattttcagtgctcaaggaaaaaatcctggagcaaaatggaagatccttggtagtccatctgtgatttggaaagagtttgataaagaagttaaaagttttgtgtttgtcctggaaggcagcagccaaacaaacaaaattcagttaccaaaggagaata

SEQ ID NO: 728368 - DNA, 502 bp, Homo sapiens; identical to SEQ ID NO: 73555

SEQ ID NO: 728369 - DNA, 743 bp, Homo sapiens
agggagctctaccatcaagtgaggggaatgcccaccatcgctatcatcaccatcaccactacttctgccacagccatcacattcacctctacctccaccatcaccatcactactcaagttggagaaatagaggccaggggaaggggataaagggagggcaaagaaaagtaattccaaaggaacatgagcaccaataatgctttaagagtgttttggaaatcaagagaatggaatatgaaaacatcaacatttgattcagatgaggatattctacttttacccaaaagaaaacgttttagaaagaaaaagtcaagaccagtgagacacaccaaacgccatgaagaggagcaggtctatgagcaagggaccacattaccctgttccatatgcaagcacgaaattgacctaactggtatttttctccataagaagcaacatgtagctctggccacgctgggtttccaatggatgggtagaaagaaaccacagccctcagtgattgctgttcagagacagttcatgatttctaaactattgtcatcttttatgttcactgaaaaaaccctacagagcattaataatgcttttgagctgctttggaaaaaacaaataccagcatactataagatttttgataacattgacaggagtgtcatatattctcaaaaaatatgtcatctgttaattaaaggagtgggcatttgtgaagacaggaattctacatggaaagctgacatgaatga

SEQ ID NO: 728370 - DNA, 455 bp, Homo sapiens
agggagctctaccatcaagtgaggggaatgcccaccatcgctatcatcaccatcaccactacttctgccacagccatcacattcacctctacctccaccatcaccatcactactcaagttggagaaatagaggccaggggaaggggataaagggagggcaaagaaaagtaattccaaaggaacatgagcaccaataatgctttaagtctgagaccgtaggagaaagatggctgtggagtcgcacattacccagaaggaaattaagaaggagcttcagaagctgatcctcacaagcagacaggcccgctgccgccagtaacagccgccgccaccgaatggtcgagttctccggatgaaacataccgtccagcgtgctggcgacctacacttggatagatgcaaccttgaaagaactgagcttagtaaaataagtctatccagaggctagaaagaag

SEQ ID NO: 728371 - DNA, 492 bp, Homo sapiens
tgtactcttaatgttttttaaaaatctgtggatacaataggaatatttttcagtctaaaaaccagcttaacacctaatgatgaaacattacaatactccctttatatatatgaagaaaataagcccaaaatcttcactttgatttactaatattcattagtcaaagcaattagcaaaagcagtgagcagtatgaaaactggaaggaaaaagaaaaaattatttacagatgacattaatatacctagaaaaccaagcaattagaagagctcatgttgtagcagaacaaaaaggataaaatttataggaacaaaacttaagaaatgtataagatctaaagaaaaaatattaagccaaaaaaaggacattaaaaagtcccaactcattggaaaagcatgacatcttggacataaagactcaataccaaaatgtcatgcttttccaatgagttgggactttttaatgtcctttttttggcttaatatttttgtcga

SEQ ID NO: 728372 - DNA, 758 bp, Homo sapiens
tgtactcttaatgttttttaaaaatctgtggatacaataggaatatttttcagtctaaaaaccagcttaacacctaatgatgaaacattacaatactccctttatatatatgaagaaaataagcccaaaatcttcactttgatttactaatattcattagtcaaagcaattagcaaaagcagtgagcagtatgaaaactggaaggaaaaagaaaaaattatttacagatgacattaatatacctagaaaaccaagcaattagaagagctcatgttgtagcagaacaaaaaggataaaatttataggaacaaaacttaagaaatgtataagatctaaagaaaaaatattaagccaaaaaaaggacattaaaaagtcccaactcattggaaaagcatgacatcttggacataaagactcaataccaaaaaattcttcaactcgtagaaaataaaatgattataagtacccaataaatttagaatgtgataggtgttagcataaaattcctaccaaataatcaaatgaaaatattttcacacgagctaaaaaaaaaaaaaaatctattaataggattaaaaaccaaaacaaaacttccatatgtaagtgtgttcttcacataagaaagagcatctctgcaataggaatacataccaaaataccatcttctgttatccaaaaaaaacaactaagttacggctcacatgcaaattccaacccacctttggtaactaaatgggctttggtcacatgctaaatac

SEQ ID NO: 728373 - DNA, 1088 bp, Homo sapiens
gggagaccgatgcgggcagatcacctgaggtcgggagttcaagaccagcctaaccaacatggagaaacccccatctctactaaaaatacaaaattagccaagtgtggtgacatatgtctgtagtcccagctactcgggaggctgaggcaggagaatcacttgaacccaggaggcggaggttgtggtaagccgagatcacgccactgcattccagtctgggcaacaagagcaaaactcggtctcaaaaaaaaaaaaaaaaaaagtcccgaagtggttaacactgccatttaggctgggcatggtgattcatgcctgtaatcccagcactttgggaggccaaggcatttgagaccagcccgggcaacatggcaaaaccctgtctctataaaaaatacaaaaaaaaaaaaaatagctgggcatggtggtgtgcacctgtacccccagcttctagggagggcgagatgggagaatcatgtgagcccctggagaggtcgaggctgcggtaagccatgactgcgctactgcactccaacctggatgacagagaccctgtctaaaaaaacataatatttaaaaaaaaaaaaaacttatcatatagatcaggtgtcataaaatctgggggttcaggctgtggctcctccctctgcacccttgcgatgcaaattaacctattaccttaaaatgagatgtgaccaattctgctcagagacagaagctactggtcaaagggattcagagcaaaccagtcacagctaccagaggatttacagagggagctaacagagccgggctgggctgcagagcgacctttccacagcacgctgcaacctaatacagtgtgttaagccaggggacctacaggggagacacagattgggaaaggctgggcttggtaagcaggagaattggcccaaatgactcatcacataaggagagaatgaggcaggtaatcagaagctagcatctctaactaaggagatcaaagaaccagtgggatcaccttgctcagtgggaaggtgatctggataaataccaaagacggggacacttgcctgcagctgggcttttctgctcccagtgacagaatg

SEQ ID NO: 728374 - DNA, 792 bp, Homo sapiens
tgcctcgcgtcgacgatctggtagcaaagaagaagaaacaaacactgatctctttctgccacccctctgaccctttggaactcctctgaccctttaggacaagcctacctaatatctgctagagaaaagaccaacaacggcctcaaaggatctcttaccatgaaggtctcagctaattcttggctaagatgtgggttccacattaggttctgaatatggggggaagggtcaatttgctcattttgtgtgtggataaagtcaggatgcccaggggccagagcagggggctgctgctttgggaacaatggctgagcatataaccataggtatgggaacaaaaaacatcaaagtcactgtatcaattgccatgaagacttgagggacctgaatctaccgattcatcttaaggcagcaggaccagtttgagtggcaacaatgcagcagcagaatcaatggaaacaacagaatgattgcaatcattctgttgtttccagtcgactccttctgacttgataaaagggaccgtcttccttggatttagtgaacccctttggttcctgaaaaattcaaggagtatctaggacatagtccccagaagacagtacaagactttctgataaactggacatttcaagacccaaataactaatcagaaaaatcaaagatgtgatactattttttatcccatgcataggtgctacacttggatcaaatgaacaatgttgggatctctatggataaaggtcttaaaagtcctgagataaagaatcctgcacccactggtacttctaa

SEQ ID NO: 728375 - DNA, 1253 bp, Homo sapiens; identical to SEQ ID NO: 386141
  misc_feature (820)..(821): n is a, c, g, or t
  misc_feature (835)..(835): n is a, c, g, or t
  misc_feature (855)..(855): n is a, c, g, or t
  misc_feature (903)..(903): n is a, c, g, or t
  misc_feature (1126)..(1126): n is a, c, g, or t

SEQ ID NO: 728376 - DNA, 568 bp, Homo sapiens
tgccacatgttcatatctatgtgcaggaaggacaagactgtagacagacagtcggctcccttggacactgcccagaacatgtggtcatgggggaaagggtgttaaacctggatggcaagtgagatcttgtgacccttggggacatggtattgccgtgttgaacctgctgtcgcaccatggggtaggactggggaggaggagcagtctagagcggagaggccctgggtgcttatatgggactggcctccaacctgaggcactggcttcataagctcaactcagcctatccggaaagccatttagtttttattgctgcttctgagaagtgggggagaggtgagctatttgtggatttgttttaggcagtgttcacaatcatagcacctaaatatgaaggatcagaataagttatgaaatgaaggtcaggaaccttttgtacatagtttcttatttggaatgatgttctttaagccctatgagtatttggtatgtgctcctgatgctggcatctgagtctcatttttgtaccgtgttatttgagcaaataaatacattaacttgcacaaac

SEQ ID NO: 728377 - DNA, 1035 bp, Homo sapiens; identical to SEQ ID NO: 5866

SEQ ID NO: 728378 - DNA, 809 bp, Homo sapiens
tccatctactgattcaaatgctaatctctcctggaaacactctcacagccacacccagaaataatgttttaccagctatctggacatccttagcttagtcaagctgacacataaaattaatcatcacatgtcctatttctttttcaatgatatttccttgctccatcttatttatatctttttaaaaatatgtattgttgctatgacctaaaaacaatctctctctttgctattatttactagctcctctcccatgtgactatatgaccgccttcaatgtacacattcatcccttattggaactttggcctttaaattagctatagtaggaaaaaaaaaaaaaaaacctctatattcagcacaaagctctatgttgaatatataatgagatgtcagtgcccattgaataaataaatgagtgaatgaatgaaaatagccagggatgccagataaaagataaagtagaattgtagtagattatctactcttgctatatcttttattcacactatagagtaataacacttgttggggtgcatttctatgagaaaactgcaaaaatatttggactaatgcattaataagttagcttacagatgtaggaagaaacccagtatttcagaccaaaaatggttaaactgaatgaccactgagtttactttcaaagttgatacagaatacgtcacattgaagcacaactaccattgccttcactactcgttagaaatattttatgccccaaatttataactggactctctttcactttgagatacacccccagttccttaagtaccttctttgagaaa

SEQ ID NO: 728379 - DNA, 684 bp, Homo sapiens
ctcttggtgaagatgccagaaaaatatcgtaaaaacctgctctcttatcctcttctctgtactactttgttaccccaccccaccccacctcaagcccccagtaaaaaatgaccttttggcccagggccctatctgagtatattgtgtggcagagttgtctctggctgactcccaggattgttaatgacttccttctctgtccctaaataattgcttgaaaagacagctgtggagagacattgcccccagcttgcaggctcattaattcagccctatgaaagagggtgcaaaggaagaaggtggaagttactttgccaagagtagcaggcttgggggaaactaaaatagaggcttcaggggaagggcagcagcatggtgtcagagattacacttggagtttgtgaagtctgggcaggcttcaatctaaagaaactttatgcacaaaagcccaaatccagggaaataaatgaaagtgattattcacttttctaaagtccttacagtagcgttcctctggtattgtttgaatacagtttaacctgaagggcacttggtttttgtgcagctcttcaagaacagaagcatctaagtaagtagaaagtctgagaaattaacagagaagattccctaaaagtcagccttcattacttgaccattattcataattctgcatttgtctattcc

SEQ ID NO: 728380 - DNA, 542 bp, Homo sapiens
cgttgcactccagcctgggtgacagagtgagatcccgtctcaaaacaaacaaccctcaaaactctccaataggccaggcacgatggctcacgcctgtaatcccagcactttggtaagtcgaggtgggggcggggggatcacctgaggttgggagttcgagaccagcctggctaacattgtgaaacccagtttctactaaaaattaaaaaattagcctggcatggtggcacgcgcctgtaatcccagctactgggaagctgaggcgagagaatcgcttgaacctgggagacggaggttgcagtgagccaagatcgtgtcattgcactccagcttgggcaacaagagagaaagtcaaaaaaaaaaaaaaaaaaaagagagaaaagaaaataaagaaactcccccttttgttgtagtatgaagacttcaaactataataatactagggtgggacgagtactagtaaatttatttccttttatttttactacattttttgcaatgtacatttactttgtctgacaataaaaagctacttacgagat

SEQ ID NO: 728381 - DNA, 567 bp, Homo sapiens
ggctaatttttctatttttagtagagatggggtttcaccatattggtcaggctggtctcgaactcctgaccccaggtgacccacctgccttggcctcccaaagtgctgagattacaggcgtgagccaccatgcccggccctcaagatttttatgaggaccacatgaaatgctgaaagcacttagtagtatgtccaggagcagggtcttgctctgtcatctagacttgaatgcagcgagtggcatcgtcatagctcactgcaggctcaatctctcagcctcaagcaatccttgcccctcagcctcctaagtagctgggactacacgtccagctaatttttgtatttttgtaaagatggggcctcactatgttgccttggctggtcttgaactcctagtttcaagttatcctctcaccttggcctcccgaagtgttgggattataggcgtgagccactgcaactggccaggacagtgattgattgattgattgattggtttgagacagagtctcactctgtcgtccaggatggagtgcagtggcacgatctcagctcactgtaacctcc

SEQ ID NO: 728382 - DNA, 1076 bp, Homo sapiens
cccgtccttcctctcctagcctaaggcgtgcaaacagagcgccactgggaggctgaaacctttaggccgatgcttgcttgcaaggtcaggcaagctggattctggtccccacctttgcagagagaacagcgatgttgtgcgcccatttctcagatcaaggaccggcccatcttactacctccaagagtgcttttctctctaataagaaaacatctactttgaaacatctactgggcgagaccaggagtgatggctcagcctgtaattctggaatttcgggaggccgaggcaggaagattccttgagcacaggagttccagaccagcctgggcaatgtagcaagacgctgtctctatttatacaataaaatttttttaaaaaaggaaaaaaaaaaaaaaaaaaaaaattgtgtgtggggggatgggccctgggaaaagtttttaaaaccatttggtgggggggcgggggcccaaagggttagggaacacggggaccaacgagcagtgtacacaaggagagcaccgggcgcacaaggaccatagggcgctgggggatatacttccaccaagtttaaaagagagcgccggggggaacacccgaggttttctaaaaacaaattccaagaagagggtcacggagggcaacaaacgggcgctctatacacaggaggaatccaaaaggcggaaggctctgaaagtactaaaaaatataagcccgcggacccaggggtagaggagaaacacagcgacacacggaaggcacaaacgcaagaggcgaaagcagagccaggcgagaagaagacaagacgacaaagaacgaaaggaaacgagcaaggagcaagagaggcaaaaggaagaaggacggaacaacagaagacgaaaaaggaagcgacaacaaaagaaagagaaaagacaagagaaagggcgaaagaacaaagaaaaagaaaaaagacacaaaaagaaaagaagaaacacgagcaaaacagacaagagagggagagagaaaagaaaaaaagaagagagaaggacgagaaaggaccacgaagaagaaacggagaagagagagaggaaaaagac

SEQ ID NO: 728383 - DNA, 435 bp, Homo sapiens
gctcgacatttaatctctcagtggctacattacatttatcatgaaattgatggacacttgaaattaaatgtgtccttaggttgtaatgacagaaatatagagtacaggaccacagagatattattcttgatcttgaccttgatcttgactggtcaggcttcatctagaatatttaccaattctgggtacatcaccagatagagatattcagaggagagggagcagaatgaagtagcttgtgaaaaccatgtcataagacaaattgaaatacttaaggtatatatctgggaaaacaaaacccagaagttaaaattctatagttatttgcacaatttttaaattatcttaagtttgggccattttaaggatcacaaaatcaatattgccttcctttaagatgtatttcaagtcagctcttggctttttactttggct

SEQ ID NO: 728384 - DNA, 571 bp, Homo sapiens
tcgtactgtggccagacattcacctctctcttgacatttcccaataatttccctttaaagactaggccagatagcactagatcttctgacaaagagaaaaaggcctatccaattcaagctgaaataagatattttttactgatgaggaatttcaagtgtccatcaatttcatgatacatgtaatgtagccactgagagattaaatgtgtccttaggttgtaatgacagaaatatagagtacaggaccacagagatattattcttgatcttgaccttgatcttgactggtcaggcttcatctagaatatttaccaattctgggtacatcaccagatagagatattcagaggagagggagcagaatgaagtagcttgtgaaaaccatgtcataagacaaattgaaatacttaaggtatatatctgggaaaacaaaacccagaagttaaaattctatagttatttgcacaatttttaaattatcttaagtttgggccattttaaggatcacaaaatcaatattgccttcctttaagatgtatttcaagtcagctcttggctttttactttggct

SEQ ID NO: 728385 - DNA, 442 bp, Homo sapiens
attgagtacttaaccaaataagatatacagatagcaaataagcacatgaaaagatgctcaacctcattagtcattagggaaatacaaattaaaaccataacgaagtaccactacatacctattagactggctttagaagaaaaacggacaataccaagcgctgacaaagatgttggacagctgagatgctcctcatactttgctggcgggaatgcaaaatgtttgagtcactttgggagagcttggcattttcttattaaggtaaacatacccttacctatgacccagtaatcctactcctaggtctttactcaagacaaatgaaagcatgtgtctatataaagacttgtacatgaatagcaactttattcaaaattgctcaacctggagacaacctgaatgtcctcaaacctgtgaatggacatctatggatgaatctcac

SEQ ID NO: 728386 - DNA, 974 bp, Homo sapiens
ccaatgtctaggtattctgaattatgttcactaaaaagtaggtctcaaagagcatcgtaatctccttagctttgtataaggaagccatgtaacaaagcagccttactacgtttctgtttttgcttttgttttatttttatctccattacttgttaagtggtaatggtgtagtagcatcttaaaataccatactattaagattgagccggggaaccttctcctattctttgctcttcagatatttctctactgtaaccccatagctcttgaacatctcatgacatatatcattgtattttaatttaataaattcatttttctatgcactagactggcttctttgcattataaccaggacttcacatagatgctggtacctcatagatttctaataaatacctgctgaattaaggaaacacaaatttatgttctacatcacgatgttagtgaaaatttgttgctgtgtttatttctcacaataaataaacatggggtgcctcctgtagtagtgtcctatgggaatcaattattgatacccagtgatgtagacaagttgttttaaaaaagaaaagattgaaggaaagcagtctcctcttttaccagcccccacctcaactatataattttaagaaaattgatatcaaaagctgtgatatccgtttctctttaccatccaaagttcttgaagttgccttgacaagcagagattccttgaatcagtccaaatacatgatatatagataaataatacgtgtgtgtgtgtagacatctttagtagaaacagcttttcagatactgatttcatactgtcttcctcctggctttccattgacttattgatttcagatacagtttcaaattgcatcttaattgtggggagtggggatagtagctagcctctggctcctcttttttaaggttatttctgagactgccttggagtggttcaaaccagaataaatgcagtttactgc

SEQ ID NO: 728387 - DNA, 434 bp, Homo sapiens; identical to SEQ ID NO: 24382

SEQ ID NO: 728388 - DNA, 490 bp, Homo sapiens
attaccaccatcttggaaaatagtatgaagctttctcaagaaattataaatatatttacattatgattcatcaatgcctcttctggatatacgtctaaagaacttaaaatcagtatgtcaaagagacatctgcaatttcatgttcattgcagagttattcataatagctgtgatttagaaacaacctaagtgtttatcaactgaagaatggattaaaaatatgtgaaaatttgaaacccttatacactgctgatgagagtttaaaacagtctggcagttcttcaaaaggataagtatagaattaccatatgactcagtaaattaactcctatgtatacaccaaaaagaaatgaaaacaaatgtctactcaaaaggtagcatacaagtacttacagcaacaaaaagtgggaagcaacagaaatgtccatgaattgcagagtggattaataaaatgtggtctgtccatgaaatacaatagtatttggcaata

SEQ ID NO: 728389 - DNA, 809 bp, Homo sapiens
cctgagtacccattgttattccatgaagtgatataattccatatctattattttctactttcttcttcaggttgtcagctatcagtacagttccctttaatagccctcagccataccaatgaaaattggttgtttacaatctcttctagactacaaaaccagataattcattgtatcaagcccttattataaggcttaagaatcagtcaagtgctcagtgaggccgtagaggaaatgtgaattttgtagctctgatagggagtgactttagcctctacctcaagtttcactggccactgctgatttggaagttgtgtatcaacagatgaagtgacaaaaccatccttagtaaattaatgtaactacaggcagcaccaggttaacacttcttcttacatgcaaacagctatctggctggcctaaggcattcttctcccctagtatagctgcttgcatttgtttctcctctttcctcattccaagacttaactgctgacaactgctgcaaatcagaatggataccctaatcttagccaccttaccccataccctagtgatagtcctgagtcatcctgatatgaaggttgaccaggatatcataatggcaatgatagtgcttgtaggacatgccatttgagtgtgtattctgtgccagatactgtgctagaacttcaggtgcatcattgttttaatccttaaaaaatcactttcagaggccaaggcagatcgatcgcttgagaccaggagttcaaggaccagcctgggcaacatgttgaaaccccatctctactaaaaatacaaaaaaaaaa

SEQ ID NO: 728390 - DNA, 632 bp, Homo sapiens
gtcccgtcagtacaatttcctctaaaacctataccttggcttgaaagaattatagttctcacgactaacaaaacaattctctgcagatataatacatgctatcccagtccctgccacactggaaaagcaataatcagatctggtggaattgctaacctgctcaaggaccatcttctcttcaacagagaattttacagaatcataataaaaccaagtacatatgagtttcctttaacctggctttcagattaattcaggatttgggtaagctcttagcctcacactgactcaaaaatccaaacaaatatttatggcctagagagcatgtaaagcaaaacacctcactagagggcaaaatgggaaagaaaacacccttttagcctcaaagcatgaagcagcaaacacctgccactccattctttgtccaggcaagccttcaaagtaagtgtcagagaacgggataaatatttatgtgtgaccaagctgaagtacagttaaaaaaaaaaaaaaaaagtagtccccaggtcctgccagaaaaggaggcaagacttaccgctgtgttgctgacaggcagatgtaattccatggaaggcctgacatttaaagccatatgtactggaaaatgtttcaaa

SEQ ID NO: 728391 - DNA, 466 bp, Homo sapiens
tatttttggaatgtatagtaaattcacatggatcaaaattcaaatgaaaattctccttccaactgtggtccccagccactcctttcctctccctagaggcaaccagtattactgattatgtgattatccttctagaagtattttgtaccttctacaagtgtgtgtgtgtgtgtgtgtgtgtgtgtgtgtgtacatgaatatttctatgtaaccatacatgcgtattttcttattttaatgagtggttacagaatatagacactgttatataccttgctttttcacctaacaccaaatcttggaaattattctgtattcctagaaagaaagcttttgcacttttaaaatggcatgcgtctacagtaggttaaagtaattcctaatgcgtggattaggcctattacataatagcactcaagaaattgttactgcctgtagcactgcccaagaacacggaaaaaaaaaa

SEQ ID NO: 728392 - DNA, 538 bp, Homo sapiens
agactgcgtcttctgttctagctctgctggccccagggctggagtccattaaagaatataaatcaaagagtgagaagccatccctgtagttggtcctatgatcacacatgctaagcaagcagtgtgtaattatgggaggacattaaaatgccagtggaagagatggatgagattcaaaacatgctttcttttctgggtcagtaaagtctgtttccttttttgccagaatacatgttcccttttattctatgaagaatagaaagtgtatctgagccatgagtaattttaaaagaaaggaagggaagaagggagcaaagggggcagaaagggagagaaaaaggaaggaaggaaggaaggaaacttccttttgataatcatctttcttgatggaaaaaataatgtacaaaatttaaaaataagaacaatttttggaaagtgattgttgattctggaaaagaaattctgaacagtgaagagatctttaaagataaacaaaactgaaacttaaatatagaggatctctatgaagcttgagaga

SEQ ID NO: 728393 - DNA, 458 bp, Homo sapiens
gaagaccaaaagagccaggaagagagaaatgggacgccatcaaaacttgcagaaaaacttgagaatatgagactagttcccagccacagcattcacataaatctctcaccataacccaggcattatgctaagcactttatattatcttatttcatccccagaacaaccccgtgagataggtattattatccccattccatgggggataactaaggcacggaagttactaaacttgtccagtgcctcataacatggtctcaagctcttaacaaatggagcccaggattcaaaaatctgaactctaataatggcttgtcattctggtttcttacccttgaggaacctgtgaggtgttaaccaacctgtaagctgcattccagcactggcaaacctggcctctcaaatatccagccaattctaagtttggtgccaggaacacagactccatccaacccctt

SEQ ID NO: 728394 - DNA, 441 bp, Homo sapiens
ctggctcttcctgcccaaagacgggccacagagtctccccgtgctcccttccaacctgttcccattgacgccaactttcaccatgctggacctgaaccagcccgaaacagtctccagggaagctatgcaccagggagaggaggcaagtccaaggcctaccagatggggaaagcagcagcagcggcagttgagtgatcagacacttgagtctcccgggaccctgacaccgtcctgggaatcaccttcttatgtggccacactgtggactgtcaactatacctgcctggattaaacaagcatcttttgaggacttgcaacctgggaggcagggattatcacgtccccattttacagacgaggagcactgagccccagagaagtgcagtggcttgcccaagtccatgtaattgaggtaggatacaaatcctggtagaatcctga

SEQ ID NO: 728395 - DNA, 562 bp, Homo sapiens
gcacgaggccggtaaccgggccctttccacctccgcctccatgttcagtttaaatattaatcttgctctatctagaaccccaagaatcatctaagctgactcttaaattatatccaaaaacttacggttgtgatattcaaatgtataaacagacagatgtaagacattaatagaaaagacattgtatccaaaacaccattaagaaaattaaaagacaaaaattaaactgctaaaaagattgcaacaaaatgtccaaatttatatttaaaaagtttttgcaagtcaataagaaataatattactaacctaatacaaaaatgagcaaagaacatgagctggcaaattatgaaaaaagaaatacaaatagctaataaataggtagagaaaagtttgacctcaattgtaataaaaaggtcaaattaacaaaaaaaattggatgtcattttcatctctcaaattgctgcccctaaaaaaaaaaaagctgatagtatctagtttcataaagaactcagagaaatgttattttcatccattactggtaactctgatgacccttccagag

SEQ ID NO: 728396 - DNA, 448 bp, Homo sapiens
tcctgcccttcatatttctcaaaggtagacttaataaaggtagaagagacatttctaatttttctatatatctcttgctccctaatttctaaaaggcataactaaaatgctttattcgagccactcccttgcatctgaaccctacctaccaagtaggttaagagtaggttaggtaaggtctgtagctacttctttctttcagttacaaattgtaggtgggaaagaaggatgcggaaggaaacttgcaaggaaagcaaacagaaagaaaaagaagtaaaaaaggagagaagggaatttggtgggtggtccaaccatcaaaatgtggtactaatgccataggtatctacaccacttatgtaagttggaatgttgatgcattccaacgcatgtttttatctttgtactgaaagcccttaagaatacccgaagtaaacatataaaaagtaaa

SEQ ID NO: 728397 - DNA, 490 bp, Homo sapiens
caatcggtttctttgctttgctaagaagagatctcttcaagatcgataaaacagtgacctctgttgggcatttactcaagttttgtttcgtgcataacatttcaggacccgcctgttggggaaagtgaggtcatccattcttcaccgattgtctaaacagagagacggtggtcctctgccgcggtgggattctttggtgtgaaaatgaaaatgggggaggatggctggatggtttcatttttagtgctctcctgtcttaagcaacgtaggcactcctgaaccaagttctctttcctgcatgaaacgaagccactgctcccagctccgcagccgtgcactgtgatccgtctatgtaatgtgagcttgcttttactcaactatctattttttagaaaatacaattcaataaatttcaagtacttgaactgagtgacacaatacaacacacagatttatcttttcaataaaaagtgttttttaaatagaaaaa

SEQ ID NO: 728398 - DNA, 350 bp, Homo sapiens
agagactaaggacgctaggtgggcagggctcttcacttgcaggtgcgcctgtgtgctgtgagttgctgggggttgtagaatgcttttggtggacagagggaaccaggttgcaatgtgagaacatttttatgaatttctgggaaactgccttaagatctattccaagagagacacctggttcttctcacctaacttgttgggtttccttttctcactctaaatattcactttaaggccgggcactgtggctcatgtctgtaatcctaatgctttgggaggctcaagcgatcctcggccttccaaagtgctgagattacaggcgttaagccactgagcctggctaaattaaa

SEQ ID NO: 728399 - DNA, 635 bp, Homo sapiens
ggagatacatatcagagaacatttgtacaattccccatgaaaattgctccaaagttgataacaatatagtcggtgcttctagttatatgcaagtactcagtgataaatggattaaaaaatattcagaaatgtattggggggtggaggagaataagaggcagagcaagagctagagaattggtttccttgcttccctgtatgctcagaaaacattgatttgagcatagacgcagagactgaaaaaaaaatttactttgatctctgtttttgaattcttattatttatattttgcttactaccttttttgccttttgtccttttgtggagagggcgatgaattaagagtagtggggtgggtggcgagtaagtaaaatttcaaatagcattttagtgaatgcaattcagtagtcctgaagcctgacttaataaaacaaaattcatttatggttgtttcatgaaagttattagataggatcaagttttgtttgtatattgtttgccttgctctggttttgcttttgtgcttaggcaagtgcaaaatactctatggaaatcataattgtcatcttcttcatggtgttagggatatattgtcacatgatttcaataaatccttttttgctttaaaaaggaa

SEQ ID NO: 728400 - DNA, 357 bp, Homo sapiens
agacctagaaatagcaactaaagagggatgagaaaaaaatatcataaaggtcaagggaagagtgcgtcttgagaaagaggatatgtccatgtattgccaaagcttaaggatattttctcttttcagaatatggcaacagatttctgaaagtaaatgtttcccatttcctaagtaccatacctaccaaaagacatcagaaatatagtcagatcttactgatcaacttctccatccaagtgatcactgttacttaagggctttcaatttttttttttgaccatgatccacagggaaaagaaaaatacattttatattgtgattcagctcacaaaatataaaactatctaacatattaaa

SEQ ID NO: 728401 - DNA, 541 bp, Homo sapiens; identical to SEQ ID NO: 273322

SEQ ID NO: 728402 - DNA, 517 bp, Homo sapiens
tgctcacttccttttctgtaaaaggagctctttgatccaaggtgacatggtatgggatccaatgacaataaatcagttattctgtgaaccctgatcaaaacttgactcaacttttgacagttaggttttttcctgaccacagactcctcacctttcttttcttagaaaatttacattggaaaacagatgtaaattttctccagcctcttgcaaggtttacagtccaggactttgaggtcctgggagtcatccttttgaaatacaatcatcaaagaagatagtgctccaatctcctagtctctgtgggagggttggaacctaacttcagtaaactaatcaccaattagcaaacacagaggggctgatcatactgacccactttcccactaaaatgtctagtactttccaccagctcaccacagtgcttaaaaactctcctgtcttttgttttactagagttgagtccaatctctttcatctattgcaatagtgttgaataaagtcttccttgcctaac

SEQ ID NO: 728403 - DNA, 1417 bp, Homo sapiens; identical to SEQ ID NO: 21

SEQ ID NO: 728404 - DNA, 216 bp, Homo sapiens
taggattccccccccaaccagaaaccaaacttaaaaactaggaacttccagtccagtctgtatccctagatgtaagattcttacctggataaattgataatgctgcgaaacaaagtgacctagaaatccagctaatcttatcagtgctcgtttttaattgagaaaatctaattactcagataattgtggagcgtgttgcatactcttaattactgt

SEQ ID NO: 728405 - DNA, 1005 bp, Homo sapiens; identical to SEQ ID NO: 249068

SEQ ID NO: 728406 - DNA, 871 bp, Homo sapiens; identical to SEQ ID NO: 248300

SEQ ID NO: 728407 - DNA, 454 bp, Homo sapiens
ttttcctttggaggctgaagaaaagaagaatggtattcatgcagttcccattttacagatgaaaacaagaggactttttctgtgaagtcaagaaagtggttacaatggtactttcagcctgtccgaattatgtattgcccctcccctttttattaataacattgaagtgtgatgggacaaccactgaagccgtctgttgaaacctgctgggactttttagccattctcttcaacataaagaatgggtgtttttggagggggtgagaggaatggggaaatgttgtcaaagagtacaatgttttagttgagacaggaggaatatattttgttgagatctacagcacagcatggtgactgtagttaacaatgaagtattgtgtatttccaaattgctaagacaataaatttcaaatgttctcaccacaaaaaagataggttttgaggtgatgaatct

SEQ ID NO: 728408 - DNA, 1500 bp, Homo sapiens
gagtgggaatctcaaagcagttgagtaggcagaaaaaagaacctcttcattaaggattaaaatgtataggccagcacgtgtaacttcgacttcaagatttctgaatccatatgtagtatgtttcattgtcgtcgcaggggtagtgatcctggcagtcaccatagctctacttgtttactttttagcttttgatcaaaaatcttacttttataggagcagttttcaactcctaaatgttgaatataatagtcagttaaattcaccagctacacaggaatacaggactttgagtggaagaattgaatctctgattactaaaacattcaaagaatcaaatttaagaaatcagttcatcagagctcatgttgccaaactgaggcaagatggtagtggtgtgagagcggatgttgtcatgaaatttcaattcactagaaataacaatggagcatcaatgaaaagcagaattgagtctgttttacgacaaatgctgaataactctggaaacctggaaataaacccttcaactgagataacatcacttactgaccaggctgcagcaaattggcttattaatgaatgtggggccggtccagacctaataacattgtctgagcagagaatccttggaggcactgaggctgaggagggaagctggccgtggcaagtcagtctgcggctcaataatgcccaccactgtggaggcagcctgatcaataacatgtggatcctgacagcagctcactgcttcagaagcaactctaatcctcgtgactggattgccacgtctggtatttccacaacatttcctaaactaagaatgagagtaagaaatattttaattcataacaattataaatctgcaactcatgaaaatgacattgcacttgtgagacttgagaacagtgtcacctttaccaaagatatccatagtgtgtgtctcccagctgctacccagaatattccacctggctctactgcttatgtaacaggatggggcgctcaagaatatgctggccacacagttccagagctaaggcaaggacaggtcagaataataagtaatgatgtatgtaatgcaccacatagttataatggagccatcttgtctggaatgctgtgtgctggagtacctcaaggtggagtggacgcatgtcagggtgactctggtggcccactagtacaagaagactcacggcggctttggtttattgtggggatagtaagctggggagatcagtgtggcctgccggataagccaggagtgtatactcgagtgacagcctaccttgactggattaggcaacaaactgggatctagtgcaacaagtgcatccctgttgcaaagtctgtatgcaggtgtgcctgtcttaaattccaaagctttacatttcaactgaaaaagaaactagaaatgtcctaatttaacatcttgttacataaatatggtttaacaaacactgtttaacctttctttattattaaaggttttctattttctcc

SEQ ID NO: 728409 - DNA, 1062 bp, Homo sapiens
gagtgggaatctcaaagcagttgagtaggcagaaaaaagaacctcttcattaaggattaaaatgtataggccagcacgtgtaacttcgacttcaagatttctgaatccatatgtagtatgtttcattgtcgtcgcaggggtagtgatcctggcagtcaccatagctctacttgtttactttttagcttttgatcaaaaatcttacttttataggagcagttttcaactcctaaatgttgaatataatagtcagttaaattcaccagctacacaggaatacaggactttgagtggaagaattgaatctctgattactaaaacattcaaagaatcaaatttaagaaatcagttcatcagagctcatgttgccaaactgaggcaagatggtagtggtgtgagagcggatgttgtcatgaaatttcaattcactagaaataacaatggagcatcaatgaaaagcagaattgagtctgttttacgacaaatgctgaataactctggaaacctggaaataaacccttcaactgagataacatcacttactgaccaggctgcagcaaattggcttattaatggccacacagttccagagctaaggcaaggacaggtcagaataataagtaatgatgtatgtaatgcaccacatagttataatggagccatcttgtctggaatgctgtgtgctggagtacctcaaggtggagtggacgcatgtcagggtgactctggtggcccactagtacaagaagactcacggcggctttggtttattgtggggatagtaagctggggagatcagtgtggcctgccggataagccaggagtgtatactcgagtgacagcctaccttgactggattaggcaacaaactgggatctagtgcaacaagtgcatccctgttgcaaagtctgtatgcaggtgtgcctgtcttaaattccaaagctttacatttcaactgaaaaagaaactagaaatgtcctaatttaacatcttgttacataaatatggtttaacaaacactgtttaacctttctttattattaaaggttttctattttctcc

SEQ ID NO: 728410 - DNA, 1889 bp, Homo sapiens; identical to SEQ ID NO: 257616
  misc_feature (1)..(2): n is a, c, g, or t
  misc_feature (6)..(7): n is a, c, g, or t
  misc_feature (9)..(9): n is a, c, g, or t
  misc_feature (1843)..(1843): n is a, c, g, or t

SEQ ID NO: 728411 - DNA, 1328 bp, Homo sapiens; identical to SEQ ID NO: 257617
  misc_feature (41)..(41): n is a, c, g, or t
  misc_feature (1282)..(1282): n is a, c, g, or t

SEQ ID NO: 728412 - DNA, 1678 bp, Homo sapiens
  misc_feature (1)..(2): n is a, c, g, or t
  misc_feature (6)..(7): n is a, c, g, or t
  misc_feature (9)..(9): n is a, c, g, or t
  misc_feature (1632)..(1632): n is a, c, g, or t
nnagcnncngtaaggatagcatcaactggcaaacggagaaggaggagaacagagtggagaggaaccctgttaggagaaattgagcggcattccatctggtaggcaagtttgcatttctcctttttgggatctgcccaggaatgttgtcaagtgtaatggctcccctgtgggcctgcatcctggtggctgcaggaattctagccacagatacacatcatccccaggattctgctctgtatcatctcagcaagcagctattacagaaatatcataaagaagtgagacctgtttacaactggaccaaggccaccacagtctacctggacctgttcgtccatgctatattggatgtggatgcagagaatcaaatattaaagacaagtgtatggtaccaagaggtctggaatgatgaatttttatcctggaactccagcatgtttgatgagattagagagatctccctacctctaagtgccatctgggcccccgatatcatcatcaatgagtttgtggacattgaaagataccctgaccttccctatgtttatgtgaactcatctgggaccattgagaactataagcccatccaggtggtctctgcgtgcagtttagagacatatgcttttccatttgatgtccagaattgcagcctgaccttcaagagcattctgcatacagtggaagacgtagacctggcctttctgaggagcccagaagacattcagcatgacaaaaaggcgtttttgaatgacagtgagtgggaacttctatctgtgtcctccacatacagcatcctgcagagcagcgctggaggatttgcacagattcagtttaatggcacttcttcaccatctgcatggccttcttggttctcagcttagctaagtccatcgtgttggtcaaattcctccatgatgagcagcgtggtggacaggagcagcccttcttgtgccttcgaggggacaccgatgctgacaggcctagagtggaacccagggcccaacgtgctgtggtaacagagtcctcgctgtatggagagcacctggcccagccaggaaccctgaaggaagtctggtcgcagcttcaatctatcagcaactacctccaaactcaggaccagacagaccaacaggaggcagagtggctggtcctcctgtcccgctttgaccgactgctcttccaaagctaccttttcatgctggggatctacaccatcactctgtgctccctctgggcactgtggggcggcgtgtgaagactgaagtgttcttcagtaattgtgctggcacttaggagagagaggagggggaataatagtgggttaaaaagctttctgggtcgggtgtggtggttcttgcctatagtcccagtgctttgggaggccatagcaggaggattgcttgagcccaggagttcgagaccagccagagcaacatagtgagaccacatctctaccagtaaataaataaataaataaataaataaataaataaataaatagctgggcatagtggctcatgcctgtactctcagctacttgggaggttgaggtgggaggattgcttgagcccaggatttcaaggctgcagtgagccatgattgcaccactgcaccccagcctgggtgacagancaagaccctgtctcaaaaaaaataaaataaaaggctttctgccttc

SEQ ID NO: 728413 - DNA, 1539 bp, Homo sapiens
  misc_feature (41)..(41): n is a, c, g, or t
  misc_feature (1493)..(1493): n is a, c, g, or t
cactcgttatgcaagtgtcaatattaaagacaagtgtatgnacaagaggtctggaatgatgaatttttatcctggaactccagcatgtttgatgagattagagagatctccctacctctaagtgccatctgggcccccgatatcatcatcaatgagtttgtggacattgaaagataccctgaccttccctatgtttatgtgaactcatctgggaccattgagaactataagcccatccaggtggtctctgcgtgcagtttagagacatatgcttttccatttgatgtccagaattgcagcctgaccttcaagagcattctgcatacagtggaagacgtagacctggcctttctgaggagcccagaagacattcagcatgacaaaaaggcgtttttgaatgacagtgagtgggaacttctatctgtgtcctccacatacagcatcctgcagagcagcgctggaggatttgcacagattcagtttaatgtggtgatgcgcaggcaccccctggtctatgtcgtgagtctgctgattcctagcatctttctcatgctggtggacctggggagcttctacctgccacccaactgccgagccaggattgtgttcaagaccagtgtgctggtgggctacaccgtcttcagggtcaacatgtccaaccaggtgccacggagtgtagggagcacccctctgattgggcacttcttcaccatctgcatggccttcttggttctcagcttagctaagtccatcgtgttggtcaaattcctccatgatgagcagcgtggtggacaggagcagcccttcttgtgccttcgaggggacaccgatgctgacaggcctagagtggaacccagggcccaacgtgctgtggtaacagagtcctcgctgtatggagagcacctggcccagccaggaaccctgaaggaagtctggtcgcagcttcaatctatcagcaactacctccaaactcaggaccagacagaccaacaggaggcagagtggctggtcctcctgtcccgctttgaccgactgctcttccaaagctaccttttcatgctggggatctacaccatcactctgtgctccctctgggcactgtggggcggcgtgtgaagactgaagtgttcttcagtaattgtgctggcacttaggagagagaggagggggaataatagtgggttaaaaagctttctgggtcgggtgtggtggttcttgcctatagtcccagtgctttgggaggccatagcaggaggattgcttgagcccaggagttcgagaccagccagagcaacatagtgagaccacatctctaccagtaaataaataaataaataaataaataaataaataaataaatagctgggcatagtggctcatgcctgtactctcagctacttgggaggttgaggtgggaggattgcttgagcccaggatttcaaggctgcagtgagccatgattgcaccactgcaccccagcctgggtgacagancaagaccctgtctcaaaaaaaataaaataaaaggctttctgccttc

SEQ ID NO: 728414 - DNA, 750 bp, Homo sapiens
atagatcccccggtgatgcagatgtggctggtctgggaacactgctcttcccatccttgctctctgctgcatcacccagaaagcagcaacagtgggatgcagtcagaatgagctcctgctccccagctcatgcagctgcacccagtgttcctctacctcttcttggacacgcagcctgtggcgccccctgcttcagcaccagaccccacaccctcactttgcagggtgtggttcctctctccctcagcaattccactgacttatttccagcagcaaatacacatgctgttatttctcccatctttagaacacagctttcctagccccatatcccttaagcggctgctcaagttttcttgataaccagtcccccaattcttctccgatccttcctcttgtaactgctctgaagtctactgctgcagagtgccctaatcacaagcctgtggttccatccatttttacccagtgaacacacttatggaaaagcacttagtccacagcgcagaaaatgcctagcaccttggaagccccctgcacccccttccagtgttaccctcccaggagcatcaggatcctgccttccaaaaactgcaaggagctttgcttgtttctgaacttccataaatgaaatctgacaaaatgtacttttgtgtgtctggattcttcaactcaatgttaggtctgtgccgttcactcataccattttgagtagctgtagtctgttcattcagtaagtcttgtgaatat

SEQ ID NO: 728415 - DNA, 1404 bp, Homo sapiens
cagtcctgggaattgagtcgggaggctggcaagggagtgagacctcctggggctggcacgtgctggactcccctctagaaaagagaaggacccgtgagggagagggcagaggcacttactgctcccgttgactgtaatctgcccctggcaaaccaggcttttcttgggctctggccgcatgcccagctgcgtgtctagtctctcttctggaagagttgggcaactggctctccagaggtttattttagggtcccagtgcttctttgaggacacagcagaaaactaaggggcagctgacaggcttctggaacagctgacaggctggggaggctgaaggctaagactttcaaccactagatcacactgaattccagtcctaggtgaacactgatctctccctttgaggaggtgactttctgcaactagaggctgagctggagtgtctgaggctctctttgctttttggatggttgtggtccttatgattggaagaaaaaaagaagggattccattttcaatacacatttataactcctgccagtaacagacactgttgattggggcacccattcaatgttttctaatcctccactgtatctacatataactttgtttgaaagaggagactgaggttcagggaggttgggatggcgggatggcaggttgtcaggccccggtgatggaggccaacccctcccgtggctctgtgctccagtgtggtagatgtctaagactctcaaatatagaactagatcagcaggcagagctgggggcattggggcaagctgagagtcactcttgtctggctgagtgctgggacagaaaaggctgagggagggaagtggaggcccaggcttgcccatggtggtgttagagggatgcaagacaggttccagggctcggatggcctcaggagcaagcagggctcccttggctgcctctgctgctgtcacgccagcccaaggctcctgccccagggaggttactgttactgctgtagttgccaccacctgttgctcctgagtggatgctaggccttccagggcagccagttacagtcagcctttccctggtgctcaggaaggattaggagaggtggtctcatggcctgaacagcccatgaaaggcagaactgagagactggggaggaagtgaaagtcctcccagctcagaaggaaatgcagagaagtagaaatacccagcccctctcccacacccacacagactcagcccacaaactggagagtaaaaataaagaaatcgtacaggaagcatggagcaaatgactgtgagatgtttcgctttagagaagtgaggagcagagggggagcagaggctggagttggctgagaggggaaatccgcaggtacagcctgcggggctcttagagcccagaggtttgtt

SEQ ID NO: 728416 - DNA, 1248 bp, Homo sapiens; identical to SEQ ID NO: 258206
  misc_feature (20)..(20): n is a, c, g, or t
  misc_feature (29)..(29): n is a, c, g, or t
  misc_feature (36)..(36): n is a, c, g, or t
  misc_feature (39)..(39): n is a, c, g, or t
  misc_feature (57)..(57): n is a, c, g, or t

SEQ ID NO: 728417 - DNA, 212 bp, Homo sapiens
tagtaggagggagcctagactttaaacttgattgttgataacttatggaatatgtaggtaagttgctactgaaaaatataggcagcttgataaaacacagtggctcataatcaagtgctggctaatgtcagcatctagaacagcttcttacctatgacagatgttgaactgatgttgagtttaatgtccgtagttaaagtcaagcagttagc

SEQ ID NO: 728418 - DNA, 702 bp, Homo sapiens; identical to SEQ ID NO: 262017

SEQ ID NO: 728419 - DNA, 476 bp, Homo sapiens
atatgctgtctaaatttgccttgggaaaccatcatggtggtcacaaaaccacttctacggcttgccttgacctagcaggaatgaagatataaagaaagaatgagcgcgtcatggttatgatgggatgatgatgtctgttgtgttgtttggtgtcagtttctgtaacgcctttctatttcaatcaaggctattaacttttcctctgttttagtgaagtttccttgaagtagaaaatgggagtgtattgggcatctcagagttttcagctgaactgaagggtctgatggtaactttacccccaaatccctgagagaaaagcagggggtccctgcttcagctctgctcagaagagcctccctcacatggtggtttctgtgtcactagactggttaaccaaatggttcttctaaatacccaacttttaatagaaactcttgcggcttggattattaaagtcctaacatgcttatttaatc

SEQ ID NO: 728420 - DNA, 329 bp, Homo sapiens
caggacgcggtcgtcccaactccttccgagtggaaagagtgtaaaacttttgtccgtgcgcgggtggagctcagtaggaccacggcgcgtcctgccccggcttccccagcctcccagcagggttagctgcggtcagcgcactttccacttgggactcccggccagaaatttctcgggaatggagcggtcacagtgtggcagcagagaccgaggcgttagcggccgacctcacttggcccctgggctagtggtggctgcccctccgcccccgtccccggcgttgccggtaccatcggggatgcaggttcccccagcgttcctgcggccgc

SEQ ID NO: 728421 - DNA, 752 bp, Homo sapiens
tgcagtgggaataccaggggtgggcactgtcaagagacccagctttgacttcaaatgccacccagagggacaactgctcactttcagagcaggagcaggaggccagaggagagtgtgagtctaacatctgcacagtgagaagtccaggagaagcaaaaatgagatccaggctggagcggctgtgccagagggtccctatgatccagacctcaagagagggttcctggacctcccacagaaagggattcaagaccagctgaaactgattagagccaagatagccaaccaaatgacttcaggaagacctcaggcttcattatcatctcatttccatgctaaaaaaacccagctccctagaacaatgggaaatattgggcacttcatcaggcgagttcaggtgcatttctagagattgtccaggtgctggtaacaataatagagaaccatccatatccacaagaggcagaacctcttccagcaaaatggtgctgcctcacccaaaggtcacactggcattagcccctcatcctctggagttcatctcatccaggcgaagacagctggctggcctcagagggtgagacgcaactcgagggtaaaaacatttttacagggcatggacacaaaagtggcctttacctctggataagcttttaaaacttcccatttacatgtaaaggtgtactttctatgtgccaccaagaaacctaaagtgagtaaaaggtgtttcactttaatcaagttccccaatg

SEQ ID NO: 728422 - DNA, 413 bp, Homo sapiens
tgcagtgggaataccaggggtgggcactgtcaagagacccagctttgacttcaaatgccacccagagggacaactgctcactttcagagcaggagcaggaggccagaggagagtgtgagtctaacatctgcacagtgagaagtccaggagaagcaaaaatgagatccaggctggagcggctgtgccagagtaactgttccagcgggtgtgggggagggtcccccaaaaagacttacctggactgaatgggaaataatagaaaataggagcaagagactgtcactttataataggttctgttatgacctcctacaacaatatgttagaaattatgatttctaatatgtctatgatacagatagacatatagttagaaaactaaataaagagacagattttgagctaggtatact

SEQ ID NO: 728423 - DNA, 948 bp, Homo sapiens
tgcgcgcaggcgtagttaagagagcgcattttgacttcgaggcaccgccgacgttactgtgtcgccatggggcgccgtccagctcgctgttaccggtattgtaagaacaagccgtacccaaaatctcgtttctgccgaggggttcctgatgccaagatccgcatctttgacctgggtagaaagaaggcaaaagtggatgagttcccactcggtggccacatggtgtctgatgaatatgagcagctgtcttctgaagccctggaggccgcccgtatttgtgccaacaaatacatggtgaaaagttgtggcagagatggctttcacatgcgagtgcggctccatcccttccatgtcatccgcatcaacaagatgttgtcctgtgctggggctgacaggctccagacaggtatgcgaggtgcctttggaaaaccccagggtactgtagcccgggtccacattggtcaagtcatcatgtccatccgcaccaagcttcagaacgaggagcatgtgattgaagccttgcgcagggccaagttcaagttccctggacgccagaagattcatatctccaagaagtggggcttcacgaagtttaatgctgacgaatttgaagacatggtggccaagaagtgcctcatccctgatggttgtggagtcaagtacgttcccagtcatggccccttggacaagtggcgggttctgcactcatgaaggttttggcagtactgtctccttgggccatgctggtctgacttatgcttactaataaatctgtttactggcaaaaaataaattttccaggggatcggcaaaggggaactcgggggggccgaccactttggccttaggagggagaaaccgccgcgggaatgcacaacgctggatggcgacgccacacaaacaaacagaaagaatatataaaaaaaaaaatatataatcaaatacatc

SEQ ID NO: 728424 - DNA, 713 bp, Homo sapiens
caataataaaaacctaaaaaaaaaaaaagactgctatgtaatcttgtgtcttttctttctctctctctctttttttttgagacagggtcttgtcctgtcacccaggctggagtgcagtagtgtgatcttggctcactgcagtctttccttgctgggcttaagcgatcctcccaccttggtctcccacagtggtgggattacaggtgtgagccaccatgcctggcccaaactattttttaatacagtaaaatgcatttattatcatggcttagatttagtgaatgtgtaggagtgaaagtctactgagagaataaatctagtaatttaatgaactttcttcatagcttcataagagttagttaattatgatttcttaattcattgcccaaagaatgaattactggaattcattatattttttttttgaaaaaaaaaaactaagttagctgcctgtgtgtgtgtgtgtgtgtgtgtatgtatgtatctatgtattctagagaaatatatattatatgcatccagagatgtgtaaaatattctctatcagtaggagaatagattaataaattgtggtgtaatcatatgctagaatactatacagcagtaaaaaaatgaactagagctgtacacaataacatggatatatcccacagacatgatgttgaaagacagatatggcctgggtttgttagctcatgcctgtaataccagcc

SEQ ID NO: 728425 - DNA, 1095 bp, Homo sapiens
aaccagaggcgcgggtcacagagacctagaacagctggaatccttcgcccccggcgcgcagccttcgcccgccggaatcgctgccttatccaccagcgggatgcttacctcgcccgccctctcgggtcaggcgggcccgggaggatgggagggtggctgctgagcgggagccgccacgtcttccacccgacatattgcctagagtttgctgtgacttagatcttgattcagagatggagaaatcaggcccatcttctaccatctctgagcagcagctgcagaggcaagagggatggattaacaccaaaacagacttggctgagcagagtctcatttcatctgagaaatggcttcaactgcatgggcttaagagcaacaaattgaccttgaaacagattttgtcacagatcggattcccacattgtgaagattatgtggcgtctctggggagacctgtggcttctcggtatgctgatggtctgtttccacagctctacagagcagaagatggcagagtatacaatctgacagctaaatcagaactgatttatcagtttgtggaacatttaacacaagctgtggagagctacaagcagcgaatggactggctcaccagcaagagccggcagattttggtgtcatcttggaacagtgcgtcaccatagtgctggattttggcggcattctggagggggagcttgatctgtgccgagaggctctaacaatggttctccaggagcaggtggctcacataaccgagttcaatatcatacgggtttctcaagagcctgtgaagtggcaggaaaatgctactcctgtgaccgaacagtccatagctactgccatcagttgggttgagaaactgacggttgagctgactgtgagcgaggctggccgcctggatgctctgctggaagccgggagagacaagactttactcttcttcacagatggatctgtcatctgtcacacactttccaaggtgaagtacgcgcaagctgatgactccatccatttttggatgtcaatgtattgacatgaattttgatagggacatttttggaaataaagctttacctggaagaagtgattaga

SEQ ID NO: 728426 - DNA, 1212 bp, Homo sapiens
aaccagaggcgcgggtcacagagacctagaacagctggaatccttcgcccccggcgcgcagccttcgcccgccggaatcgctgccttatccaccagcgggatgcttacctcgcccgccctctcgggtcaggcgggcccgggaggatgggagggtggctgctgagcgggagccgccacgtcttccacccgacatattgcctagagtttgctgtgacttagatcttgattcagagatggagaaatcaggcccatcttctaccatctctgagcagcagctgcagaggcaagagggatggattaacaccaaaacagacttggctgagcagagtctcatttcatctgagaaatggcttcaactgcatgggcttaagagcaacaaattgaccttgaaacagattttgtcacagatcggattcccacattgtgaagcttgaagaattccctttagcatttcttataaggcaggtctggtagtgatgaactccctcggcttttgtttatctgtgaaagtctttatctctccttcatttgggaaggacagctttgattatgtggcgtctctggggagacctgtggcttctcggtatgctgatggtctgtttccacagctctacagagcagaagatggcagagtatacaatctgacagctaaatcagaactgatttatcagtttgtggaacatttaacacaagctgtggagagctacaagcagcgaatggactggctcaccagcaagagccggcagattttggtgtcatcttggaacagtgcgtcaccatagtgctggattttggcggcattctggagggggagcttgatctgtgccgagaggctctaacaatggttctccaggagcaggtggctcacataaccgagttcaatatcatacgggtttctcaagagcctgtgaagtggcaggaaaatgctactcctgtgaccgaacagtccatagctactgccatcagttgggttgagaaactgacggttgagctgactgtgagcgaggctggccgcctggatgctctgctggaagccgggagagacaagactttactcttcttcacagatggatctgtcatctgtcacacactttccaaggtgaagtacgcgcaagctgatgactccatccatttttggatgtcaatgtattgacatgaattttgatagggacatttttggaaataaagctttacctggaagaagtgattaga

SEQ ID NO: 728427 - DNA, 666 bp, Homo sapiens
cggggaggctgcgccactgggaggctgcgcagactgttgaagggggcacaggaacgtggaattggtgttggaccaaatgaaactgccaacacctgccctcaaaactggggagttcccagtggctgaaccgaggatttccacaatggggggcactgttctaaaaagagaaggttgagggcctagaccgttgagttgtaatcattcacaaaaccttttccatggaattctgcagctggcctgggaaggctgtgcacggtggccacacggtgctgcggtgaagtctaaggggctgttcaacgtagcacctacatttggggaattacagatgccacagcctgcagggaggcacccacaactgtctcccccaaggtaaagacgactgtccttcacttacgacacaccgggttcctgcacagcgatggcctggagcatccagagaagggtccctgctctcagagccggccaggcgggctgtgtacacggccacggaaagcacccttgggggagggtgttgctgtgatttctgcacccccacttcctcacgtcctgcaacctagctagaatctgcaatcaaaagctacccagctttggaaggctgagtgggatcacttaaggccaggagtttgagtccagcctgggcaacacagcaagttcccgtctctgaaa

SEQ ID NO: 728428 - DNA, 230 bp, Homo sapiens
ttttttttttctttctttctttctttctttttctttctttctttctttctttctcgctctcgctctctccctccctcgctcgttttctctctctctcgctcttgccctctcgctctctccctcgctcgttttctctctctctctctctctctgtctctcgctctcgccctctctctctctgtctctctctctctctctctctctctctctctcccttctgtcgtcttctc

SEQ ID NO: 728429 - DNA, 473 bp, Homo sapiens; identical to SEQ ID NO: 211840

SEQ ID NO: 728430 - DNA, 486 bp, Homo sapiens
gaaaccacactccacttagaacagggtttgagaggcttagtcagcactgggtagcgttttgactccattcttggctttcttctttttcttcccagaaggatttttgtgcagaaatgggtcttttgttgccgtgttagtcctccttggaaggcagctcagaaggcccgtgaaacgtcgggggacaggacccccagggagggaaccccaggctacgcactttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcaacttttgtataagtctccacttggtggcagcagcttgctgatgacttgttttaaaactttcatcctaaat

SEQ ID NO: 728431 - DNA, 2180 bp, Homo sapiens; identical to SEQ ID NO: 224662
  misc_feature (1532)..(1532): n is a, c, g, or t

SEQ ID NO: 728432 - DNA, 429 bp, Homo sapiens
tatttgcaatcacagatctgaagtttatcaatacatgatctcctcaaaaacgaaaggaataaaacaagtatctgcaatttgctgagaacttaatatgtgtcagttgcctgcaaaactcatcattctttagactttcaaatacatctgtgaggacggtattgttgtttccacttacacatgagaaggcaagagacaagcccacggtcacccagctggaaaactaagctccatgagaagaggggacttgcccatgtggctcagggctctatgcccagtgccctagacagtgcctgactgtgtgtgcggaatgaatgaataaccttggtgatccacccaatggcactggcgctcagtgacctcatctgaaatggaataaggattttatgaaaatgcatgtttgttgaataacacaaaggagaatattatcta

SEQ ID NO: 728433 - DNA, 1062 bp, Homo sapiens
ggccctaaccgctcccgcatccctcgcctgcacagtgggcagtctggcgcctgtggcgtcgtgtttgctgagggcccggctgccgttgactgaggctgcgatggcggcggcaggccggggtcgggagcaggactcggcgcgcttcgtctatgtgacgcgcttcggctcgcatcagtgcagtggcgtcctgcaactgggcggccgtggagctcaaggcctttggggtcaggggcctggggcaggctgtcgccaggagaagccgagggaagcaatggcggtggcgggcgttcagggtggcagcgagctgcccctcggttcccagctcagggtccccacgacccctggtgtggaggctgcggcctctgcctcctcccagctgcgggcatcgagagttcagagcggcaccagacagtcggcgcgtgcaggtttaatccagaaggatgcagctaaaaagtatgattttcccataccattgaatgaagcttccaaaataatgaagaaaaagaaaaaggttttagtatggaatagagtatacaaagtcatttcaagaatgcttgaagaaaatgaaaaatatagacacaggctgaaatgccaaaggttatctagtgaaagctcaaattacacaagatgaatcttcttatcttctggaataacctatctttggatgtttcccaaagaagagtatgaagaatctaaagatgaaacattaaatgaatcataattatttgttacttttgatgtgttttattagaattgggactttagtagtcgaacagaaaaattaccttctttataaattaataatatttctttgctacttaataatacctttagttaaatattgttaaccatatgcatgcaagtgttattttcagaattaatgcttattctacatacttttaaattaacctcatacataaaattaaattagcatatcaatgcaattgcatgaattttataattaccagcttttccattttattaatgagtctacaactgctgctttgttcatctcttcttttagatgtaactcttaaattaaacttggattcatttaaatta

SEQ ID NO: 728434 - DNA, 4585 bp, Homo sapiens
tatctgtcgtcctgacttcttgttcattccaatgaatcgatacagactgttagtgcacatcaatatccattttgtcctcttcttttttggcatacaaccaaaacttacataggctttttatcattttactgggcctatgtaactgagttttagccagtggaatatgtccaagtgacatttgccacttctaggtctggcacattaacacttgatgtattacatttcagaccctcttatcattctgcagtgtgtttggcgatctgttgtttaagatctatatgcactggttactgttgcttgccttccattcctacccttactaatcagattcctattatagctacttctgtccttgattcattttgtatattagatgtgtgtgtgttcatgtgcatgcatgcaccctcacatgtaggtgtatatgggagtggtggtaaagacaggatatttcttcagttcatgggattttatttcaggagaattcaaacattcacgtattggagaagatgacacatttcttgaatgtctttggctttgagctgaatgcactaactagaagggacttcagattgtcctccttcgggggaggtaagtatattcttcatatacaggtaagagtgaaatgatagaagaatgttcctcctctccttttcttcctggacaacagatcaaatatttctcagatcttttacagctgaattggagtcacatggacaggtatgatcttaaaatataaaaaattattttaaaattacatgctaaaattttataaaaataaatgctaaaactaacttaaacggaagcatttgattaaaaaatttatccaaaaaagtttgaattttatatgaaacaggatagaagatgaaaaagctaaagaaataaaatataaataaattatggctggggacagtggctcacacctgtaatcccagcactttgggaggctgaggtgggaggactgattgaggctaggagtttgagacctgttatttgaggcacatgggaaggaaagttttctttgagatattccacattttataatattcttcaagagatttacagagttccttgagtgaattgttggtttgttcttaatactgaatttcctattcaaatttatttagaagttcatttcttacagtgatctcatctcctattaagatattcttcaaggtaggttcttggccagtttctcaatgacagatttttaaaaatattgttaatctttttattaatatgagaacataattgttccagatctggaggccatcctttaagcttcttgcaacagtctgggagcaaagagtttactcgccactgggtagtgggccatggacaccccagtctccaccagaagttcgggattgcaaaatgggactctggcagcaaatttcaaactgtatgccagacctggccctttgcagtgatataaaatttttcttgaggtgtctggaaagatggctgaataggaacagctctgctctgcagctcccagcgagatcaacgcagaaggagataatttctgcatttccaactaaagtacccagctcatctcattgggactggttagacagtgggtgcagcccacagaaggcaagcagaagcagggtggggtgtcgcctcacccgggaagcgcaaggggtcagggaactccctcccctagccaagggaagctgtgagggactgtgccgtgaggaacggggcattccggcacagatactatgctttccccacggtctttgcaacccacagaccaggagattcccttgggtgcctgcaccaccagggccctgggtttcaagcaaaaaactgggcagccatttgggcagacactgagctagcagcaggagtttttttcataccctagtagcccctagaatgccagcgagacagaactgttcactcccctggaaaggggcactgaagccagggagccaagtggtctagctcagcagatcccacccccacggagcccaacaagctaagacccactgggttgaaattctcgctgccagcacagcagtctgatgtccacctggaatgcttgagcttggtgcagggaggggcgtctgccattactgaggcttgattaggcagtttccccctcacagtgtaaacaaagctgctgggaagtttgaactgggtggagcccactgcagctcggcaaagttgctgtagcaagagtgtctctctagattcctcctctctgagcagggcatctctgaaacaaaggcagcagccccagtcagggacttatagataaaactcccatctccctgggacagagcacctgggggaaggggcagctgtgggcacagcttcaggacacttaaacgttcctgcctgctggctctgaagagagcagcagatctcccagcacagtgctcaagttctgctaagggacagactgcctcctcaagtgggtccctgacccctgtgcctccggagtgggagagaccttccagcaggggtcaacagacatctggtgggtgcccgtctgagacgaagcttccagaggaaggaacaggcagcaatctgtgctgttctgtagcctgcgctggtgatacccaggtaaacagggtctggagtggatctccaacaaactccagcagacctgcagcagaggggcctgactgttataaggaaaactaacaaacagaaaggaatagcgtcaacatcaacaaaaaggacatccacacaaaaaccccatccgaaggtcaccagcatcaaagaccaaaggtagataaatccatgaagatgaggaaaaaccagtgcaaaaaggctgaaaattccaaaaaccagaacaccttttctcctgcaaaggatcacaactccttgccagcaagagaacaaaactggatggagaatgagtttgacgaatttacagaaggaggcttcagaaggtgggtaataacaaactcctctgagctaaaggagcatgttctaacccaatgcaaggaagctaaaaatgaaaaaaggctggaggaattgctaactagaataaccactttagagaagaacataaatgatctgatggagctgaaaaacacagcacgagaccttcgtgaagcatacagaagtatcaatagctgaatcgatcaagcagaagaaaggatatcagagattgaagatcaacttaatgacataaagtgtgacgtcaagattagagaaaaaaagaatgaaaaggaacgaacaaagcctccaagaaatatgggactatgtgaaaagaccaaacctatgtttaattgatgtacctgaaagtgctggggagaatagaaccaagtttgaaaacactcttaggatattatccaggagaacttccccaacctagcaagacaggccaatattcaaatcagtaaatacagagaacaccacaaagatactcctcgagaagagcaaccccaagacacataatcatcagattcaccaaggatgaaatgaagaaaaaaatgttaagggcagccagagagaaaggtcggtttactcacaaagggaagcccattaaactaatagcagatttgtctgctgaaaccctacaagccagaatagagtggggggccaatatttaacattcttaaagaaaagaattttcagcccagaatttcatatccagccaaactaagcttcattagcaaagaagaaataaaatcctgagagacaagcaaatgctgagcgattttgtcaccaccaggcctgccttacaagagctccagaaggcagcactaaacacataaaggaaaaaccagtaccagccactgcaaaaacataacaaactataaagaccaccgacactatgaagaaactgcatcaactaacaggcaaaataaccaactagcatcataatgacaggatcagattaacacataacaatattaaccttaaatgcaaacgggctaaatgccacaattaaaagacacagactggcaaattggatagagtcaaaatccatcattgtgctgtattcaggagacccatctcacgtgcaaagacacacataggctcaaaataaagggatggaggaatatttaccaagcaaatggaaaggaaaagaaaaaaagcaggggttgcaatcctagtctctcataaaacagactttaaaccaacaaagataaaaaaagacaaagaagggcattacataatggtaaagggatgaatgcaacaagcagagctaactattctacatatatatgcacccaatacaggagcacccagattcataaagcaagttcttagagacctacaaagagacttagactctcacacaataataatgggagactttgacactccactgtcaatattagacagaacaatgagacagaaaattaacaagaatattcaggacttaaactcagctctggaccaagcagacctacagaactcagaacttgaactcagctttggaccaagcagacatctacacaactctccacttcaaatcaacagaatatacattcttagcagcaccacatcgcacttattctaaaattgaccacataattggaagtaaaacactacacaccgaatgcaaaagaacggaaatcacaacagtctctcagaccacagtgcaatcaaattagaactc

SEQ ID NO: 728435 - DNA, 4480 bp, Homo sapiens
tatctgtcgtcctgacttcttgttcattccaatgaatcgatacagactgttagtgcacatcaatatccattttgtcctcttcttttttggcatacaaccaaaacttacataggctttttatcattttactgggcctatgtaactgagttttagccagtggaatatgtccaagtgacatttgccacttctaggtctggcacattaacacttgatgtattacatttcagaccctcttatcattctgcagtgtgtttggcgatctgttgtttaagatctatatgcactggttactgttgcttgccttccattcctacccttactaatcagattcctattatagctacttctgtccttgattcattttgtatattagatgtgtgtgtgttcatgtgcatgcatgcaccctcacatgtaggtgtatatgggagtggtggtaaagacaggatatttcttcagttcatgggattttatttcaggagaattcaaacattcacgtattggagaagatgacacatttcttgaatgtctttggctttgagctgaatgcactaactagaagggacttcagattgtcctccttcgggggaggtaagtatattcttcatatacaggtaagagtgaaatgatagaagaatgttcctcctctccttttcttcctggacaacagatcaaatatttctcagatcttttacagctgaattggagtcacatggacaggtatgatcttaaaatataaaaaattattttaaaattacatgctaaaattttataaaaataaatgctaaaactaacttaaacggaagcatttgattaaaaaatttatccaaaaaagtttgaattttatatgaaacaggatagaagatgaaaaagctaaagaaataaaatataaataaattatggctggggacagtggctcacacctgtaatcccagcactttgggaggctgaggtgggaggactgattgaggctaggagtttgagacctgttatttgaggcacatgggaaggaaagttttctttgagatattccacattttataatattcttcaagagatttacagagttccttgagtgaattgttggtttgttcttaatactgaatttcctattcaaatttatttagaagttcatttcttacagtgatctcatctcctattaagatattcttcaagatctggaggccatcctttaagcttcttgcaacagtctgggagcaaagagtttactcgccactgggtagtgggccatggacaccccagtctccaccagaagttcgggattgcaaaatgggactctggcagcaaatttcaaactgtatgccagacctggccctttgcaggtgtctggaaagatggctgaataggaacagctctgctctgcagctcccagcgagatcaacgcagaaggagataatttctgcatttccaactaaagtacccagctcatctcattgggactggttagacagtgggtgcagcccacagaaggcaagcagaagcagggtggggtgtcgcctcacccgggaagcgcaaggggtcagggaactccctcccctagccaagggaagctgtgagggactgtgccgtgaggaacggggcattccggcacagatactatgctttccccacggtctttgcaacccacagaccaggagattcccttgggtgcctgcaccaccagggccctgggtttcaagcaaaaaactgggcagccatttgggcagacactgagctagcagcaggagtttttttcataccctagtagcccctagaatgccagcgagacagaactgttcactcccctggaaaggggcactgaagccagggagccaagtggtctagctcagcagatcccacccccacggagcccaacaagctaagacccactgggttgaaattctcgctgccagcacagcagtctgatgtccacctggaatgcttgagcttggtgcagggaggggcgtctgccattactgaggcttgattaggcagtttccccctcacagtgtaaacaaagctgctgggaagtttgaactgggtggagcccactgcagctcggcaaagttgctgtagcaagagtgtctctctagattcctcctctctgagcagggcatctctgaaacaaaggcagcagccccagtcagggacttatagataaaactcccatctccctgggacagagcacctgggggaaggggcagctgtgggcacagcttcaggacacttaaacgttcctgcctgctggctctgaagagagcagcagatctcccagcacagtgctcaagttctgctaagggacagactgcctcctcaagtgggtccctgacccctgtgcctccggagtgggagagaccttccagcaggggtcaacagacatctggtgggtgcccgtctgagacgaagcttccagaggaaggaacaggcagcaatctgtgctgttctgtagcctgcgctggtgatacccaggtaaacagggtctggagtggatctccaacaaactccagcagacctgcagcagaggggcctgactgttataaggaaaactaacaaacagaaaggaatagcgtcaacatcaacaaaaaggacatccacacaaaaaccccatccgaaggtcaccagcatcaaagaccaaaggtagataaatccatgaagatgaggaaaaaccagtgcaaaaaggctgaaaattccaaaaaccagaacaccttttctcctgcaaaggatcacaactccttgccagcaagagaacaaaactggatggagaatgagtttgacgaatttacagaaggaggcttcagaaggtgggtaataacaaactcctctgagctaaaggagcatgttctaacccaatgcaaggaagctaaaaatgaaaaaaggctggaggaattgctaactagaataaccactttagagaagaacataaatgatctgatggagctgaaaaacacagcacgagaccttcgtgaagcatacagaagtatcaatagctgaatcgatcaagcagaagaaaggatatcagagattgaagatcaacttaatgacataaagtgtgacgtcaagattagagaaaaaaagaatgaaaaggaacgaacaaagcctccaagaaatatgggactatgtgaaaagaccaaacctatgtttaattgatgtacctgaaagtgctggggagaatagaaccaagtttgaaaacactcttaggatattatccaggagaacttccccaacctagcaagacaggccaatattcaaatcagtaaatacagagaacaccacaaagatactcctcgagaagagcaaccccaagacacataatcatcagattcaccaaggatgaaatgaagaaaaaaatgttaagggcagccagagagaaaggtcggtttactcacaaagggaagcccattaaactaatagcagatttgtctgctgaaaccctacaagccagaatagagtggggggccaatatttaacattcttaaagaaaagaattttcagcccagaatttcatatccagccaaactaagcttcattagcaaagaagaaataaaatcctgagagacaagcaaatgctgagcgattttgtcaccaccaggcctgccttacaagagctccagaaggcagcactaaacacataaaggaaaaaccagtaccagccactgcaaaaacataacaaactataaagaccaccgacactatgaagaaactgcatcaactaacaggcaaaataaccaactagcatcataatgacaggatcagattaacacataacaatattaaccttaaatgcaaacgggctaaatgccacaattaaaagacacagactggcaaattggatagagtcaaaatccatcattgtgctgtattcaggagacccatctcacgtgcaaagacacacataggctcaaaataaagggatggaggaatatttaccaagcaaatggaaaggaaaagaaaaaaagcaggggttgcaatcctagtctctcataaaacagactttaaaccaacaaagataaaaaaagacaaagaagggcattacataatggtaaagggatgaatgcaacaagcagagctaactattctacatatatatgcacccaatacaggagcacccagattcataaagcaagttcttagagacctacaaagagacttagactctcacacaataataatgggagactttgacactccactgtcaatattagacagaacaatgagacagaaaattaacaagaatattcaggacttaaactcagctctggaccaagcagacctacagaactcagaacttgaactcagctttggaccaagcagacatctacacaactctccacttcaaatcaacagaatatacattcttagcagcaccacatcgcacttattctaaaattgaccacataattggaagtaaaacactacacaccgaatgcaaaagaacggaaatcacaacagtctctcagaccacagtgcaatcaaattagaactc

SEQ ID NO: 728436 - DNA, 1758 bp, Homo sapiens
tatctgtcgtcctgacttcttgttcattccaatgaatcgatacagactgttagtgcacatcaatatccattttgtcctcttcttttttggcatacaaccaaaacttacataggctttttatcattttactgggcctatgtaactgagttttagccagtggaatatgtccaagtgacatttgccacttctaggtctggcacattaacacttgatgtattacatttcagaccctcttatcattctgcagtgtgtttggcgatctgttgtttaagatctatatgcactggttactgttgcttgccttccattcctacccttactaatcagattcctattatagctacttctgtccttgattcattttgtatattagatgtgtgtgtgttcatgtgcatgcatgcaccctcacatgtaggtgtatatgggagtggtggtaaagacaggatatttcttcagttcatgggattttatttcaggagaattcaaacattcacgtattggagaagatgacacatttcttgaatgtctttggctttgagctgaatgcactaactagaagggacttcagattgtcctccttcgggggaggtaagtatattcttcatatacaggtaagagtgaaatgatagaagaatgttcctcctctccttttcttcctggacaacagatcaaatatttctcagatcttttacagctgaattggagtcacatggacaggtatgatcttaaaatataaaaaattattttaaaattacatgctaaaattttataaaaataaatgctaaaactaacttaaacggaagcatttgattaaaaaatttatccaaaaaagtttgaattttatatgaaacaggatagaagatgaaaaagctaaagaaataaaatataaataaattatggctggggacagtggctcacacctgtaatcccagcactttgggaggctgaggtgggaggactgattgaggctaggagtttgagacctgttatttgaggcacatgggaaggaaagttttctttgagatattccacattttataatattcttcaagagatttacagagttccttgagtgaattgttggtttgttcttaatactgaatttcctattcaaatttatttagaagttcatttcttacagtgatctcatctcctattaagatattcttcaaggtaggttcttggccagtttctcaatgacagatttttaaaaatattgttaatctttttattaatatgagaacataattgttccagatctggaggccatcctttaagcttcttgcaacagtctgggagcaaagagtttactcgccactgggtagtgggccatggacaccccagtctccaccagaagttcgggattgcaaaatgggactctggcagcaaatttcaaactgtatgccagacctggccctttgcaggtgggcatcactaaaaatttaaattaccaaaattgactcaagagtaaatctatgtctgaggagaaagcctttggaaaaattgaattagtaagcaaaaacctacccaaaataaataacagtaagtctagaaaattttacacagggattaccaacaaacattcaaagcacagaaaaatctctttagcacaaaatgctacaaaatacagaaaaagaggaaaattctgtagtttctctcatgaagttaatatattctagttagctgaactagaaaaataagagaaagaaaaattataggttaatcttccttatgagtacatgcaagtatcataagatg

SEQ ID NO: 728437 - DNA, 1711 bp, Homo sapiens
tatctgtcgtcctgacttcttgttcattccaatgaatcgatacagactgttagtgcacatcaatatccattttgtcctcttcttttttggcatacaaccaaaacttacataggctttttatcattttactgggcctatgtaactgagttttagccagtggaatatgtccaagtgacatttgccacttctaggtctggcacattaacacttgatgtattacatttcagaccctcttatcattctgcagtgtgtttggcgatctgttgtttaagatctatatgcactggttactgttgcttgccttccattcctacccttactaatcagattcctattatagctacttctgtccttgattcattttgtatattagatgtgtgtgtgttcatgtgcatgcatgcaccctcacatgtaggtgtatatgggagtggtggtaaagacaggatatttcttcagttcatgggattttatttcaggagaattcaaacattcacgtattggagaagatgacacatttcttgaatgtctttggctttgagctgaatgcactaactagaagggacttcagattgtcctccttcgggggaggtaagtatattcttcatatacaggtaagagtgaaatgatagaagaatgttcctcctctccttttcttcctggacaacagatcaaatatttctcagatcttttacagctgaattggagtcacatggacaggtatgatcttaaaatataaaaaattattttaaaattacatgctaaaattttataaaaataaatgctaaaactaacttaaacggaagcatttgattaaaaaatttatccaaaaaagtttgaattttatatgaaacaggatagaagatgaaaaagctaaagaaataaaatataaataaattatggctggggacagtggctcacacctgtaatcccagcactttgggaggctgaggtgggaggactgattgaggctaggagtttgagacctgttatttgaggcacatgggaaggaaagttttctttgagatattccacattttataatattcttcaagagatttacagagttccttgagtgaattgttggtttgttcttaatactgaatttcctattcaaatttatttagaagttcatttcttacagtgatctcatctcctattaagatattcttcaaggtaggttcttggccagtttctcaatgacagatttttaaaaatattgttaatctttttattaatatgagaacataattgttccagatctggaggccatcctttaagcttcttgcaacagtctgggagcaaagagtttactcgccactgggtagtgggccatggacaccccagtctccaccagaagttcgggattgcaaaatgggactctggcagcaaatttcaaactgtatgccagacctggccctttgcagagttaaaagaagccaggtgtggtggctcacacctgtaatccctggactttgggaggctgaggccagagaatcacctgaggtcaagggtttgaaaccagcgtggccaacatgacaaaaacccatctctactaaaatagaaaaattagccaggagtgatggcgggcacctgtaatcccagctacttgggaggctgatggaggagaatcacctgaacccaggaggtggaggttgcagtgggccaagattgcaccactgcactcctgtctgggcaacagagtgagactgtc

SEQ ID NO: 728438 - DNA, 4564 bp, Homo sapiens
tatctgtcgtcctgacttcttgttcattccaatgaatcgatacagactgttagtgcacatcaatatccattttgtcctcttcttttttggcatacaaccaaaacttacataggctttttatcattttactgggcctatgtaactgagttttagccagtggaatatgtccaagtgacatttgccacttctaggtctggcacattaacacttgatgtattacatttcagaccctcttatcattctgcagtgtgtttggcgatctgttgtttaagatctatatgcactggttactgttgcttgccttccattcctacccttactaatcagattcctattatagctacttctgtccttgattcattttgtatattagatgtgtgtgtgttcatgtgcatgcatgcaccctcacatgtaggtgtatatgggagtggtggtaaagacaggatatttcttcagttcatgggattttatttcaggagaattcaaacattcacgtattggagaagatgacacatttcttgaatgtctttggctttgagctgaatgcactaactagaagggacttcagattgtcctccttcgggggaggtaagtatattcttcatatacaggtaagagtgaaatgatagaagaatgttcctcctctccttttcttcctggacaacagatcaaatatttctcagatcttttacagctgaattggagtcacatggacaggtatgatcttaaaatataaaaaattattttaaaattacatgctaaaattttataaaaataaatgctaaaactaacttaaacggaagcatttgattaaaaaatttatccaaaaaagtttgaattttatatgaaacaggatagaagatgaaaaagctaaagaaataaaatataaataaattatggctggggacagtggctcacacctgtaatcccagcactttgggaggctgaggtgggaggactgattgaggctaggagtttgagacctgttatttgaggcacatgggaaggaaagttttctttgagatattccacattttataatattcttcaagagatttacagagttccttgagtgaattgttggtttgttcttaatactgaatttcctattcaaatttatttagaagttcatttcttacagtgatctcatctcctattaagatattcttcaaggtaggttcttggccagtttctcaatgacagatttttaaaaatattgttaatctttttattaatatgagaacataattgttccagatctggaggccatcctttaagcttcttgcaacagtctgggagcaaagagtttactcgccactgggtagtgggccatggacaccccagtctccaccagaagttcgggattgcaaaatgggactctggcagcaaatttcaaactgtatgccagacctggccctttgcaggtgtctggaaagatggctgaataggaacagctctgctctgcagctcccagcgagatcaacgcagaaggagataatttctgcatttccaactaaagtacccagctcatctcattgggactggttagacagtgggtgcagcccacagaaggcaagcagaagcagggtggggtgtcgcctcacccgggaagcgcaaggggtcagggaactccctcccctagccaagggaagctgtgagggactgtgccgtgaggaacggggcattccggcacagatactatgctttccccacggtctttgcaacccacagaccaggagattcccttgggtgcctgcaccaccagggccctgggtttcaagcaaaaaactgggcagccatttgggcagacactgagctagcagcaggagtttttttcataccctagtagcccctagaatgccagcgagacagaactgttcactcccctggaaaggggcactgaagccagggagccaagtggtctagctcagcagatcccacccccacggagcccaacaagctaagacccactgggttgaaattctcgctgccagcacagcagtctgatgtccacctggaatgcttgagcttggtgcagggaggggcgtctgccattactgaggcttgattaggcagtttccccctcacagtgtaaacaaagctgctgggaagtttgaactgggtggagcccactgcagctcggcaaagttgctgtagcaagagtgtctctctagattcctcctctctgagcagggcatctctgaaacaaaggcagcagccccagtcagggacttatagataaaactcccatctccctgggacagagcacctgggggaaggggcagctgtgggcacagcttcaggacacttaaacgttcctgcctgctggctctgaagagagcagcagatctcccagcacagtgctcaagttctgctaagggacagactgcctcctcaagtgggtccctgacccctgtgcctccggagtgggagagaccttccagcaggggtcaacagacatctggtgggtgcccgtctgagacgaagcttccagaggaaggaacaggcagcaatctgtgctgttctgtagcctgcgctggtgatacccaggtaaacagggtctggagtggatctccaacaaactccagcagacctgcagcagaggggcctgactgttataaggaaaactaacaaacagaaaggaatagcgtcaacatcaacaaaaaggacatccacacaaaaaccccatccgaaggtcaccagcatcaaagaccaaaggtagataaatccatgaagatgaggaaaaaccagtgcaaaaaggctgaaaattccaaaaaccagaacaccttttctcctgcaaaggatcacaactccttgccagcaagagaacaaaactggatggagaatgagtttgacgaatttacagaaggaggcttcagaaggtgggtaataacaaactcctctgagctaaaggagcatgttctaacccaatgcaaggaagctaaaaatgaaaaaaggctggaggaattgctaactagaataaccactttagagaagaacataaatgatctgatggagctgaaaaacacagcacgagaccttcgtgaagcatacagaagtatcaatagctgaatcgatcaagcagaagaaaggatatcagagattgaagatcaacttaatgacataaagtgtgacgtcaagattagagaaaaaaagaatgaaaaggaacgaacaaagcctccaagaaatatgggactatgtgaaaagaccaaacctatgtttaattgatgtacctgaaagtgctggggagaatagaaccaagtttgaaaacactcttaggatattatccaggagaacttccccaacctagcaagacaggccaatattcaaatcagtaaatacagagaacaccacaaagatactcctcgagaagagcaaccccaagacacataatcatcagattcaccaaggatgaaatgaagaaaaaaatgttaagggcagccagagagaaaggtcggtttactcacaaagggaagcccattaaactaatagcagatttgtctgctgaaaccctacaagccagaatagagtggggggccaatatttaacattcttaaagaaaagaattttcagcccagaatttcatatccagccaaactaagcttcattagcaaagaagaaataaaatcctgagagacaagcaaatgctgagcgattttgtcaccaccaggcctgccttacaagagctccagaaggcagcactaaacacataaaggaaaaaccagtaccagccactgcaaaaacataacaaactataaagaccaccgacactatgaagaaactgcatcaactaacaggcaaaataaccaactagcatcataatgacaggatcagattaacacataacaatattaaccttaaatgcaaacgggctaaatgccacaattaaaagacacagactggcaaattggatagagtcaaaatccatcattgtgctgtattcaggagacccatctcacgtgcaaagacacacataggctcaaaataaagggatggaggaatatttaccaagcaaatggaaaggaaaagaaaaaaagcaggggttgcaatcctagtctctcataaaacagactttaaaccaacaaagataaaaaaagacaaagaagggcattacataatggtaaagggatgaatgcaacaagcagagctaactattctacatatatatgcacccaatacaggagcacccagattcataaagcaagttcttagagacctacaaagagacttagactctcacacaataataatgggagactttgacactccactgtcaatattagacagaacaatgagacagaaaattaacaagaatattcaggacttaaactcagctctggaccaagcagacctacagaactcagaacttgaactcagctttggaccaagcagacatctacacaactctccacttcaaatcaacagaatatacattcttagcagcaccacatcgcacttattctaaaattgaccacataattggaagtaaaacactacacaccgaatgcaaaagaacggaaatcacaacagtctctcagaccacagtgcaatcaaattagaactc

SEQ ID NO: 728439 - DNA, 1674 bp, Homo sapiens
tatctgtcgtcctgacttcttgttcattccaatgaatcgatacagactgttagtgcacatcaatatccattttgtcctcttcttttttggcatacaaccaaaacttacataggctttttatcattttactgggcctatgtaactgagttttagccagtggaatatgtccaagtgacatttgccacttctaggtctggcacattaacacttgatgtattacatttcagaccctcttatcattctgcagtgtgtttggcgatctgttgtttaagatctatatgcactggttactgttgcttgccttccattcctacccttactaatcagattcctattatagctacttctgtccttgattcattttgtatattagatgtgtgtgtgttcatgtgcatgcatgcaccctcacatgtaggtgtatatgggagtggtggtaaagacaggatatttcttcagttcatgggattttatttcaggagaattcaaacattcacgtattggagaagatgacacatttcttgaatgtctttggctttgagctgaatgcactaactagaagggacttcagattgtcctccttcgggggaggtaagtatattcttcatatacaggtaagagtgaaatgatagaagaatgttcctcctctccttttcttcctggacaacagatcaaatatttctcagatcttttacagctgaattggagtcacatggacaggtatgatcttaaaatataaaaaattattttaaaattacatgctaaaattttataaaaataaatgctaaaactaacttaaacggaagcatttgattaaaaaatttatccaaaaaagtttgaattttatatgaaacaggatagaagatgaaaaagctaaagaaataaaatataaataaattatggctggggacagtggctcacacctgtaatcccagcactttgggaggctgaggtgggaggactgattgaggctaggagtttgagacctgttatttgaggcacatgggaaggaaagttttctttgagatattccacattttataatattcttcaagagatttacagagttccttgagtgaattgttggtttgttcttaatactgaatttcctattcaaatttatttagaagttcatttcttacagtgatctcatctcctattaagatattcttcaagatctggaggccatcctttaagcttcttgcaacagtctgggagcaaagagtttactcgccactgggtagtgggccatggacaccccagtctccaccagaagttcgggattgcaaaatgggactctggcagcaaatttcaaactgtatgccagacctggccctttgcaggtgggcatcactaaaaatttaaattaccaaaattgactcaagagtaaatctatgtctgaggagaaagcctttggaaaaattgaattagtaagcaaaaacctacccaaaataaataacagtaagtctagaaaattttacacagggattaccaacaaacattcaaagcacagaaaaatctctttagcacaaaatgctacaaaatacagaaaaagaggaaaattctgtagtttctctcatgaagttaatatattctagttagctgaactagaaaaataagagaaagaaaaattataggttaatcttccttatgagtacatgcaagtatcataagatg

SEQ ID NO: 728440 - DNA, 4501 bp, Homo sapiens
tatctgtcgtcctgacttcttgttcattccaatgaatcgatacagactgttagtgcacatcaatatccattttgtcctcttcttttttggcatacaaccaaaacttacataggctttttatcattttactgggcctatgtaactgagttttagccagtggaatatgtccaagtgacatttgccacttctaggtctggcacattaacacttgatgtattacatttcagaccctcttatcattctgcagtgtgtttggcgatctgttgtttaagatctatatgcactggttactgttgcttgccttccattcctacccttactaatcagattcctattatagctacttctgtccttgattcattttgtatattagatgtgtgtgtgttcatgtgcatgcatgcaccctcacatgtaggtgtatatgggagtggtggtaaagacaggatatttcttcagttcatgggattttatttcaggagaattcaaacattcacgtattggagaagatgacacatttcttgaatgtctttggctttgagctgaatgcactaactagaagggacttcagattgtcctccttcgggggaggtaagtatattcttcatatacaggtaagagtgaaatgatagaagaatgttcctcctctccttttcttcctggacaacagatcaaatatttctcagatcttttacagctgaattggagtcacatggacaggtatgatcttaaaatataaaaaattattttaaaattacatgctaaaattttataaaaataaatgctaaaactaacttaaacggaagcatttgattaaaaaatttatccaaaaaagtttgaattttatatgaaacaggatagaagatgaaaaagctaaagaaataaaatataaataaattatggctggggacagtggctcacacctgtaatcccagcactttgggaggctgaggtgggaggactgattgaggctaggagtttgagacctgttatttgaggcacatgggaaggaaagttttctttgagatattccacattttataatattcttcaagagatttacagagttccttgagtgaattgttggtttgttcttaatactgaatttcctattcaaatttatttagaagttcatttcttacagtgatctcatctcctattaagatattcttcaagatctggaggccatcctttaagcttcttgcaacagtctgggagcaaagagtttactcgccactgggtagtgggccatggacaccccagtctccaccagaagttcgggattgcaaaatgggactctggcagcaaatttcaaactgtatgccagacctggccctttgcagtgatataaaatttttcttgaggtgtctggaaagatggctgaataggaacagctctgctctgcagctcccagcgagatcaacgcagaaggagataatttctgcatttccaactaaagtacccagctcatctcattgggactggttagacagtgggtgcagcccacagaaggcaagcagaagcagggtggggtgtcgcctcacccgggaagcgcaaggggtcagggaactccctcccctagccaagggaagctgtgagggactgtgccgtgaggaacggggcattccggcacagatactatgctttccccacggtctttgcaacccacagaccaggagattcccttgggtgcctgcaccaccagggccctgggtttcaagcaaaaaactgggcagccatttgggcagacactgagctagcagcaggagtttttttcataccctagtagcccctagaatgccagcgagacagaactgttcactcccctggaaaggggcactgaagccagggagccaagtggtctagctcagcagatcccacccccacggagcccaacaagctaagacccactgggttgaaattctcgctgccagcacagcagtctgatgtccacctggaatgcttgagcttggtgcagggaggggcgtctgccattactgaggcttgattaggcagtttccccctcacagtgtaaacaaagctgctgggaagtttgaactgggtggagcccactgcagctcggcaaagttgctgtagcaagagtgtctctctagattcctcctctctgagcagggcatctctgaaacaaaggcagcagccccagtcagggacttatagataaaactcccatctccctgggacagagcacctgggggaaggggcagctgtgggcacagcttcaggacacttaaacgttcctgcctgctggctctgaagagagcagcagatctcccagcacagtgctcaagttctgctaagggacagactgcctcctcaagtgggtccctgacccctgtgcctccggagtgggagagaccttccagcaggggtcaacagacatctggtgggtgcccgtctgagacgaagcttccagaggaaggaacaggcagcaatctgtgctgttctgtagcctgcgctggtgatacccaggtaaacagggtctggagtggatctccaacaaactccagcagacctgcagcagaggggcctgactgttataaggaaaactaacaaacagaaaggaatagcgtcaacatcaacaaaaaggacatccacacaaaaaccccatccgaaggtcaccagcatcaaagaccaaaggtagataaatccatgaagatgaggaaaaaccagtgcaaaaaggctgaaaattccaaaaaccagaacaccttttctcctgcaaaggatcacaactccttgccagcaagagaacaaaactggatggagaatgagtttgacgaatttacagaaggaggcttcagaaggtgggtaataacaaactcctctgagctaaaggagcatgttctaacccaatgcaaggaagctaaaaatgaaaaaaggctggaggaattgctaactagaataaccactttagagaagaacataaatgatctgatggagctgaaaaacacagcacgagaccttcgtgaagcatacagaagtatcaatagctgaatcgatcaagcagaagaaaggatatcagagattgaagatcaacttaatgacataaagtgtgacgtcaagattagagaaaaaaagaatgaaaaggaacgaacaaagcctccaagaaatatgggactatgtgaaaagaccaaacctatgtttaattgatgtacctgaaagtgctggggagaatagaaccaagtttgaaaacactcttaggatattatccaggagaacttccccaacctagcaagacaggccaatattcaaatcagtaaatacagagaacaccacaaagatactcctcgagaagagcaaccccaagacacataatcatcagattcaccaaggatgaaatgaagaaaaaaatgttaagggcagccagagagaaaggtcggtttactcacaaagggaagcccattaaactaatagcagatttgtctgctgaaaccctacaagccagaatagagtggggggccaatatttaacattcttaaagaaaagaattttcagcccagaatttcatatccagccaaactaagcttcattagcaaagaagaaataaaatcctgagagacaagcaaatgctgagcgattttgtcaccaccaggcctgccttacaagagctccagaaggcagcactaaacacataaaggaaaaaccagtaccagccactgcaaaaacataacaaactataaagaccaccgacactatgaagaaactgcatcaactaacaggcaaaataaccaactagcatcataatgacaggatcagattaacacataacaatattaaccttaaatgcaaacgggctaaatgccacaattaaaagacacagactggcaaattggatagagtcaaaatccatcattgtgctgtattcaggagacccatctcacgtgcaaagacacacataggctcaaaataaagggatggaggaatatttaccaagcaaatggaaaggaaaagaaaaaaagcaggggttgcaatcctagtctctcataaaacagactttaaaccaacaaagataaaaaaagacaaagaagggcattacataatggtaaagggatgaatgcaacaagcagagctaactattctacatatatatgcacccaatacaggagcacccagattcataaagcaagttcttagagacctacaaagagacttagactctcacacaataataatgggagactttgacactccactgtcaatattagacagaacaatgagacagaaaattaacaagaatattcaggacttaaactcagctctggaccaagcagacctacagaactcagaacttgaactcagctttggaccaagcagacatctacacaactctccacttcaaatcaacagaatatacattcttagcagcaccacatcgcacttattctaaaattgaccacataattggaagtaaaacactacacaccgaatgcaaaagaacggaaatcacaacagtctctcagaccacagtgcaatcaaattagaactc

SEQ ID NO: 728441 - DNA, 1627 bp, Homo sapiens
tatctgtcgtcctgacttcttgttcattccaatgaatcgatacagactgttagtgcacatcaatatccattttgtcctcttcttttttggcatacaaccaaaacttacataggctttttatcattttactgggcctatgtaactgagttttagccagtggaatatgtccaagtgacatttgccacttctaggtctggcacattaacacttgatgtattacatttcagaccctcttatcattctgcagtgtgtttggcgatctgttgtttaagatctatatgcactggttactgttgcttgccttccattcctacccttactaatcagattcctattatagctacttctgtccttgattcattttgtatattagatgtgtgtgtgttcatgtgcatgcatgcaccctcacatgtaggtgtatatgggagtggtggtaaagacaggatatttcttcagttcatgggattttatttcaggagaattcaaacattcacgtattggagaagatgacacatttcttgaatgtctttggctttgagctgaatgcactaactagaagggacttcagattgtcctccttcgggggaggtaagtatattcttcatatacaggtaagagtgaaatgatagaagaatgttcctcctctccttttcttcctggacaacagatcaaatatttctcagatcttttacagctgaattggagtcacatggacaggtatgatcttaaaatataaaaaattattttaaaattacatgctaaaattttataaaaataaatgctaaaactaacttaaacggaagcatttgattaaaaaatttatccaaaaaagtttgaattttatatgaaacaggatagaagatgaaaaagctaaagaaataaaatataaataaattatggctggggacagtggctcacacctgtaatcccagcactttgggaggctgaggtgggaggactgattgaggctaggagtttgagacctgttatttgaggcacatgggaaggaaagttttctttgagatattccacattttataatattcttcaagagatttacagagttccttgagtgaattgttggtttgttcttaatactgaatttcctattcaaatttatttagaagttcatttcttacagtgatctcatctcctattaagatattcttcaagatctggaggccatcctttaagcttcttgcaacagtctgggagcaaagagtttactcgccactgggtagtgggccatggacaccccagtctccaccagaagttcgggattgcaaaatgggactctggcagcaaatttcaaactgtatgccagacctggccctttgcagagttaaaagaagccaggtgtggtggctcacacctgtaatccctggactttgggaggctgaggccagagaatcacctgaggtcaagggtttgaaaccagcgtggccaacatgacaaaaacccatctctactaaaatagaaaaattagccaggagtgatggcgggcacctgtaatcccagctacttgggaggctgatggaggagaatcacctgaacccaggaggtggaggttgcagtgggccaagattgcaccactgcactcctgtctgggcaacagagtgagactgtc

SEQ ID NO: 728442 - DNA, 1516 bp, Homo sapiens
gcgcctccgcgtctgcccgcgccgggcttcgggggcctggggagcctgaggcggccaggaagtggggcgaggaagggcggccacacggcccgagctgggagtcccacagtcccgcagcggcgacgccgccacccgccgagtgccgaggcccggggcccactcccagcccagctccaggagaggccgcgccggaggaccgcgaggacggcgccgcagcgccaggtcgggctgagctaagggaggaaatggagcgaaaagtggcggcgggcagagggccccgggcgggcggagaatcgctgacgagggcatttcggaaggaactgaacctaggagcacagggctccctcccgggaaggcagggcgtgaccctggagccgccggtccctcttgccgcggccccaggcgtggctggcgcgctccaggatctggagcttctacaagtttgctttgtttcctgcttttgcatctaaaaacccgctctctcctcgcccgcctgccggagaccaggactctggcccgtctgcctccctccggcgtcgtctccgggagcgcgggcgcggtggggcctgcaggccgggctgggaccaggcgcgccttggggcgcgagtggctcggccgtcgccgcagaacccgctccctgcgaaacagccgcacccgctccctgggagagtcatgagaactggggtcgcgcctgacccccgcgcccgaagaaaaccagcccgcggaccccgccacacgggccgtgacccgagccccgcgcgccgtcccgaacgcgcgcggtgaaaacgccccgctgcgccggccttgctcggtccccctcctccacccccacttctccggaaaaaaaaaattctgaattgggaacgaagacccgaaaaactcgccatgaccattcccctccccggcccctagcttcggcccggaaggcccctcagggcagcggccgtgggtaccacgacccggccagttcccctcgccgcggaccgaccgggcagggccaacccaggactgttccggggaggggagcagggtaggggagcgaatgttggggttcgttcgtgggtcacccagaactgggcgcacgctggcggcgcccggacttcgccgactgtccgcccggtgccacccgcgcggctcgcgccagacgcagcctggcggtccctgtcctgtcttcgagtatttgtttttaatgctgggtgtcgatcgagacaacaagcgctcagagcaaagcaaggatgcattacgggggtaattttaaaccgatcgataagatttttcagagaaaaaaaaatcgctcatagtccatattttttaagaaaaaaaaaaaagcctcaacattttaacggattttgttaaaagggaagatatatacttcttaacatcacaatcctgaatttcttttgctaaaaaaaatgtaaaaccccaaagccagaataaaaaataaaataataataaaaatacaaaaacaaaaaaaaaaatgaaagcaatttcagttacttactggaggctgtttcct

SEQ ID NO: 728443 - DNA, 1104 bp, Homo sapiens
aggagtctggtggcagcatgcccaataccatgcacctgccctacctcaggcagcgtggtggactgtgggggcctccacctgctctgtctcccttccaggctgcctgatggagtctggctcctggagctgagccacaataatctcagccatctgccggctggcgccttccagggcttttggggactgcgggtgttgctgctttctctcaatatcctgcgggatctgtctgatggggccctagggggcctcagtttcctggagcagctgaacctcagccataaccagctggcccatctgcccacagacttctcggctaccctgggctctctgctctgcctggacctctctcacaacctactcacttccctggaccccaccagcctgtggcgcctggggggcctggagcagctcaacctgagccacaaccagctggctgaactggccgcaggggtctttgggggcctcttccacctacactggctctcgctggctgggaaccagctgcagcgggtgaagggtgctgccctgaccactgtgccgggcttggaagtcctctctgtagctgggaatgacatcagtgagctggaggccgaggcgtttgcaaccttaggagcactgggccttctctctcctgggtaaccgactgcagcacctggaggtcaaggcagtggcaggcatccggacagcaggcatgcggctgctgttgttggataacccctggacacgtgactgtgacctgcagtgagccttcggaaagttgggtcacctgcggcacttgagtgtcgtagacctgggcatcctgacttgcgctgggcccgaaaggctgtcaggggcagtgctgagtggtgtggaggcccagctttgcctggctgagactgccactgtgctgggcatcacaggcaccgtgctgctcacagtggctgtggctgtgctgatggctgagcgcaagcgaagacagggcccgcaagaagccggggagctggggagctttctggagagactatttaatcagcaggcagatcaacaggccaaaatttccaccataactgcaaacttgaatgcggatgaatggattacaacatggtcaaaccttgcaatgagagg

SEQ ID NO: 728444 - DNA, 400 bp, Homo sapiens
gaatattaaaatcataagaatgcacagtgatgcatgcctctaatccaaactacttgggaggatgaggcaagaggatcacttgaggagcccagaagtttgagaccagcttgggaaacatagtaagactctaccttcataaaaaaattgtgcacacttgtgtgtatgctttagatcctgttttttgttgttgttgttgttgttgttttggtttggtttggttttttaaagcataagactgacgctttgttacaaagcattcctttgggagcatgcctgggacgttattagaattaacattcattatatgtattggtaggtaattaatgcagtaagaactcttccctctgtatttattagatgcaaagaagaatacatttattaaaatttggtatctacaagt

SEQ ID NO: 728445 - DNA, 514 bp, Homo sapiens
tgtgtagattcgctggaagcagctggaggctccagttctcatctgctcaggtgtccccggcgccttggcgaactcggccactccagttcctcacgtggtgagcactcagggcagcgggtcgattttccgaggtcccatacctgggtttgaggggcgcggctcgcagcggcgggtgcaggggcgactgccagccctcaccccgcctcggggtgcgttcggaggccgacacctggaggacgcctccagtccccgcgggacgccacgcctgcgcgccagggatccgggataagaagtgcgcgccgggctccggctgcgcgccgcggggccaccagtttgcgcgcagggctcaggcgaccgtgcggccatggacacgccacggggcatcggcaccttcgtggtgtgggactacgtggtgttcgcgggcatgctggtcatctcggccgccatcggcatctactacgccttcgctgggggcggccagcagacctccaaggacttcctgatgggcggccgc

SEQ ID NO: 728446 - DNA, 520 bp, Homo sapiens
cacatttgctgttgcaggtgaccaggattgggctgattgttcacaagaccaggaagcaggattttcaggtgttggctggatcggctggctttctgatggccagctatgccttgggagctgtggggggcgtctgcgccctggccaatgtcctgggggctcaggtgtgccagctggagcgactgtgctgcacggggcaatgggaagatgcccagaaactgcagcaccgcctcattgagccaaacgctgcggtgagccagtggcagcgggggcgcggcctggcggggggtgggcagtctgtgtcctcattggagcaggacccagggctggcaccaggccccactcagtctcttcctttcagaaaatcctttgagagaacatcccagtgtgggaactccttgtgactcccagaaaatcctgacttcggacaaagtcgagcaccactgattgtcaaacttaagtgtgcattaaaatttccttgggggcgaattaaagttccaacttttgggcccaagaagatgca

SEQ ID NO: 728447 - DNA, 410 bp, Homo sapiens
cacatttgctgttgcaggtgaccaggattgggctgattgttcacaagaccaggaagcaggattttcaggtgttggctggatcggctggctttctgatggccagctatgccttgggagctgtggggggcgtctgcgccctggccaatgtcctgggggctcaggtgtgccagctggagcgactgtgctgcacggggcaatgggaagatgcccagaaactgcagcaccgcctcattgagccaaacgctgcgaaaatcctttgagagaacatcccagtgtgggaactccttgtgactcccagaaaatcctgacttcggacaaagtcgagcaccactgattgtcaaacttaagtgtgcattaaaatttccttgggggcgaattaaagttccaacttttgggcccaagaagatgca

SEQ ID NO: 728448 - DNA, 654 bp, Homo sapiens
gcccaggctggtcttgaactcctggcctcaagcaattcatcccatcttggcttcccaaagcactggaattataggcatgagccacatcacccagccttgtagttatttttaaaatgaagacaagaggaatagagtatacctttaaaaatatatgatactgtgtattggatgattctgaaaggatgtatttgcctatgaagaaaaaccttcttgttttgatgtctggttgttagctttttactttactaaagcccagttaacttttctgtgctttagttccacatctgtaaaattactcattttatatttctctatccactttgaaaattaagtaaatgctctttgaatttcaacttttaattatttaagccaagatctctcttctgtattttttatgtgttctttattgtgggcttactaattcttgaatttaaaaaaatcatttaaatcaagcaatagtaatagtatatgtttaagcatatagtgtatgtttttaaataaataagcaggctgggttttagtggctcacccctataatcccaacactttaggaggccaaggcaaaaggatcacttgagtcctggaattgaagaccagtctgggcaacatagcgagatcacacctctacaaaaaaaaaagtttaaaaattagcca

SEQ ID NO: 728449 - DNA, 410 bp, Homo sapiens
aggtggttagtagggtgccttcagaagccctgcaacccaccctccctcagaggcacccaagagaagtgatttgccacaggtgaggaggggtctcgggcagcaccggagttgaactttaagtccagatcaatggtagtgccaccactgggcctcctgctgcccacacccctgcctgtctgctgtgcagatgctgcatctacatagaacacggctttcccagccgcccagctgggacaatagggctggtgggtcaggggacctgagtcctggtccttagggtgggattttggttaggtccctgcttctcttgggatcttatttacccgactctgcagcagccatggtagcttttgactccaggccacaaagccatgagaatgggccttataaactgtaaagtgacgtgcagc

SEQ ID NO: 728450 - DNA, 469 bp, Homo sapiens
ctccgaaaggagggagacgagctcaaccctcgggccttactggcagctcgcagcctagcacggagcccgcgcctgtgcgggcgcctggagctgcccgctccgccgcagcagccgccgcgcctggccgtacgctgtggccggaccccgcggtcgctcgctcacacacccctcgccgctccgcgcctggctcgcccgcgggggccgagcgcgagcgggcgggcgggggaggtgaggggtgcgggcgggtgtgcatgtgcctggctgggtgcacaccccgcaaggcggcggcgccaggacgcggagcgctccccagagcccggctgcctcgcacagctcccgcggctgcgaccatgttccagcccgcggccaagcgcggctttaccatagagtccttggtggccaaggacggcggcaccggcgggggcactggcggcgggggcgcgggctcccatctcctggcggcggccgc

SEQ ID NO: 728451 - DNA, 380 bp, Homo sapiens
ccacaggacccgcgctcgaccctggcgaaggtgcaccggcagcggcgcgacctgctgaacagcgcctgtagccgccactcacgccggcagcgcctgctacagccggaggacctgcggcacgtgctggtggacgacgcgcatggcctgctctactgctacgtgcccaaggtggcctgcaccaactggaagcgcgtgctgctggcgctgagcggccaagcccgcggcgacccgcgcgccatctccgcgcaagaggcgcacgcgcctggccgcctgccctcactggccgacttcagccccgccgagatcaaccggcgcctgcgcgcctacttggccttcctgttcgtgcgggagcccttcgagcgcctggcatcggcttaccg

SEQ ID NO: 728452 - DNA, 532 bp, Homo sapiens
aagatgacctggacatggactccagtgaaggcagcagccccaatgcatctccacatgacagggaggaagcttgttccccacaacaggaacctcagggctgcaggtgcccgctggaccgcttccaagactttgccctgattgatgccccaacgttggaggatgagccccaagaggggcagcagtgggaaatagccctgcccaacaactggcagcggtacccaaggacaaaggtggaggagaaggaggcttcggacacaggtggggaggaacctgagaaggaagaggaagacctgtactatgggctgccagatggagccggggacctcctcccggacaaggagctgggttttgagcctgacacccaaggctgagatgtttgtgctccgtagcttctagtctggaactgctgctgacccctgtgtgacatcacagggcctcagtttccctatctgcaaaatgggatgatatggaggttcaatgagatggtggcattttgagaatggtaaagaaatacacagggaggggatgatga

SEQ ID NO: 728453 - DNA, 178 bp, Homo sapiens
ggtagtatatgagccatcctcttcaagaagcctggaaaccctgcttccccacctacaggcatgcccctcaggactgtgaaagtggcagctttcctctccctgcctcagccatcacttcagagcaggctactgctgctgcctcccagaggggcttgcagcctccagctcttgctcctcc

SEQ ID NO: 728454 - DNA, 282 bp, Homo sapiens
ggcagagccggacgccaggggctggacgcccaaccacctagtcactccccaggacgcagttatcgcgcgcaaagcagctgggggaccccgcaaggaaactcaggcacaatggagcccgcttctttttctgtcaactctgaatgctatgtctggtttggtcctggctgctagttcgaagctggaacatcctccagagctggggcccatttccttttatttgccttgggccccaaatgaaaagcatctatccgcatgcctaataaaaattttcttaaatcgggc

SEQ ID NO: 728455 - DNA, 464 bp, Homo sapiens
gcaaccaggcgccagcccccgaaccatcacacgccgactcggggctccctccggccccgccatccccgcaaacccaaccacctacacagctcggcagcttcccgtccccattgtcgagacccgacggagtttcccgtctacgacaatgacgccatttctgtcagagaagaaactcacaacaagcccggcgtccggcgcagggccggccgctctcccctagggcctcggcgcccggccgagcgaatccgcgcccccacgcgccgcgtccgagcgagaggccggccgggggccaccgaggggccaggagggcctgtgggccgcgggcaggaccggcccgccacagagcccctgcccacgtcccgttccgggctcagacccgacaagtgggagcgagatcaacatctggccccgccgcgggacaacgtgagggccgagggccccggaggcggaacggcccccaccct

SEQ ID NO: 728456 - DNA, 1051 bp, Homo sapiens
gtgagcttgaactaagtgatccatgtggcccccggtcacaaggcctagtgctaggcagcttacctatattataagtgcatgctgcctaaaaggagtaaatcctttttttgaaaactattaccatatttaatgttcttttttgagtcctgggaattactataaaatatttattatttcaaaaacaaaaataaagattttttaaaaaaagttttctagagcaaagccaccgtaagaaagtttgtaaccagaggtttttgaattctaatttgatgctgaaagagtagaagtattatgaatgtataagcaactccccattcccccattaatagtttttcccaatcaaataatgttgccataaatagttgttgttttatatattaatgggtttacagtgaactgccacttgtttgtttggtctaccttaatgtgttttactctttattttcttaatgattttggccgctaaaatggaaaaaaattaactcaagtgggttaaaaagggttttgaaaacatagtagagaacagatgtaaattccttaaagtaaccattcatccagtcactgaaatagaatcctaaaaatacagttggcctacattctgacttacaaaagagtgcaacttttgtccctgctattatgaacagtgtaaaacattaagaattagtgtgctgagaagaaatacttcatgtattctcttcctgcaggagcttgttaggtgtgctctcctgccccccaacttcctttgttggtaaaaatggtaggaattgacagggaggatagaaagtcatgtttttttttggtaggaggaggaagaagaggtcattccagcagtattgtgtagaaattaatttgtcagaaattaaaattgaaggatgaaatgtttattaatagggttctagttaaaaaaataaaggtatccatagacagtaagatactgtgcaattgttgaaaaaatactggtatgtacaaataaaaaatgagacaaaaaaaatctggtaagtgaggaaagcaaagtgccagatatatatgtatagaacgctacctttcttgt

SEQ ID NO: 728457 - DNA, 347 bp, Homo sapiens
accctgcatgaccctgttccccgggaggggcagcctggggagtgacaggcatgacctcgatggtgggccaggggcctcctcagaggagcaaagagaagcttggtggaagagaaagccgctagtattcagcgagaagatcactcaaatccttcaccagcatgctcagtgaagaatgcattaaaaaaattagactttttttcttcctggcaacaaaatcttgccaaaataagtaccaaaataagtgttccaatggttttatttggggaaagccaacgctttccccaaaaagactttttcttgtttctcatttggctgctacaaataaagctgcaatgaacatacatgta

SEQ ID NO: 728458 - DNA, 587 bp, Homo sapiens
aactgtgcatacggattgaaggctgagggttcccttcaattttagcttattttgcctttttgtctatgcatatcataaattgcaaatttggaagagctattgcaagaatagggaattaagagagaaagccatgtagcctactttggtttgaggaattggcttacctggcatataaggaaacttctgcatgacatatatggaaccttctccctctagcttcctggagtctactttaaggcttgggtacaaacctcagtgaaagtatttctgtgttttattttgcctccattgtaccttactcaaaaatcacttgaggaagaagacagttgtcatggcatgattgcggaattcattgttttcctggcaaaatttctccttactagtgctcaatctaatccatgcaaaaatacagttcctgaatagatctaagttatgctgactgtatgtttgtttgccctcataaccatctttagtctttatctgccctacagtcttgcagtggagctgactgttgcaggatacatttccctggctctgtgtcagctactcctacctgggttctgttgttgaatgtataaatgaatgac

SEQ ID NO: 728459 - DNA, 219 bp, Homo sapiens; identical to SEQ ID NO: 242748
  misc_feature (9)..(9): n is a, c, g, or t

SEQ ID NO: 728460 - DNA, 448 bp, Homo sapiens
tgtaaaaaaaaaaaaaaaaaaaaaaaaaagcatacaacagaaactgtatgtggcctgtgaaacctaaaatatatattctttggctcttaacgaagatgtttgccaacccctggtatatattaaagacagttattttagagactgtgtctggtaaccctattatttgaaacttctttgttagtttctggagtttattccatactttttatcagtgccatcctgtctcgtcatatgtgcctggttttattgggctgagcaatggatgttgtatatgtgaaaaaaaatttttttaattgagacctaggatgactttcttcctatagtgaggatttgtgtttgcttccaacagttgattggaaatgctagtaatcctgtataaccttattttagcatcaggcattgaggtcattctaaaattagcatcagtttacttttgggtgacatttac

SEQ ID NO: 728461 - DNA, 551 bp, Homo sapiens
tcatagtactctattttgctgtctgcagagtctgccatgagatctctgttgcattccagatactggtaatctgtgtcgtctctgtttttctttgccttttttccgggttctgcttgctttgggtttattttgctcttgagatgggagcttaaattattggtttgagattttttctcttttctaatgtatgcatttagtgctataaatttcccttcagcattgccttagctatgttccatatatttggatatattgtagtttcatttttcattcagttcaatgtatttttttattttccttgagacttcctgtttggctcttaggtagtgtaaatttctgtttattcctgtatctgctgtacatttaagtcattgctaattatttaccatcctaaataatattgtcagaaataacatcctttaatcaggcacggtggttcatgcctataaccctagccctttgggagaccaaggcaggaggatcccttgagcctaggacttcaagacctgcctaggcaacataacgagatcttgtctctacaaaaaaagaaa

SEQ ID NO: 728462 - DNA, 806 bp, Homo sapiens
gtagatttaaaaatcagtatcttcctgacagaggtattgctataaattttcttttctagatgaaaagaaaaatttttcacttagttattatgaatatatatataaatacatatatatatagttcttacaaataatgaaagccaagttttaaggaagtactgtggctttgtagcccagactgagaggaaaactgacaactatgtcatcaattcaccaaatagacgaaatgggtttctgtgttctctgttaagttataaaactaaacttagatactgaaattaacacaatttaaaaacagtcatgtagaataatgatgctattatttataatgctcatttgattctcacaatcttgttaagtggacaaagcaaatatcaccatcctgtttgctgaataatgaaactgagtctctgggaagctaactggtaggtctagaacccgtccagttatctttcctgtgattcctttacctttatcatcatcatcgtggtaagcattacattagacttagctatgtgccagacgttgttttaagtattttacctgtattaactcatttaatcctcttaatagaggattttttgagtttgttctattactattacccaattttccaaaaaactgagacacacagaggttaagtaatttgtccagttatagagcttagtgaatggtggagccagaattcaaacacaggtagtttggctctcaatatagtctgtgctcttaactaattcactatatttgtctctcaaatatccaaatcacatttctatgaaagttgtgtattaaaagttaatagattt

SEQ ID NO: 728463 - DNA, 517 bp, Homo sapiens; identical to SEQ ID NO: 216137

SEQ ID NO: 728464 - DNA, 736 bp, Homo sapiens
tgaaattctattcaatttcccaacactggttcccagactggctaaatgtgacttatctatacaagtctttaaaaattcagagacctgggccccatcctcagggcgactaattgaatagattgaggctggagttcagggatagaccgcatggccaaatttgggaactatgactacagatggtgtgagccactgaggaaataacatcactggggagaaaaaggtagctttcattatatagcttatatgaccttgagaatgtatattatgtctctctcttttgagggtgtaagggagagagggaaggaaatgagaaacatgatcatcagggaaaggaagacgtacgacaaatcctgcacagctagtgccaggatgctaaagtattgtgatgagggaaatggtgcagaccaggcttctaaagtgaagttgttaatgaaatgaaaggtagacaatacgcagaagcagcctgtcatatatgctaaactgtctgttttctggagaatccaaaagcattggaaactgttttctctgatatccctagttggtttactcaaggataaaatgcccagacttccttcctaacagcaggctaattgatttaaccaaagaatgtgcaaacaagatatactgttcctaaattatgcagtttttccttccttctctatacagtctatttttgcttttgttggacaacatcccactgatcgatcgatctctgaataaaaacactgaaatggac

SEQ ID NO: 728465 - DNA, 494 bp, Homo sapiens
gctatatgcacaagatgctacctgcagagattggtttttgcccagatgtgcaggagagatgcacagagaggaagaaatgcatacatgtgtgcaggttttggcgtgtgcacaagaagcctggaaggattttctttggatctacagtcaaaatggatttccgagaggaagctgtctgaaaacacacctcttccctgtgctacatacggtcccatctctgccagccaggttgtcaggaaagtgatcagcactggcttcaactctggctagagctctttggccaatgtgatgggcagaaaactggaatgaggacagaaaagcacctcagaggtttgaagagtctagtctctcaccaccttgctgctgagacttatttgaatgcctgtttcatatggagcttttaagtgtaacagttgtgagtgaaattgccccttttcaagcgctccgagtttgcttctgcatggaaggggaagatggactagagctgatacctcctg

SEQ ID NO: 728466 - DNA, 811 bp, Homo sapiens
gctatatgcacaagatgctacctgcagagattggtttttgcccagatgtgcaggagagatgcacagagaggaagaaatgcatacatgtgtgcaggttttggcgtgtgcacaagaagcctggaaggattttctttggatctacagtcaaaatggatttccgagaggaagctgtctgaaaacacacctcttccctgtgctacatacggtcccatctctgccagccaggttgtcaggaaagtgatcagcactggcttcaactctggctagagctctttggccaatgtgatgggcagaaaactggaatgaggacagaaaagcacctcagaggtttgaagagtctagtctctcaccaccttgctgctgagacttatttgaatgcctgtttcatatggagcttttaagtgtaacagttgtgagtgaaattgccccttttcaaggtaattgaattccatttttcactttccatttccctctagaaaaatcaaaacgttttcagagcttggcttcttagtgggtgattttctaaggtgggaactttagaaccataaaacattctagtgtggcaaaggcattcaggaaccggatgaccaggccccttctccgcaggtgaacagcctccaccagccggtcttggagaacatattgatttcactgtgtttttatttgaaacaccaaaggaatgcccatatcttgtccttgggccagggctgtgggttaggggagctgggtttctgtccagaatcttgtcatctgtagggcagctgaggggcattattacccagaggtccctggaaacctgtgctaaattggt

SEQ ID NO: 728467 - DNA, 225 bp, Homo sapiens
gcacaggtctacgccatcccccacgcagtttcggagatggagcgctgggcccatggagggaaggcggcaggctcggcggctccggcagcttgctggggcaggggctcaaggcggcagtccgatagtggaggccgctgagaactgtcacggagctgcgtctgtacagcgagcatcccttatttattcagggcgagtgtgtatttggggcggcgtgcagggggctga

SEQ ID NO: 728468 - DNA, 501 bp, Homo sapiens
ggaatgtgacatcagcggcgccgggcgcttggggctggaggaggcagctcgcctcagctgcgctgtgcacacctcgcccgggggaggacgcagacccgggcaggcggcagggatgtcggcgaaggagaggccaaagggcaaagtgatcaaggacagcgtcaccctcctgccctgcttttatttcgtcgagttgcctatattggcatcatcggtggttagcctctatttcctcgaactcacagatgtcttcaaacctgtgcactctggatttagctgctatgaccggagtcttagcatgccgtacattgaaccaacccaggaggcaattccattcctcatgttgcttagcttggcttttgctggacctgcaattacgattatggtaggagaaggaattctctactgttgcctctccaaaagaagaaatggggtcggactagagcccaacattaatgctggaggctgcaacttcaattccttcctcagacgagctgtcagatt

SEQ ID NO: 728469 - DNA, 916 bp, Homo sapiens
aagggagattatccagacccccaggagcgaacagcaagcagcaaccgaagcgcaagtgccaggattacagcctaggctgctccaactatgagcccttcctcggaccctgggactcggctacttggggtttgggggtcttccacaccacagaggcacaaagctgactttaatcactttttttcctttaaacttgattctgccgcagtggagccagcacagcggatgttttcacacccagcaagacaaaggccgtcgtctccgccatgacactgttccgttccaagcagaggccgggattctggactcctcgaaaaatcaaaaagaaacaaggaaaacaaacaacaaatacagcaacaaacagaaaaaactgaaaaccaccaaaatcgtttgcccgtttgcccgtgccaggggtgatctgggcatctgttgcagcagaaggcgcttgtgtggggctaatttttcttttggtgggggggacaagctgttggcttgtttgctatttcaacttcgtttataattaacttaaaaaaaaccccaccattcagcctagtcaacaacaaacaaagaaaaagcagacatcggaagagaaatgccataggaagcggcatgaatacatgccacagccggtgccacttgccactcggaaaacctcagggaaagatgccaattctacagctgcgaagaaggcagagaaaggaggataaaggtctacaactagaaatcataaggaaagaatactgcttgtataatcctggattgcaattgcacacagcctctgctgggagaagagagggaatatttaaatggagatatagatgggtataaattaaaagataggcacctatcgattgcgtataaacacatgtgtaaggttgtatgtgtatataaatatgcatattttcagacaaacgtttag

SEQ ID NO: 728470 - DNA, 416 bp, Homo sapiens
agtaatgagctgagccttggcccccagaagtttcccagaaatgaagccagtcaacggaacccaccttattccacaatcaaacgatcaaaggtgtcaaagaatataagagcaaaaaccccatccaaaggacagtgatatggtttggctctgtgtccccacccaaatgtcaccttgaataaatccccatgcgtcaagggcaggaccagatggagataacttaatcatggggtgcttcccccatgagtgagctctcatgagatctgatgattttataaatgggaattccgctgcacaagctctcttgcttgacaccacgtaagacgtaattttgctcctcatttgccatgattgttaggcctccccagcctaacaatgtggaattgtgagcaaattaaacctctttccttataaattac

SEQ ID NO: 728471 - DNA, 728 bp, Homo sapiens; identical to SEQ ID NO: 205376

SEQ ID NO: 728472 - DNA, 712 bp, Homo sapiens
ctcactctgtcacccaggctagagggcagtgccacggtctcagctcactgcaacctccacctcccaggttcaggcaattctcctgcctcagcctcccgagtagttgggattacaggcacacgctaccactcctggctaattttttgtatttttagtagagactgggtttcaccttgttggccaggctggtctcaaactccagacctaagacgatccacgcacctcggcctcccaaagtgttgggagtacaggcatgagccaccactcccagcctagacaagctgatttctcttggccccttcccattctagaattcagtattccttctgcctgttaattcaatggaaaagttggctcaagtgagtattaggttagcaaacactataaatattttatataccagacacttcctgtcccttctcaggtctctgtttgaatacagtactaaaaagttcatctggatcagcagcctaggctcccaccctgccatgagttgggttaccttttagatttcctggatgagtatgaagttaactgtagcctaattatactagacactctgaaaaaggtttttgtgtgatgtctgcaggaaaaactttcttttcttccctgtggtgtttcccatttcagaagcttgtattcaaacatgccagtcatgcttatatttttagttattcttatttctccaccccattgctcaagaggtgagtcc

SEQ ID NO: 728473 - DNA, 692 bp, Homo sapiens
cttagaatctgtcatttctatctcattaaatcagaggatctaaattgaaagtataatcaaaacaatttctattcttgaaaatttcaggctatcatacagagaattgcagtgaaatatcttggccacatgctaaccccaggcaaacttttctgctccccctcccaaactgcctcagcttttgtgagataacatttatggttcctaccttcttctagagaatgctaactagaaattgcatcaggcatttgatatagtggtgatgtttaagtcttctctgctaaaaagatttgttctgtattgggcatagcactctgttgatatgtagatattgtaattaagattgccctgtcttgtgatatggtcatctcccaaaatatccctgatttactaagaattacctaatatgataaatagattgctgttgggctatataattctctctggtgccagatctaatagtgccaggtatagaaattttgaagtctggccatgataaagaaatgagaacaggaaggggaacatcacacaccggggcctgttgtggggtgggggaaggggggagggatagcattaggagatacacctaacgttaaatgaagagttaatgggtgcatcacaccagcatggcacatgtatacatatgtaacaaacctgcacattgtgcacatgtaccctaaaacttaaagtataat

SEQ ID NO: 728474 - DNA, 774 bp, Homo sapiens
aaaaaaaaagaggggaacttcttttatttgttgataaaatattggtgaggttggtgccgctactgaaactgaacacactagggtacaagagaaggaatgcttctcgctggtggtcttcttagactcaaagagagaagtatctctccctctccccaggaactctacagagcaaggacaaaaccacttctgacttagagggagggctgaatgcagtgaccctatttaccaaatcccaaactgggtcatgaatttttttaatgacatttcagtttgaaaagaaagctggaagatggagtttgtgtgctgacatgttggaattcctggggcattatgagggttcccatgggggccaaagaagagaagatttaatatggtgatgtgttgtcataaaacatttgattgtttttgctcggattctttgaagatttagtctattatcgataagagaaacactaaagaactcttggttgtgtatttggccgctctcatttcggcaagtgtttaaatgtgtcattagacaaaaggtgctctgcaacagttggctctgactggagaccaaatttctctcaaatcaatccataaaccacttctgtcagagacgctctctgcacgcaccaatctggccagctcacaagccagaaattagatgtataactggatttcctctgagtcagccaatgctttgggttacatttaagcacaatctttctatgttatagcaagttccaaaggttgcagttctttttccttttctttccttccttcctttttttt

SEQ ID NO: 728475 - DNA, 531 bp, Homo sapiens; identical to SEQ ID NO: 399418

SEQ ID NO: 728476 - DNA, 340 bp, Homo sapiens; identical to SEQ ID NO: 399419

SEQ ID NO: 728477 - DNA, 662 bp, Homo sapiens
ctaagtcaaaataaacatgggatccaagcagttgcccttttaaaagacttcgtttcacacaatgtagataaaacaacctccaggattgccagataaaatgcagggccagctaaatttgaatttcagataaacaacggacaattgtttagtacaaatatgtcccacgtttcagataaacagtgatttttttttaactacagtaagtttcatgtaatatttaggatatatttacaacagagaatcatttcattgtgtgaaataaaataattcaaacttaaagctgttgaaactttaaattattctgagctttgagagggacatggctatatggcatgagtcaagcagcatgtagttgtaacttctgctttttcctgtaagtgatctggaatgattgaggcgtgccagagataagacccctgagaacattacacctcctcacagaatattaaaggaatcttccttggaatgtagcaagttaaactaatcaaattgttacaactgtttctgcctatataagtgaaatcttggcctcctcactttggagcactgaccccattcctttggaatcatgtttcgcgatggctatcctcaagctttgtgctgcagtaaactttatacttagtcatattttctgaatctcattattgaaggttgacatttgt

SEQ ID NO: 728478 - DNA, 2778 bp, Homo sapiens; identical to SEQ ID NO: 236595
  misc_feature (2504)..(2504): n is a, c, g, or t

SEQ ID NO: 728479 - DNA, 978 bp, Homo sapiens; identical to SEQ ID NO: 236593
  misc_feature (569)..(569): n is a, c, g, or t
  misc_feature (688)..(688): n is a, c, g, or t
  misc_feature (697)..(697): n is a, c, g, or t
  misc_feature (700)..(700): n is a, c, g, or t
  misc_feature (710)..(710): n is a, c, g, or t
  misc_feature (731)..(731): n is a, c, g, or t
  misc_feature (752)..(752): n is a, c, g, or t
  misc_feature (755)..(755): n is a, c, g, or t
  misc_feature (772)..(772): n is a, c, g, or t
  misc_feature (781)..(781): n is a, c, g, or t
  misc_feature (785)..(785): n is a, c, g, or t
  misc_feature (814)..(814): n is a, c, g, or t
  misc_feature (831)..(832): n is a, c, g, or t
  misc_feature (844)..(844): n is a, c, g, or t

SEQ ID NO: 728480 - DNA, 2913 bp, Homo sapiens
  misc_feature (2504)..(2504): n is a, c, g, or t
  misc_feature (2623)..(2623): n is a, c, g, or t
  misc_feature (2632)..(2632): n is a, c, g, or t
  misc_feature (2635)..(2635): n is a, c, g, or t
  misc_feature (2645)..(2645): n is a, c, g, or t
  misc_feature (2666)..(2666): n is a, c, g, or t
  misc_feature (2687)..(2687): n is a, c, g, or t
  misc_feature (2690)..(2690): n is a, c, g, or t
  misc_feature (2707)..(2707): n is a, c, g, or t
  misc_feature (2716)..(2716): n is a, c, g, or t
  misc_feature (2720)..(2720): n is a, c, g, or t
  misc_feature (2749)..(2749): n is a, c, g, or t
  misc_feature (2766)..(2767): n is a, c, g, or t
  misc_feature (2779)..(2779): n is a, c, g, or t
ctcattttgatgtctagaatcaggggatccaggatcatcaccaaggtcattttcccaggtatggaggggtctttctgcttctttcttgtcatgcacagctgctgaggaaggggctgggagtaaagacagtgaaatggggaggaggagtccattcaaaccgagaaacaaagtgtttggtttttcttacccctggtgtagaagctaccaaccttttccaagaaagagggcctggcccccttctcgggtctggctgggtgcctgctgtgcctctctggcctcccctccgaagggcaccattccctcgggtgagtactaccggcctgcaccgtcttccagtggggacagcctgagaagagagtctggggccttacttcagtaccttccttcactggcctcaccctgtgcaaatcatgccacacgctgcagcctccttttccctatctataaaataaaaatgaccctgctctatctcactgggctggcaagaacacactgttgttgccttgcagacagatgtgctgaggctgtagaaagtgctttttatttggttgggagcttgtgcataaatgcgagaggggctgcacatctgacggactagaggtgactcatggctgaaccggaacaggacatcggggagaagccagcagccatgctgaactctccacagggccctgtgaaaagctcttcacctcctctgccctctggatctagtgaagcctattcatccttcagatgtcagctcaaataatcaaccttcatggaggcctcccttgacccctaacatgctttcaaagtactgtgtatttcacattcatcatgccccgacaactgtgatttcccatttattaatatctgtctcttctgctggcctgcaaactccaggagcacagagacatctttgggatttttgaacatgatttccccagggcttagcccagtgcctggtgcaaagcaggctttcaacatgttcagtggatattgtaagaaagaaagaaatacacaaaaggcctggcatatgcaaagcactctaaatattcactcctttcccttccctctgggtgagaaaatttctccttataaagacaccctcctaactgtatctctgctagagaactgaagacataaagcactctgtgccaaaaatatttaagtaaaaacttgagctaagcacagagattataaatatttcttccccagattacgcaccatttaaaaatactgtctcagctccttttcatgatttgggtggtgattaaagaaaattactcttcaagactgaaagtcattactgcccttttcctgacttgccttttcccttgagaaggggaggataagctgcagggcaggaagtggaagtggggcatccttgtcctttgtctggcagacagccaactggtcaggtactgctccttctcaactctttcctgattcccaggtgaatataaacaagaaggcacaaatccacacttgccaacaacggacccaagtgataacaagaaacccagtgacacctgtctaggtgaagactcagcccctatgtgaccaggttgcaaagccaaactgaccatctgctttccatttggacttttagttcatactgtatcttctcaggacagttaagttggaatacaatgccactgtcctgaaagatggtagaattatcctatttctggaggagtgggggtggtgggtaggaatctcaagagcgatttgctcctctgcacaatagcttctttaaggacaccagggcccccagggctatacatttccctgaagctttccagataagcaacaaggtatgagcacctgctatgtattgcccaagggtgatgtgtttaaatatccattgcatattttaaatccttggctggcttaaagctgcaagctttctgtcttcagtggatataatgggggcatacatcccagagcttgcccaacactccaagaaaagaaccctcagctaatgcaaagtgtgtatgtgcccatgaaagctccatgtctacttaacattcagtttttaggattatttatgctgtaataatagatatgaaaatctctgacaggtattttgtttcctttacaaactgtatttgaatttatgggtgatttagagcttgtgtttaaagtcagaattcagaaccccaaagaaaatgacttcattgaaattgaactgaagagacaagaactgagttaccaaaacctactaaacgtgagttgctgtgaactggggattaaaccagaacgagtggagaagatcagaaagctaccaaacacactgctcagaaaggacaaagacattcgaagactgcgggactttcaggaagtggaactcattttaatgaaaaatggaagctccagattgacagaatatgtgccatctctgacagaaaggccctgctatgatagcaaagctgcaaaaatgacttattaaatactcccaggaatggccgcgcatggtggctcaccccctgtaatcccagcactttgggaagccaaggtgggcngatcacctgaggtcaggagttctagaccagcctggccaacatatagtgaaacccagtctctactaaaaaaaatacaaaaattagctaggtgtggtggcgcacacctgtagtagtccccngcctcccangtngctgggactncagtgcccaccaccacacccngctaatttttttttttttttngtngagacagggtttcactntgttggccnggcnggtcttgaactcctgacctcatgatccgnctgccttggcctcccanngtgctgggattncaagtgtgagccaccgcgcccggccaattccactgattctaaaatggccttaagtgaaattaatcacgtaccaaaatgccatcctaagaagtcccagaactatttaggttaaaataaaatatgaaatgacctag

SEQ ID NO: 728481 - DNA, 1294 bp, Homo sapiens
  misc_feature (1020)..(1020): n is a, c, g, or t
ctcattttgatgtctagaatcaggggatccaggatcatcaccaaggtcattttcccaggtatggaggggtctttctgcttctttcttgtcatgcacagctgctgaggaaggggctgggagtaaagacagtgaaatggggaggaggagtccattcaaaccgagaaacaaagtgtttggtttttcttacccctggtgtagaagctaccaaccttttccaagaaagagggcctggcccccttctcgggtctggctgggtgcctgctgtgcctctctggcctcccctccgaagggcaccattccctcgggtgagtactaccggcctgcaccgtcttccagtggggacagcctgagaagagagtctggggccttacttcagtaccttccttcactggcctcaccctgtgcaaatcatgccacacgctgcagcctccttttccctatctataaaataaaaatgaccctgctctatctcactgggctggcaagaacacactgttgttgccttgcagacagatgtgctgaggctgtagaaagtgctttttatttggttgggagcttgtgcataaatgcgagaggggctgcacatctgacggactagaggtgactcatggctgaaccggaacaggacatcggggagaagccagcagattcagaaccccaaagaaaatgacttcattgaaattgaactgaagagacaagaactgagttaccaaaacctactaaacgtgagttgctgtgaactggggattaaaccagaacgagtggagaagatcagaaagctaccaaacacactgctcagaaaggacaaagacattcgaagactgcgggactttcaggaagtggaactcattttaatgaaaaatggaagctccagattgacagaatatgtgccatctctgacagaaaggccctgctatgatagcaaagctgcaaaaatgacttattaaatactcccaggaatggccgcgcatggtggctcaccccctgtaatcccagcactttgggaagccaaggtgggcngatcacctgaggtcaggagttctagaccagcctggccaacatatagtgaaacccagtctctactaaaaaaaatacaaaaattagctaggtgtggtggcgcacacctgtagtagtcccagctacatgggaagctgaggcaggagaatcacctgaacccaggaggcagaggttgcagtgagctgagattgcgccactgcactccagcctggcgacagagcaagactctgtctctcaaaataaataaataaataaataaataaataaataaataatc

SEQ ID NO: 728482 - DNA, 1429 bp, Homo sapiens
  misc_feature (1020)..(1020): n is a, c, g, or t
  misc_feature (1139)..(1139): n is a, c, g, or t
  misc_feature (1148)..(1148): n is a, c, g, or t
  misc_feature (1151)..(1151): n is a, c, g, or t
  misc_feature (1161)..(1161): n is a, c, g, or t
  misc_feature (1182)..(1182): n is a, c, g, or t
  misc_feature (1203)..(1203): n is a, c, g, or t
  misc_feature (1206)..(1206): n is a, c, g, or t
  misc_feature (1223)..(1223): n is a, c, g, or t
  misc_feature (1232)..(1232): n is a, c, g, or t
  misc_feature (1236)..(1236): n is a, c, g, or t
  misc_feature (1265)..(1265): n is a, c, g, or t
  misc_feature (1282)..(1283): n is a, c, g, or t
  misc_feature (1295)..(1295): n is a, c, g, or t
ctcattttgatgtctagaatcaggggatccaggatcatcaccaaggtcattttcccaggtatggaggggtctttctgcttctttcttgtcatgcacagctgctgaggaaggggctgggagtaaagacagtgaaatggggaggaggagtccattcaaaccgagaaacaaagtgtttggtttttcttacccctggtgtagaagctaccaaccttttccaagaaagagggcctggcccccttctcgggtctggctgggtgcctgctgtgcctctctggcctcccctccgaagggcaccattccctcgggtgagtactaccggcctgcaccgtcttccagtggggacagcctgagaagagagtctggggccttacttcagtaccttccttcactggcctcaccctgtgcaaatcatgccacacgctgcagcctccttttccctatctataaaataaaaatgaccctgctctatctcactgggctggcaagaacacactgttgttgccttgcagacagatgtgctgaggctgtagaaagtgctttttatttggttgggagcttgtgcataaatgcgagaggggctgcacatctgacggactagaggtgactcatggctgaaccggaacaggacatcggggagaagccagcagattcagaaccccaaagaaaatgacttcattgaaattgaactgaagagacaagaactgagttaccaaaacctactaaacgtgagttgctgtgaactggggattaaaccagaacgagtggagaagatcagaaagctaccaaacacactgctcagaaaggacaaagacattcgaagactgcgggactttcaggaagtggaactcattttaatgaaaaatggaagctccagattgacagaatatgtgccatctctgacagaaaggccctgctatgatagcaaagctgcaaaaatgacttattaaatactcccaggaatggccgcgcatggtggctcaccccctgtaatcccagcactttgggaagccaaggtgggcngatcacctgaggtcaggagttctagaccagcctggccaacatatagtgaaacccagtctctactaaaaaaaatacaaaaattagctaggtgtggtggcgcacacctgtagtagtccccngcctcccangtngctgggactncagtgcccaccaccacacccngctaatttttttttttttttngtngagacagggtttcactntgttggccnggcnggtcttgaactcctgacctcatgatccgnctgccttggcctcccanngtgctgggattncaagtgtgagccaccgcgcccggccaattccactgattctaaaatggccttaagtgaaattaatcacgtaccaaaatgccatcctaagaagtcccagaactatttaggttaaaataaaatatgaaatgacctag

SEQ ID NO: 728483 - DNA, 2327 bp, Homo sapiens
  misc_feature (2053)..(2053): n is a, c, g, or t
ctcattttgatgtctagaatcaggggatccaggatcatcaccaaggtcattttcccagacagatgtgctgaggctgtagaaagtgctttttatttggttgggagcttgtgcataaatgcgagaggggctgcacatctgacggactagaggtgactcatggctgaaccggaacaggacatcggggagaagccagcagccatgctgaactctccacagggccctgtgaaaagctcttcacctcctctgccctctggatctagtgaagcctattcatccttcagatgtcagctcaaataatcaaccttcatggaggcctcccttgacccctaacatgctttcaaagtactgtgtatttcacattcatcatgccccgacaactgtgatttcccatttattaatatctgtctcttctgctggcctgcaaactccaggagcacagagacatctttgggatttttgaacatgatttccccagggcttagcccagtgcctggtgcaaagcaggctttcaacatgttcagtggatattgtaagaaagaaagaaatacacaaaaggcctggcatatgcaaagcactctaaatattcactcctttcccttccctctgggtgagaaaatttctccttataaagacaccctcctaactgtatctctgctagagaactgaagacataaagcactctgtgccaaaaatatttaagtaaaaacttgagctaagcacagagattataaatatttcttccccagattacgcaccatttaaaaatactgtctcagctccttttcatgatttgggtggtgattaaagaaaattactcttcaagactgaaagtcattactgcccttttcctgacttgccttttcccttgagaaggggaggataagctgcagggcaggaagtggaagtggggcatccttgtcctttgtctggcagacagccaactggtcaggtactgctccttctcaactctttcctgattcccaggtgaatataaacaagaaggcacaaatccacacttgccaacaacggacccaagtgataacaagaaacccagtgacacctgtctaggtgaagactcagcccctatgtgaccaggttgcaaagccaaactgaccatctgctttccatttggacttttagttcatactgtatcttctcaggacagttaagttggaatacaatgccactgtcctgaaagatggtagaattatcctatttctggaggagtgggggtggtgggtaggaatctcaagagcgatttgctcctctgcacaatagcttctttaaggacaccagggcccccagggctatacatttccctgaagctttccagataagcaacaaggtatgagcacctgctatgtattgcccaagggtgatgtgtttaaatatccattgcatattttaaatccttggctggcttaaagctgcaagctttctgtcttcagtggatataatgggggcatacatcccagagcttgcccaacactccaagaaaagaaccctcagctaatgcaaagtgtgtatgtgcccatgaaagctccatgtctacttaacattcagtttttaggattatttatgctgtaataatagatatgaaaatctctgacaggtattttgtttcctttacaaactgtatttgaatttatgggtgatttagagcttgtgtttaaagtcagaattcagaaccccaaagaaaatgacttcattgaaattgaactgaagagacaagaactgagttaccaaaacctactaaacgtgagttgctgtgaactggggattaaaccagaacgagtggagaagatcagaaagctaccaaacacactgctcagaaaggacaaagacattcgaagactgcgggactttcaggaagtggaactcattttaatgaaaaatggaagctccagattgacagaatatgtgccatctctgacagaaaggccctgctatgatagcaaagctgcaaaaatgacttattaaatactcccaggaatggccgcgcatggtggctcaccccctgtaatcccagcactttgggaagccaaggtgggcngatcacctgaggtcaggagttctagaccagcctggccaacatatagtgaaacccagtctctactaaaaaaaatacaaaaattagctaggtgtggtggcgcacacctgtagtagtcccagctacatgggaagctgaggcaggagaatcacctgaacccaggaggcagaggttgcagtgagctgagattgcgccactgcactccagcctggcgacagagcaagactctgtctctcaaaataaataaataaataaataaataaataaataaataatc

SEQ ID NO: 728484 - DNA, 2462 bp, Homo sapiens
  misc_feature (2053)..(2053): n is a, c, g, or t
  misc_feature (2172)..(2172): n is a, c, g, or t
  misc_feature (2181)..(2181): n is a, c, g, or t
  misc_feature (2184)..(2184): n is a, c, g, or t
  misc_feature (2194)..(2194): n is a, c, g, or t
  misc_feature (2215)..(2215): n is a, c, g, or t
  misc_feature (2236)..(2236): n is a, c, g, or t
  misc_feature (2239)..(2239): n is a, c, g, or t
  misc_feature (2256)..(2256): n is a, c, g, or t
  misc_feature (2265)..(2265): n is a, c, g, or t
  misc_feature (2269)..(2269): n is a, c, g, or t
  misc_feature (2298)..(2298): n is a, c, g, or t
  misc_feature (2315)..(2316): n is a, c, g, or t
  misc_feature (2328)..(2328): n is a, c, g, or t
ctcattttgatgtctagaatcaggggatccaggatcatcaccaaggtcattttcccagacagatgtgctgaggctgtagaaagtgctttttatttggttgggagcttgtgcataaatgcgagaggggctgcacatctgacggactagaggtgactcatggctgaaccggaacaggacatcggggagaagccagcagccatgctgaactctccacagggccctgtgaaaagctcttcacctcctctgccctctggatctagtgaagcctattcatccttcagatgtcagctcaaataatcaaccttcatggaggcctcccttgacccctaacatgctttcaaagtactgtgtatttcacattcatcatgccccgacaactgtgatttcccatttattaatatctgtctcttctgctggcctgcaaactccaggagcacagagacatctttgggatttttgaacatgatttccccagggcttagcccagtgcctggtgcaaagcaggctttcaacatgttcagtggatattgtaagaaagaaagaaatacacaaaaggcctggcatatgcaaagcactctaaatattcactcctttcccttccctctgggtgagaaaatttctccttataaagacaccctcctaactgtatctctgctagagaactgaagacataaagcactctgtgccaaaaatatttaagtaaaaacttgagctaagcacagagattataaatatttcttccccagattacgcaccatttaaaaatactgtctcagctccttttcatgatttgggtggtgattaaagaaaattactcttcaagactgaaagtcattactgcccttttcctgacttgccttttcccttgagaaggggaggataagctgcagggcaggaagtggaagtggggcatccttgtcctttgtctggcagacagccaactggtcaggtactgctccttctcaactctttcctgattcccaggtgaatataaacaagaaggcacaaatccacacttgccaacaacggacccaagtgataacaagaaacccagtgacacctgtctaggtgaagactcagcccctatgtgaccaggttgcaaagccaaactgaccatctgctttccatttggacttttagttcatactgtatcttctcaggacagttaagttggaatacaatgccactgtcctgaaagatggtagaattatcctatttctggaggagtgggggtggtgggtaggaatctcaagagcgatttgctcctctgcacaatagcttctttaaggacaccagggcccccagggctatacatttccctgaagctttccagataagcaacaaggtatgagcacctgctatgtattgcccaagggtgatgtgtttaaatatccattgcatattttaaatccttggctggcttaaagctgcaagctttctgtcttcagtggatataatgggggcatacatcccagagcttgcccaacactccaagaaaagaaccctcagctaatgcaaagtgtgtatgtgcccatgaaagctccatgtctacttaacattcagtttttaggattatttatgctgtaataatagatatgaaaatctctgacaggtattttgtttcctttacaaactgtatttgaatttatgggtgatttagagcttgtgtttaaagtcagaattcagaaccccaaagaaaatgacttcattgaaattgaactgaagagacaagaactgagttaccaaaacctactaaacgtgagttgctgtgaactggggattaaaccagaacgagtggagaagatcagaaagctaccaaacacactgctcagaaaggacaaagacattcgaagactgcgggactttcaggaagtggaactcattttaatgaaaaatggaagctccagattgacagaatatgtgccatctctgacagaaaggccctgctatgatagcaaagctgcaaaaatgacttattaaatactcccaggaatggccgcgcatggtggctcaccccctgtaatcccagcactttgggaagccaaggtgggcngatcacctgaggtcaggagttctagaccagcctggccaacatatagtgaaacccagtctctactaaaaaaaatacaaaaattagctaggtgtggtggcgcacacctgtagtagtccccngcctcccangtngctgggactncagtgcccaccaccacacccngctaatttttttttttttttngtngagacagggtttcactntgttggccnggcnggtcttgaactcctgacctcatgatccgnctgccttggcctcccanngtgctgggattncaagtgtgagccaccgcgcccggccaattccactgattctaaaatggccttaagtgaaattaatcacgtaccaaaatgccatcctaagaagtcccagaactatttaggttaaaataaaatatgaaatgacctag

SEQ ID NO: 728485 - DNA, 843 bp, Homo sapiens
  misc_feature (569)..(569): n is a, c, g, or t
ctcattttgatgtctagaatcaggggatccaggatcatcaccaaggtcattttcccagacagatgtgctgaggctgtagaaagtgctttttatttggttgggagcttgtgcataaatgcgagaggggctgcacatctgacggactagaggtgactcatggctgaaccggaacaggacatcggggagaagccagcagattcagaaccccaaagaaaatgacttcattgaaattgaactgaagagacaagaactgagttaccaaaacctactaaacgtgagttgctgtgaactggggattaaaccagaacgagtggagaagatcagaaagctaccaaacacactgctcagaaaggacaaagacattcgaagactgcgggactttcaggaagtggaactcattttaatgaaaaatggaagctccagattgacagaatatgtgccatctctgacagaaaggccctgctatgatagcaaagctgcaaaaatgacttattaaatactcccaggaatggccgcgcatggtggctcaccccctgtaatcccagcactttgggaagccaaggtgggcngatcacctgaggtcaggagttctagaccagcctggccaacatatagtgaaacccagtctctactaaaaaaaatacaaaaattagctaggtgtggtggcgcacacctgtagtagtcccagctacatgggaagctgaggcaggagaatcacctgaacccaggaggcagaggttgcagtgagctgagattgcgccactgcactccagcctggcgacagagcaagactctgtctctcaaaataaataaataaataaataaataaataaataaataatc

SEQ ID NO: 728486 - DNA, 887 bp, Homo sapiens; identical to SEQ ID NO: 236594
  misc_feature (613)..(613): n is a, c, g, or t

SEQ ID NO: 728487 - DNA, 1022 bp, Homo sapiens
  misc_feature (613)..(613): n is a, c, g, or t
  misc_feature (732)..(732): n is a, c, g, or t
  misc_feature (741)..(741): n is a, c, g, or t
  misc_feature (744)..(744): n is a, c, g, or t
  misc_feature (754)..(754): n is a, c, g, or t
  misc_feature (775)..(775): n is a, c, g, or t
  misc_feature (796)..(796): n is a, c, g, or t
  misc_feature (799)..(799): n is a, c, g, or t
  misc_feature (816)..(816): n is a, c, g, or t
  misc_feature (825)..(825): n is a, c, g, or t
  misc_feature (829)..(829): n is a, c, g, or t
  misc_feature (858)..(858): n is a, c, g, or t
  misc_feature (875)..(876): n is a, c, g, or t
  misc_feature (888)..(888): n is a, c, g, or t
acgcctatttacggtgttctgaatgaaacaggacactaattactattggaaccatttttctctgttttgaacagttggataagggaagtcttgacgtgctgcctatgtgtccgctgcccttcatcaaagttgagctactgagaaattggagttgaaggaacagtggctaatggcatgtgctgggatgcaagtaagacattatgcttgggcataaggagttctggtattttatgtatacctattcagaaccccaaagaaaatgacttcattgaaattgaactgaagagacaagaactgagttaccaaaacctactaaacgtgagttgctgtgaactggggattaaaccagaacgagtggagaagatcagaaagctaccaaacacactgctcagaaaggacaaagacattcgaagactgcgggactttcaggaagtggaactcattttaatgaaaaatggaagctccagattgacagaatatgtgccatctctgacagaaaggccctgctatgatagcaaagctgcaaaaatgacttattaaatactcccaggaatggccgcgcatggtggctcaccccctgtaatcccagcactttgggaagccaaggtgggcngatcacctgaggtcaggagttctagaccagcctggccaacatatagtgaaacccagtctctactaaaaaaaatacaaaaattagctaggtgtggtggcgcacacctgtagtagtccccngcctcccangtngctgggactncagtgcccaccaccacacccngctaatttttttttttttttngtngagacagggtttcactntgttggccnggcnggtcttgaactcctgacctcatgatccgnctgccttggcctcccanngtgctgggattncaagtgtgagccaccgcgcccggccaattccactgattctaaaatggccttaagtgaaattaatcacgtaccaaaatgccatcctaagaagtcccagaactatttaggttaaaataaaatatgaaatgacctag

SEQ ID NO: 728488 - DNA, 2002 bp, Homo sapiens
ctttgtttttctcatgtatcaatacctataggtaagtctattgattgtactgttgcagagccttgttttctgcaaaacgttggcaatgtgttatttgaaaccagatgttttcttaagaaataaacctgctaaacttgtttcctgtggaaactggaaatttgttttattttatagtttaaaatgccataaatgcaagatcttccattggttgaatcaatatagccttctaaatgtgatttctggttctaaatgtgtgcctgttctaaatgcttctaaatgctgacacctgaaaacctttttgcatatattcacatacgactatgactatttctgcagtaattattattgagacttactataataatgataaggctgtatataaattataccttactaaaaatttaaaatctaggaatttactgagagagcataaagtatggttgtaatagagaaaacaaatgattgaaatggcttaaatgcaagcctttaatattaattttgagtattttaacgcaaataaaaccaattatgacagtgtgctcaaattggtaaacaaccaatctgtgactttatgaaaatatatttatgacagtcatacttgccttactcttaagtgtagtatttgtccttaagttgggagcaccataaattaattttaaagcaaaacatatgaccctcatccaatgttttaaatgaattgcttcctactaggaaaacaaaacatctcaggacatcaaatacttctagtaatcaagatgttttgtttaaatttgctaatgtaagcttcaactctatttggttgcactttaaaaaagcatactagaaaatggggaatatttgaaacatgcatttttaaaagctaggtgttatcttactcagaagatgttaaaagcttctttatacattttatttgaaagtaatttccaaaaaagggatgcttggtgggtatatgaaaaggtgttcagtatcactaatcatcagggaaatacatatcaaaaccataatggaatattacctcacagctgttaggatggcttttatcaaaaagacaaaaaataacaagtattagtgagactgtggaagagaaggaaccctcacacaccactgataggaatgtatatcagtataggcattattaaaaacactatggagattcttcaaaaatgtaaaactaagaatactatataatcaaacaatcccacttctgggtatatatccaaaggaaatgagaaccatgtataaaagagatatgtactctcccatatccattgcagatttactcacaacagtgaagatactgaaacaatataaatgttcattgatggaaaagaatacagctggaggcatcatgctacctgacttcaaactacactacaaggctacagtaaccaaaacagcatggtactggtaccaaaacagacatatcgaccaatggagcagaacagagacctcagaaataaaacaacatgtctacaaccatttgatctttgacaaacctgacaaaaacaagaaatggggaaaggatctcctattcagtaaatggtgctgggaaaactggctagccatatgcagaaaactgaaactggaccccttccttacaccttatatgaaaattaactcaagatggattaaagacttaaatgtaaaactgaaaaccataaaaatcctggaagaaaacctaggcaataccattcaggacatagggatgggcaaagacttcatgatgaaaacaccaaaagcaattgcaacaaaagccaaaattgacaagtgggatttaattaaattaaagagcttcttcacagcaaaagaaataatcatcagagtgaacaggcaacctacagagtggaagaaaatttttgcaatctacccatctgacaaaggtctaatatccagaatttaaaaggaacttaaacatatttacaagaaaaaaaaaaacaaccttatcaaaacataggcaaaggatatgaatggacacttctctaaagaagacatttacatggcc

SEQ ID NO: 728489 - DNA, 4678 bp, Homo sapiens
  misc_feature (1406)..(1406): n is a, c, g, or t
  misc_feature (2415)..(2415): n is a, c, g, or t
  misc_feature (2488)..(2488): n is a, c, g, or t
  misc_feature (3003)..(3003): n is a, c, g, or t
  misc_feature (3056)..(3056): n is a, c, g, or t
gactcagtgcatcaaaggctggagaaagaatcaccctagaactgagtgccacaggcttcggaagctgcacaagactgcaacacggtgacagcttctatttctaacagcaaacctaaaaagctcaggaaccaaaataaaacggatagaaatgaaaccactcagagtatgacgacagtactcaaagcaactcacgagcatttccccacgctgtcttccaaaatgtgaaaaatgtgatttttttttaatggccacattggagaactgctatgagcagacctcatttatataacccttcccagcacctcatgtatcatcattattaaaaaacactatggggatcatgctttcacataactttgtcttatttgttatctacatagcctaagcaaatagtaaatgatggagaatgaaaataattgtcaatgtttagggggaaaaaaatacctgcatttcaaattttttaaaaaaaccataaaatctatcttttaaaaaaggaaggagtaagctggaatccacaattgttagaaacccaaaagtgatacagaggggaggcaaaaaaaaaaaaaaatactatattctccacactgaaacaatgtatctttctcaacagcccagtttcatctgtagctgtattttccccactgaaatgccaccattaatcataacaacagatgagtaaaaatcaattaatattccttcagcatctcttaggtgtcttcaatcctgtgcgctgtcatccctttaaagaggaaggaaaagatccacagccaggaaacagactcagaaactcaaacccaggtctctggaccccacagggaagtgaggcacagccaagagcaatctgtgtccattactggcctcaaatgaccacatggaaacactgtgtgcagagccagccccccaagcccgtggcggtcctccttggagatgatggggtctggggagaggtcagagtcaggctcacgtgaacttcagaaagccactgcccaggatatgggtggaccgcaagtctaccatgggctgtcccagctccaaagacgtcagaaccccacagcgattgttattcccaaagccctttacgcttggctccacagcacacggcagagaaaatcgacagaaggaaggatgttcacaggtgtccacccctacctatgccccagtgacctggaaataaaatccatcaagagcaccggggtcagccagctggggtacgctggagagtatgggtggcagagggaaccccgctgtggattgatcatttgacactgtgttcagcataccttttaaaaaaatgttggtaccatgtaaaaatataacctaaataacaagtacatttttaatgctgagatggagaatttagcacctataatccttccagagatgcacaccacgcaaccacgtgagtnccctctggctctgaattccgagagcagctaccaacacaggcctccgctgcctgcactcagcacacctatcggaaagcgccagtgctggcatgggctttccctccctggcggctgctcctcctgcacccccatgcccaggcactccggccagaaacaagggaggagtctggggactgatcctccccctctcacctcccacatctacccaggtaccacaccctgccatctgtctcctgctgccctctgtcactgcaggagcccctggagagcacatcacccctcactaggctgcagccacagcccctctcagaaaaccctgctgtctgctttccagtgcagccctgtctaatcaccctccatgtatcctccccatggctcttcccccatagcctcaggttggagcacccagctttcgcctgcagaagcccctccatgcccccgacacagcaccccatgaacaactcacctggcaccgctactctctccagcctggtctctcactagccccctcaagcctggggctgtagcctttccaagccattggcagccaaaggacccccttccccagctgctgtgtgtggccctggccatgctccttgtctgtaaggccattctaacacctcgcctcctgccagcccctacgcccagtttattccatgtcaggaggtatggcctccatcccctgatggcccactcctccttacatgcccagccttgcgtcctcaccactcccccacagctcagacaggcctgccctgcccctgggcttgggcatccccacggtttccctgccagtgggcatccccacagttccttcgcctccagaggcccagcacccagttctgcctcggccccaggcacatggaccttcccttgggtcttagtgtctctttctcagacttgccttttcttggtggtttgatggtcacccacccaacctccttccctgaaagtctggtgcaggaaggggtaaaaacacatatacaaaggtcaccagcaagccagccancaccagctctggagaaaacacggacagaaagacgtatgcccaccattcactcattcgcaagccgggagaactnacttacttccttgcctgcttgagaaacagccgccgcaccagagactgggtttcatagtgtctgaattctcaaggaatgtggatggaggacagtgaatctctaactggctgctgcacttctcacacttacagcttgctcattcgcactttaaagtcaaacctcgagtcccctcatgccagcagtcaccttctccccgatcttttacagtaactggggaaaggcagcccagagaacaggccagggcagaggtcaggctgcaaaacatgcttccctaaggacgtccaggctggagggggcccggcagcaggtgggtctttctttcagggtcttcctccaccaaattcaggactattccagaaagaggcagtgagtccctggatggggaaaccgctcctcctgagccttccccacagattggatcggagtggaaggtgcccccaggtgacagcacctagcaaggctgatgcaggccttctgcctggcccacaggagagccccagccccactccccagancacagacgaccaaggctcctgtgtacgggggaagtatcatagtgccgtgcttngcacttggtcattttagcaactaggtgttttagaaggaagcacaaggacctaggaactgggttgagctctgtcaggccttgcctctcagttaggatctgttgggtagatgggctcattgccactaaccagactcgtcttccagggagccttcctgatttaccaggctgcgtgagggccctcctctgtgcctgtctggtgtccctgcctaccttggccactgtctgcagacatcacagagagttgaaggggcctggcttgggcctgtgtgagcccccagcacctggggcctatccatagcaagtgtcggggaaactgctgcatgttactgcgtcccatctgcacggcctggctatgaggggccctcagctcagcactcagtgagaccaactcaacactgaaatggtggagtcagggtggcccgtgcgtccagcattcccattaccatactacagagcacggggctgaggaaacaggcacttgccaccatcaccatcatgacaagtagcctctcaagacaggaggtagagagcatctggtcccacgacccttactacactcttcccttgtcctgcagcccaactccctgctctaaacacaaagtaggacatcctcttcttctgagctacctgggtcctggctcccctgcaacttcctttcctgcctgagcagccctgagcagacagtgctgtgtctttcatgatcatcatcacgtggcccaacagaccaggtctgcagacaagtccactgccaagcaagtctcggagcacagttctgggccccagagtcagcccagtccagcccagccccatcagggcctctggacagcctgagagcaaggcctcgtgctgtccctctccgaggaaggatttgcctcaggcctggttctgagaagtaaacagggtaatgttctgaagcagtggacttcaaaccaaacccccacaaaataaatgtttaaaactacatatctatttgcacatttttaagttgatatgaaaaatttctcatcataagtctaaatacttgtagaggatgtaatttccaacatactgtaaatattaacatttaaaaataaaactgttaatgtttctcttttaaatggatccaatggtatctaaataccacggcgattagagattcgccatcatccatttttaaattacataatcaagctcttctttaaccattggaaatttaacagtgttccttttttcctccacaaactctgatctccctcagagatgtttatactatcacagtgtattttatgcttgaaagccttatactgattatcctattatatactatagggccaaaaaatacaaaaatcaatgttttaattttttttaatttcctgtgatttcctgtgatcataaagctctgtcagaagttttctcctggactgaattattataacaattactataagtatacaattgatcaataagacagaaatatattgcaaaattgtataagaaataacctttaaaaataaacttaattaggccaggcgcagtggttcacgcctgtaatcccagcactttgggaggccgaggtgggcagatcacctgaggtcagcagttcaagaccagcctggtcaactggtgaaaccccatctctactt

SEQ ID NO: 728490 - DNA, 1321 bp, Homo sapiens
gactcagtgcatcaaaggctggagaaagaatcaccctagaactgagtgccacaggcttcggaagctgcacaagactgcaacacggtgacagcttctatttctaacagcaaacctaaaaagctcaggaaccaaaataaaacggatagaaatgaaaccactcagagtatgacgacagtactcaaagcaactcacgagcatttccccacgctgtcttccaaaatgtgaaaaatgtgatttttttttaatggccacattggagaactgctatgagcagacctcatttatataacccttcccagcacctcatgtatcatcattattaaaaaacactatggggatcatgctttcacataactttgtcttatttgttatctacatagcctaagcaaatagtaaatgatggagaatgaaaataattgtcaatgtttagggggaaaaaaatacctgcatttcaaattttttaaaaaaaccataaaatctatcttttaaaaaaggaaggagtaagctggaatccacaattgttagaaacccaaaagtgatacagaggggaggcaaaaaaaaaaaaaaatactatattctccacactgaaacaatgtatctttctcaacagcccagtttcatctgtagctgtattttccccactgaaatgccaccattaatcataacaacagatgagtaaaaatcaattaatattccttcagcatctcttaggtgtcttcaatcctgtgcgctgtcatccctttaaagaggaaggaaaagatccacagccaggaaacagactcagaaactcaaacccaggtctctggaccccacagggaagtgaggcacagccaagagcaatctgtgtccattactggcctcaaatgaccacatggaaacactgtgtgcagagccagccccccaagcccgtggcggtcctccttggagatgatggggtctggggagaggtcagagtcaggctcacgtgaacttcagaaagccactgcccaggatatgggtggaccgcaagtctaccatgggctgtcccagctccaaagacgtcagaaccccacagcgattgttattcccaaagccctttacgcttggctccacagcacacggcagagaaaatcgacagaaggaaggatgttcacaggtgtccacccctacctatgccccagtgacctggaaataaaatccatcaagagcaccggggtcagccagctggggtacgctggagagtatgggtggcagagggaaccccgctgtggattgatcatttgacactgtgttcagcatacctttcggacgcgtgggtccagccgggaatccggcccatgcg

SEQ ID NO: 728491 - DNA, 2798 bp, Homo sapiens
  misc_feature (535)..(535): n is a, c, g, or t
  misc_feature (608)..(608): n is a, c, g, or t
  misc_feature (1123)..(1123): n is a, c, g, or t
  misc_feature (1176)..(1176): n is a, c, g, or t
tctgacgctctcacccaccccacccaagatcagacacagccaggaaaggacccaagagaaaatccttcaaggtggcctgaggtcccatccctccctcagacccatgtggtcccaggccaggctgcctgggacacagtaaataccactgtgtgcaaaaatcgaagtacaaaaccacaagactaaacaaaacaaacccagagagcggccgctctccacccactcctccttacatgcccagccttgcgtcctcaccactcccccacagctcagacaggcctgccctgcccctgggcttgggcatccccacggtttccctgccagtgggcatccccacagttccttcgcctccagaggcccagcacccagttctgcctcggccccaggcacatggaccttcccttgggtcttagtgtctctttctcagacttgccttttcttggtggtttgatggtcacccacccaacctccttccctgaaagtctggtgcaggaaggggtaaaaacacatatacaaaggtcaccagcaagccagccancaccagctctggagaaaacacggacagaaagacgtatgcccaccattcactcattcgcaagccgggagaactnacttacttccttgcctgcttgagaaacagccgccgcaccagagactgggtttcatagtgtctgaattctcaaggaatgtggatggaggacagtgaatctctaactggctgctgcacttctcacacttacagcttgctcattcgcactttaaagtcaaacctcgagtcccctcatgccagcagtcaccttctccccgatcttttacagtaactggggaaaggcagcccagagaacaggccagggcagaggtcaggctgcaaaacatgcttccctaaggacgtccaggctggagggggcccggcagcaggtgggtctttctttcagggtcttcctccaccaaattcaggactattccagaaagaggcagtgagtccctggatggggaaaccgctcctcctgagccttccccacagattggatcggagtggaaggtgcccccaggtgacagcacctagcaaggctgatgcaggccttctgcctggcccacaggagagccccagccccactccccagancacagacgaccaaggctcctgtgtacgggggaagtatcatagtgccgtgcttngcacttggtcattttagcaactaggtgttttagaaggaagcacaaggacctaggaactgggttgagctctgtcaggccttgcctctcagttaggatctgttgggtagatgggctcattgccactaaccagactcgtcttccagggagccttcctgatttaccaggctgcgtgagggccctcctctgtgcctgtctggtgtccctgcctaccttggccactgtctgcagacatcacagagagttgaaggggcctggcttgggcctgtgtgagcccccagcacctggggcctatccatagcaagtgtcggggaaactgctgcatgttactgcgtcccatctgcacggcctggctatgaggggccctcagctcagcactcagtgagaccaactcaacactgaaatggtggagtcagggtggcccgtgcgtccagcattcccattaccatactacagagcacggggctgaggaaacaggcacttgccaccatcaccatcatgacaagtagcctctcaagacaggaggtagagagcatctggtcccacgacccttactacactcttcccttgtcctgcagcccaactccctgctctaaacacaaagtaggacatcctcttcttctgagctacctgggtcctggctcccctgcaacttcctttcctgcctgagcagccctgagcagacagtgctgtgtctttcatgatcatcatcacgtggcccaacagaccaggtctgcagacaagtccactgccaagcaagtctcggagcacagttctgggccccagagtcagcccagtccagcccagccccatcagggcctctggacagcctgagagcaaggcctcgtgctgtccctctccgaggaaggatttgcctcaggcctggttctgagaagtaaacagggtaatgttctgaagcagtggacttcaaaccaaacccccacaaaataaatgtttaaaactacatatctatttgcacatttttaagttgatatgaaaaatttctcatcataagtctaaatacttgtagaggatgtaatttccaacatactgtaaatattaacatttaaaaataaaactgttaatgtttctcttttaaatggatccaatggtatctaaataccacggcgattagagattcgccatcatccatttttaaattacataatcaagctcttctttaaccattggaaatttaacagtgttccttttttcctccacaaactctgatctccctcagagatgtttatactatcacagtgtattttatgcttgaaagccttatactgattatcctattatatactatagggccaaaaaatacaaaaatcaatgttttaattttttttaatttcctgtgatttcctgtgatcataaagctctgtcagaagttttctcctggactgaattattataacaattactataagtatacaattgatcaataagacagaaatatattgcaaaattgtataagaaataacctttaaaaataaacttaattaggccaggcgcagtggttcacgcctgtaatcccagcactttgggaggccgaggtgggcagatcacctgaggtcagcagttcaagaccagcctggtcaactggtgaaaccccatctctactt

SEQ ID NO: 728492 - DNA, 786 bp, Homo sapiens
cttgttttgtaatgttttgaatctcttgagatgtatttaccccactagatacatatttgccactggttagttctccatctaagctcaagaggttattcatctctctttagattccagtggtttttcttttaacttccaggtaaaatagaaactgctatggtatacaaccaaattttggggttaaacataatcagaaaagaaaatccagttaaatttatgaagtgagattttcagatcctagatcttgaatatagcaaaggtcttttcatcttgatggccccaaagcttgttggtcatagtctatttctggccattatcttcttaaataatctatttttaagccctcatttatttttggttttggatgaggaaagtcatgttttctaagtcctctcccctaataaaacctacccaacaatagtgctttgaaaagtggtagttatcttgaagatactcttgccaaatgcaaagataaacattctttttgtctgctttataaatatgaaatatgccagatctatagtattttaatgtgcatctactttaaatgagtcatcttggggtttttataattcccttacattcttgcccctctacacttgaaataacaaaatgccttaattttatagattagttctcttatagtagacaggcagctatatgcagcaaaaccaataaagttatttttcaactttcatagttgtaaaatattttatagcaatacaaaacagctaagaaaacatgccacattttattttagcattttcaaataatttgtttttggtg

SEQ ID NO: 728493 - DNA, 493 bp, Homo sapiens
ctcccctaataaaacctacccaacaatagtgctttgaaaacatgacttccctcatttatttttggttttggatgaggaaagtcatgttttctaagtcctctcccctaataaaacctacccaacaatagtgctttgaaaagtggtagttatcttgaagatactcttgccaaatgcaaagataaacattctttttgtctgctttataaatatgaaatatgccagatctatagtattttaatgtgcatctactttaaatgagtcatcttggggtttttataattcccttacattcttgcccctctacacttgaaataacaaaatgccttaattttatagattagttctcttatagtagacaggcagctatatgcagcaaaaccaataaagttatttttcaactttcatagttgtaaaatattttatagcaatacaaaacagctaagaaaacatgccacattttattttagcattttcaaataatttgtttttggtg

SEQ ID NO: 728494 - DNA, 1151 bp, Homo sapiens
tgcgcagggctgaatggtcgctgagacagagatggaagccaggacaagggagcccaccgggcccagatagagacttcagaacccactcctgagaacagcggagccaggcgcttagaggaagaccaaatgctgccaggacacggattgtccaggattacattccagcatcttattagatggcctgattagccagaggtttccaggccgtctgtccgcctccaggagatggactgggacctttagacatcggtggagaacaggatgctctgtcccttgctgtccagggcagggatggcctccagccgcaagaagtacagcagcacctcgacctgccctcgcggagtggggaagaggagagtggctcagagcggggctcacagctgctggtggggaggtctttggggcccaagctcccaagtccacctcaggtgctagaaacccctgctggtgtcatgaaccccttacagtgggacgggggtggggtggggtcctgacaaggcatgacttgttgggtgaggggtggttatttattttagagatgcacagggccttgctctgtcccccaggctggagtacagtggctccatcatggatcactgcagcctctaactcctgggctcaagcaatcctcctgtgtcagcctcccagatacctaggattacagatgtgtgccccaatgcctgcctaatttttctttgtattttttctggagatggggtttgctacattgcccagactggtctcaaacacctgggttcagttgtcctgcctcggcctcccaaagtgctgggattacaggcatgagccaccacactcgaacacttggggtggttttaagcccccagcaaggtgcaccagcaggaccaggaggtggcctgggcaccccctatcactcccatccatgcaaacctaggcaagtccctgtctctgaatctcagccaccaccacatacaatgcaagtgggaagatgggcaggactgggggtggggcaggcagaggccacctctgtcaggctggggttgcatgggctggaggctgtcttcccatacctgggacatgacctccaaggaccagctgtcagtcatggtgatgggctggctggggttggcagggagcttgctctccttctcggagggccggagcagcgtggg

SEQ ID NO: 728495 - DNA, 803 bp, Homo sapiens
atcgccagggtatctatggccgggctcaggcggctgctggggagccaggagaccgcgcgggacggcggatgaggcgcggcggctgcggcccagggcacctcccctctggcttcccgaacccggccaggtccgacccgagggggaggatggaaacacctgccgcgctctgagccccccagaagagaacacccttcccgccatatcaccccacggtcctgcggaggccaccgcctggtccccccaagtctccatcgcgcagcgtggggccgagaggaatagtgagcgatggcggaaaacctgaaaagactggtctcaaacgaaactttacgaacgttgcaggaaaagctagacttctggctgaaggagtacaacacaaacacgtgtgatcaaaatctaaaccattgccttgaactcattgagcaagttgccaaggtgcagggacaactctttgggatcctcacagcagcagcccaagaaggaggacgtaatgatggtgtggaaacaatcaagtcacgccttttgccttggctggaggcttcctttactgctgcttccctgggaaaatctgttgacagcaaggtcccctctctgcaggacacgtttgatagggagagacataaagatcccagtcctcgggatcgggatatgcaacagttagactctaatttgaactcaacccggagtcaatgcaaccaggttcaagacgatctggttgaaactgaaaagaatcttgaagaaagcaagaacagatcggccatatcccttttggctgcagaggaggaaataaatcagctgaaaaagca

SEQ ID NO: 728496 - DNA, 717 bp, Homo sapiens
agcggagtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaagttaaaagaatattggcagagaaacagccctggtgttccagcaggagccaagaggaacaggaaaacaaatggcagcatccatgagacagccacttctggtggttgccactcacctggagattcagcaacaggtatccacggggagagccctacatcatctgctaccctgaaggatctggagagcccgtgccaagaactagcagtagtcccagactcgaggtccgtaaaagtcagtcaactgaagaacaccatcaaatctttgaaacaacagaagaaacaagtggtacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtctctgataacccggtcccatgggtgggcctgtcccggggcaggggcagtggtggcattctggggacatgtctcttgcagtaccatctctgcctctgcctggttagatctctgtcttcctctt

SEQ ID NO: 728497 - DNA, 721 bp, Homo sapiens
ggaaacctcagggccaaaggctcctgtctgtccttttccaccctaaatcttctgtgaagaaccgtacttggcccatacgtgctcagtaaatgtttattgaatgaatgcacttttctaaatcacaagctggcagaagggggggcctttctcaaactccatctctagaggtttatattgctgtcctctcaagagattccagattcagaccttcagttctgtggctgtgggcaaaagccaacaaagacccaaatcctctgtccttgggagcttgaggagagtttaccagttcgagttcccactgggtctgagaactttgcctttaaaatccattcctggtccctgcctaccacttcctgctctggggaatagagttgagggggccaccctccatcaccttaatgtgactctccccacagaaacaacagaagaaacaagtggtacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtctctgataacccggtcccatgggtgggcctgtcccggggcaggggcagtggtggcattctggggacatgtctcttgcagtaccatctctgcctctgcctggttagatctctgtcttcctctt

SEQ ID NO: 728498 - DNA, 1265 bp, Homo sapiens
acctcagaagctggagaggtggcacaacagagagggccacatggggaccggagccacaggaccggccaaggtccaaggcatggactccaagccctggtactgtgacaaaccgccttccaagtacttcgcgacagagtcacaggcgcctgaggttcccgcctgtggacacccagaactgggtatttgtgacggagggcatggacgacttccgctacgcctgtcagtctcctgaagatacgcttgtttgtcgccgtgacgagtttttactccccaaaatatctctcagaggtccccaagctgaccgcaaaagcaggaagaaaaagctgctcaagaaagcggccctattttccgagctctcgccagtacagccagcacggaaggcgttcgtagaggaagtggaagcccagctgatgaccaagcatcccttggccatgtaccccaatctgggaaaagatatgcctccagatctcctactacaggtgctgaaacagctggatcccgagaggaagctggaggacgcttgggctcgttgtgaggccgggagaagacaaccgaggtacccaccgagtctggtaaatatccctgtggggaatcctgcccgcggcctcccgagactccggtgtcccgtctccgtcctcagcttcccaagactccggtgtccagtcgccgcccagagcctcccaagactcgggtgtccagtctccgcccagagcctcccaagactcgggtgtccagtctccacccggaacctccagagactcgcgcatctcatctccgcgtggatcctcccgagactggagtgtcccatctctgcccagagcctcccaagactctggtgtccagtgtccacccagagcctcctgatactggagcgtcccatctctgcccggagcctcccgagactcgcgtatctcatctccacccggagcctcctgagactggagtgtcccatctccgcccagagccttccaagactcaggtgtccagtctctgcccggacctcccgaggctggagtgtcccatctctgcctggacctcccaacactcatcgggtgtccagtttcctactacaggtgctgaaactggattctgagaagaagctggaagatgcacgggctcgttgtgagggccaggagatgacaaccgaggaactcaccaagcctggtaaataccatttttgggaatcctgtccgcggccttttgagagtcggatgccccatctccgcctggtgcttcccataactcgtcgaatggccagtctctgc

SEQ ID NO: 728499 - DNA, 984 bp, Homo sapiens
ggggaagcaaggcatgtcgtacttggtggcaggagagagtgcagaggaaactgccacttataaaccgtcagatctcatgagaattccctcactatcatgagaacagcatgggggagaccacccctacaatccagtcacctcccaccaagtccctccctccacacatgggaattacaattcagattacaattcaaaatgagatttgggtggggacatagagccaaaccatatcagttagtcagtgaagactgaggtatctgtagaagtgagggaggagcacagtggtctggatgaaccagtggggtgatagtcaggggactggcattcagtgaggctgggggagaagcttcctaaaagcattgcccttgaaaagcagggcatacctatctgatactgaggatgtagaatgcagtttggagatgcttcctagctacctaatcttccaaggcaaaccatgcactcttcatcctgatatttgtgatgcctccctgggctacatgacagagggtgcactgcaaaggatgtgaaggaaagtcaccacagggcaaaggtggaaacccaggggcctttccccagtgagactttctggctgttcctttggaacttccacctgctagttgcagatgtttgccactggatggggccccatgctacgtgggaactgttcaggactgtgggtacttagttccagcagagctggctccaccagggcaccaggactgcaggcttctcaactcctggcctggagaggcagcttcagcaaccagtgcctgggaatccactagccctttctctgtgagtcacgtgagggcagaatctgctcaaagtcagagggctggagcaacctggattgtgccagagtgagggcccagctcactggaggtcagagtaagagagtcaaggatgggaagaaacagggttttgctcagtcttgcagatactgaggcactcaggaggctcaggatggcagcaacagggcatgtg

SEQ ID NO: 728500 - DNA, 847 bp, Homo sapiens
gaagaggccaagctgaaaaaggtagccagaatgggatttaatgcatcttccatgctccgaaaaagccagctaggtttcctcaacgtcaccagttactcccgtttagccaacgagctgcgtgtgagctgcatggagcggaaaaaggtccaaattcggagcttggatccctcctctttggcgagcgaccgatttaacttcattctggcgagtaccaacagcgaccagctcttcgtagtgaaccaggtcgaagtcgaaggctccaagtacggcatcatcagtctgcgaactctgaagatcccttcgttccacgtgtacgtgctcagaaacctctacgtccccaaccggaaggtgaagtccctgtgctgggcctcgctgaaccagttggactctcacgttctgctgtgcttcgagggaatcacagatgctccaagctgtgcagtgctgctcccagcgtcgcggttcttaagtgttcacacaagagttaaccagcctggcatgctctgcagtttccagatcccagaggcctggtcctgtgcgtggtccctcaacacccgggcatatcactgctttagtgcaggcttgtctcagcaggtcctgttgaccagcgtggcgacgggacaccagcagtcatttgataccagcagtgatgtcttggcccagcagtttgctagtacggctcctttgctgtttaatggctgtcgctccggggagatctttgccattgatctgcgttgtagaaatcgaggcaaggggtggagggccactcgcctgttccatgactcagcagtgacctctgtgcaaatcctccaagaagagcaatgcctgatggcatcagacatgactggaa

SEQ ID NO: 728501 - DNA, 613 bp, Homo sapiens
tttatgaaccaatcaagagtcaaagtcctttgttttaaaaaagttctattgacatggaattcaatattagcttaaagccagatactgtctaattgcttactacatcactttttgaggaacattaatgcaagtatttctagtcctaattttgcaatatcccaaagtatcaatgatatcaagtagggctcaagaatctacaaacatacttttaaagtttttaattaaaaaatgtattctggatatgacaccaaaagctcatatcccaaaaatcattgcaaagactaatgtcaagaaactttctccctatgttttcttctaggcattttacggttttgggtactgcatttgggtctttaagccattttggattaagttttgtacatagtgtgaggtaacggttcagtttcactcttttgcacatggatatgcagtttctccaataccatttatcgaaaagactatcctttccacatttctattcttggaacctgatcaaatgtgattttttttctaaaaaaaaatttgctttctaatttgtcacattgttctatgtgtctgaaaaaaaaaaatgtattctggccagcatgtcataaatacgagagtaataaatgat

SEQ ID NO: 728502 - DNA, 2161 bp, Homo sapiens
agaagaaagagacagcgatggcggcagaggcttcgaagactgggccttctaggtcttcctaccagcgaatggggaggaagagtcagccctggggtgccgctgaaatccagtgcaccaggtgtggaaggagggtatccagatcatccggtcaccattgtgaacttcaatgtggacatgctttttgtgaactatgcttgttaatgactgaagaatgcaccacaattatatgccctgattgtgaggttgctacagctgtaaatactagacaacgctactacccaatggctggatatattaaggaagactccataatggaaaaactgcagcctaagacgataaagaattgttctcaggactttaagaagactgctgatcagctaactactggtttagaacgttcagcctccacagacaagactcttttgaactcatcagctgtaatgttggacactaatactgcagaagaaattgatgaagcattgaatacagcacaccatagtttcgaacagttaagcattgctggaaaagcacttgaacacatgcagaagcaaacgatagaggaaagagaaagagttatagaagttgtggagaaacagtttgaccaacttttggctttttttgattccaggaaaaagaacctgtgtgaagaatttgcaagaactactgatgattatctatcaaatttaataaaggctaaaagctacattgaagagaaaaaaaataatttgaatgcagctatgaacatagcaagagcattacaattatcgccttctctaagaacatactgtgacctgaatcagattatccggactttgcagttaacttcagatagtgaattagcacaagttagttctccacaactaaggaaccctcccaggttgagtgtgaattgcagtgagatcatctgtatgttcaacaatatgggaaagattgaatttagggactcaacaaaatgttatccccaagaaaatgaaattagacagaatgttcaaaagaaatataataacaaaaaggaactttcttgttacgatacatacccaccgctagaaaagaaaaaggttgacatgtctgtcctaaccagtgaagcaccaccacctcctttgcaacctgagacaaatgatgtacatttagaagcaaaaaacttccagccacagaaagacgttgcaacagcatcccctaaaaccattgctgtgttacctcagatgggatctagccctgatgtgataattgaagaaattattgaagacaacgtggaaagttctgcagagctagtttttgtaagccatgtaatagatccttgccatttctacattcggaagtattcacaaataaaagacgccaaagtactggagaagaaggtgaatgaattttgcaataggagttcacaccttgatccttcagacattttggaactaggtgcaagaatatttgtcagcagtattaaaaatggaatgtggtgtcgaggaactatcacagaattaattccaatagagggtagaaataccagaaaaccttgtagtccaaccagattatttgtccatgaagttgcactaatacaaatattcatggtagattttggaaattctgaagtcctgattgtcactggagttgttgatacccatgtgagaccagaacactctgctaagcaacatattgcactaaatgatttatgtctggttctaaggaaatctgaaccatatactgaagggctgctaaaagacatccagccattagcacaaccatgctcattgaaagacattgttccacagaattcaaatgaaggctgggaagaggaagctaaagtggaatttttgaaaatggtaaataacaaggctgtttcaatgaaagtttttagagaagaagatggtgtgcttattgtagatctgcaaaaaccaccaccgaataaaataagcagtgatatgcctgtgtctcttagagatgcgctagtttttatggaactagcaaaagatctgatctaataaagttggttgagacactttctcattttttcaatgtttctgtattggaagaagaacttaaagcttcctaatctattttgttggcgtcattcctctgctgaatttttaaatgttcactctggcttacctgttaatggaagaatttgcataatatctacttagaaagatagtgggccccggag

SEQ ID NO: 728503 - DNA, 2302 bp, Homo sapiens
agaagaaagagacagcgatggcggcagaggcttcgaagactgggccttctaggtcttcctaccagcgaatggggaggaagagtcagccctggggtgccgctgaaatccagtgcaccaggtgtggaaggagggtatccagatcatccggtcaccattgtgaacttcaatgtggacatgctttttgtgaactatgcttgttaatgactgaagaatgcaccacaattatatgccctgattgtgaggttgctacagctgtaaatactagacaacgctactacccaatggctggatatattaaggaagactccataatggaaaaactgcagcctaagacgataaagaattgttctcaggactttaagaagactgctgatcagctaactactggtttagaacgttcagcctccacagacaagactcttttgaactcatcagctgtaatgttggacactaatactgcagaagaaattgatgaagcattgaatacagcacaccatagtttcgaacagttaagcattgctggaaaagcacttgaacacatgcagaagcaaacgatagaggaaagagaaagagttatagaagttgtggagaaacagtttgaccaacttttggctttttttgattccaggaaaaagaacctgtgtgaagaatttgcaagaactactgatgattatctatcaaatttaataaaggctaaaagctacattgaagagaaaaaaaataatttgaatgcagctatgaacatagcaagagcattacaattatcgccttctctaagaacatactgtgacctgaatcagattatccggactttgcagttaacttcagatagtgaattagcacaagttagttctccacaactaaggaaccctcccaggttgagtgtgaattgcagtgagatcatctgtatgttcaacaatatgggaaagattgaatttagggactcaacaaaatgttatccccaagaaaatgaaattagacagaatgttcaaaagaaatataataacaaaaaggaactttcttgttacgatacatacccaccgctagaaaagaaaaaggttgacatgtctgtcctaaccagtgaagcaccaccacctcctttgcaacctgagacaaatgatgtacatttagaagcaaaaaacttccagccacagaaagacgttgcaacagcatcccctaaaaccattgctgtgttacctcagatgggatctagccctgatgtgataattgaagaaattattgaagacaacgtggaaacatgcggcacagatgatcttggggagacacctagatatccaaaaaagcctcttcagaaaaactcatctgttccttttggatcaaaagcagatactgtaacaactgtctgagcttgatgtagtggagtttactgtatgtgtagttctgcagagctagtttttgtaagccatgtaatagatccttgccatttctacattcggaagtattcacaaataaaagacgccaaagtactggagaagaaggtgaatgaattttgcaataggagttcacaccttgatccttcagacattttggaactaggtgcaagaatatttgtcagcagtattaaaaatggaatgtggtgtcgaggaactatcacagaattaattccaatagagggtagaaataccagaaaaccttgtagtccaaccagattatttgtccatgaagttgcactaatacaaatattcatggtagattttggaaattctgaagtcctgattgtcactggagttgttgatacccatgtgagaccagaacactctgctaagcaacatattgcactaaatgatttatgtctggttctaaggaaatctgaaccatatactgaagggctgctaaaagacatccagccattagcacaaccatgctcattgaaagacattgttccacagaattcaaatgaaggctgggaagaggaagctaaagtggaatttttgaaaatggtaaataacaaggctgtttcaatgaaagtttttagagaagaagatggtgtgcttattgtagatctgcaaaaaccaccaccgaataaaataagcagtgatatgcctgtgtctcttagagatgcgctagtttttatggaactagcaaaagatctgatctaataaagttggttgagacactttctcattttttcaatgtttctgtattggaagaagaacttaaagcttcctaatctattttgttggcgtcattcctctgctgaatttttaaatgttcactctggcttacctgttaatggaagaatttgcataatatctacttagaaagatagtgggccccggag

SEQ ID NO: 728504 - DNA, 2132 bp, Homo sapiens
agaagaaagagacagcgatggcggcagaggcttcgaagactgggccttctaggtcttcctaccagcgaatggggaggaagagtcagccctggggtgccgctgaaatccagtgcaccaggtcaccattgtgaacttcaatgtggacatgctttttgtgaactatgcttgttaatgactgaagaatgcaccacaattatatgccctgattgtgaggttgctacagctgtaaatactagacaacgctactacccaatggctggatatattaaggaagactccataatggaaaaactgcagcctaagacgataaagaattgttctcaggactttaagaagactgctgatcagctaactactggtttagaacgttcagcctccacagacaagactcttttgaactcatcagctgtaatgttggacactaatactgcagaagaaattgatgaagcattgaatacagcacaccatagtttcgaacagttaagcattgctggaaaagcacttgaacacatgcagaagcaaacgatagaggaaagagaaagagttatagaagttgtggagaaacagtttgaccaacttttggctttttttgattccaggaaaaagaacctgtgtgaagaatttgcaagaactactgatgattatctatcaaatttaataaaggctaaaagctacattgaagagaaaaaaaataatttgaatgcagctatgaacatagcaagagcattacaattatcgccttctctaagaacatactgtgacctgaatcagattatccggactttgcagttaacttcagatagtgaattagcacaagttagttctccacaactaaggaaccctcccaggttgagtgtgaattgcagtgagatcatctgtatgttcaacaatatgggaaagattgaatttagggactcaacaaaatgttatccccaagaaaatgaaattagacagaatgttcaaaagaaatataataacaaaaaggaactttcttgttacgatacatacccaccgctagaaaagaaaaaggttgacatgtctgtcctaaccagtgaagcaccaccacctcctttgcaacctgagacaaatgatgtacatttagaagcaaaaaacttccagccacagaaagacgttgcaacagcatcccctaaaaccattgctgtgttacctcagatgggatctagccctgatgtgataattgaagaaattattgaagacaacgtggaaagttctgcagagctagtttttgtaagccatgtaatagatccttgccatttctacattcggaagtattcacaaataaaagacgccaaagtactggagaagaaggtgaatgaattttgcaataggagttcacaccttgatccttcagacattttggaactaggtgcaagaatatttgtcagcagtattaaaaatggaatgtggtgtcgaggaactatcacagaattaattccaatagagggtagaaataccagaaaaccttgtagtccaaccagattatttgtccatgaagttgcactaatacaaatattcatggtagattttggaaattctgaagtcctgattgtcactggagttgttgatacccatgtgagaccagaacactctgctaagcaacatattgcactaaatgatttatgtctggttctaaggaaatctgaaccatatactgaagggctgctaaaagacatccagccattagcacaaccatgctcattgaaagacattgttccacagaattcaaatgaaggctgggaagaggaagctaaagtggaatttttgaaaatggtaaataacaaggctgtttcaatgaaagtttttagagaagaagatggtgtgcttattgtagatctgcaaaaaccaccaccgaataaaataagcagtgatatgcctgtgtctcttagagatgcgctagtttttatggaactagcaaaagatctgatctaataaagttggttgagacactttctcattttttcaatgtttctgtattggaagaagaacttaaagcttcctaatctattttgttggcgtcattcctctgctgaatttttaaatgttcactctggcttacctgttaatggaagaatttgcataatatctacttagaaagatagtgggccccggag

SEQ ID NO: 728505 - DNA, 2273 bp, Homo sapiens
agaagaaagagacagcgatggcggcagaggcttcgaagactgggccttctaggtcttcctaccagcgaatggggaggaagagtcagccctggggtgccgctgaaatccagtgcaccaggtcaccattgtgaacttcaatgtggacatgctttttgtgaactatgcttgttaatgactgaagaatgcaccacaattatatgccctgattgtgaggttgctacagctgtaaatactagacaacgctactacccaatggctggatatattaaggaagactccataatggaaaaactgcagcctaagacgataaagaattgttctcaggactttaagaagactgctgatcagctaactactggtttagaacgttcagcctccacagacaagactcttttgaactcatcagctgtaatgttggacactaatactgcagaagaaattgatgaagcattgaatacagcacaccatagtttcgaacagttaagcattgctggaaaagcacttgaacacatgcagaagcaaacgatagaggaaagagaaagagttatagaagttgtggagaaacagtttgaccaacttttggctttttttgattccaggaaaaagaacctgtgtgaagaatttgcaagaactactgatgattatctatcaaatttaataaaggctaaaagctacattgaagagaaaaaaaataatttgaatgcagctatgaacatagcaagagcattacaattatcgccttctctaagaacatactgtgacctgaatcagattatccggactttgcagttaacttcagatagtgaattagcacaagttagttctccacaactaaggaaccctcccaggttgagtgtgaattgcagtgagatcatctgtatgttcaacaatatgggaaagattgaatttagggactcaacaaaatgttatccccaagaaaatgaaattagacagaatgttcaaaagaaatataataacaaaaaggaactttcttgttacgatacatacccaccgctagaaaagaaaaaggttgacatgtctgtcctaaccagtgaagcaccaccacctcctttgcaacctgagacaaatgatgtacatttagaagcaaaaaacttccagccacagaaagacgttgcaacagcatcccctaaaaccattgctgtgttacctcagatgggatctagccctgatgtgataattgaagaaattattgaagacaacgtggaaacatgcggcacagatgatcttggggagacacctagatatccaaaaaagcctcttcagaaaaactcatctgttccttttggatcaaaagcagatactgtaacaactgtctgagcttgatgtagtggagtttactgtatgtgtagttctgcagagctagtttttgtaagccatgtaatagatccttgccatttctacattcggaagtattcacaaataaaagacgccaaagtactggagaagaaggtgaatgaattttgcaataggagttcacaccttgatccttcagacattttggaactaggtgcaagaatatttgtcagcagtattaaaaatggaatgtggtgtcgaggaactatcacagaattaattccaatagagggtagaaataccagaaaaccttgtagtccaaccagattatttgtccatgaagttgcactaatacaaatattcatggtagattttggaaattctgaagtcctgattgtcactggagttgttgatacccatgtgagaccagaacactctgctaagcaacatattgcactaaatgatttatgtctggttctaaggaaatctgaaccatatactgaagggctgctaaaagacatccagccattagcacaaccatgctcattgaaagacattgttccacagaattcaaatgaaggctgggaagaggaagctaaagtggaatttttgaaaatggtaaataacaaggctgtttcaatgaaagtttttagagaagaagatggtgtgcttattgtagatctgcaaaaaccaccaccgaataaaataagcagtgatatgcctgtgtctcttagagatgcgctagtttttatggaactagcaaaagatctgatctaataaagttggttgagacactttctcattttttcaatgtttctgtattggaagaagaacttaaagcttcctaatctattttgttggcgtcattcctctgctgaatttttaaatgttcactctggcttacctgttaatggaagaatttgcataatatctacttagaaagatagtgggccccggag

SEQ ID NO: 728506 - DNA, 694 bp, Homo sapiens
cgccagcgaggacgccgtccagggcatcgccaaggaggatgccgcccagggcatcgccaacgaggacgccgcccagggcatcgccaacgaggacgccgcccagggcatcgccaaagaggacgccgcccacggcatcgccaacgagctgtatacgacatcgctaacgaggacaccctacaagccgtcgctaacaagtacactgtacacaacatcgctaatgagggcactgtacaagacatcaccaatgagggcgctttatacgacattgctaatggcaccgacaaggcacgctaacgtggacgctgtacacgacattgctaatgaggacagcgtataagacatcgctagtaactatcgcaagaacaaaaaaccaaacaccgcatattctcactcatagatgggaattgaacaatgagatcacatggacacaggaaggggaatatcacactctggggactgttgtggggtggggggggagggatagcatcgggagatatacctaatgctagatgatgagttagtgggtgcagcgcaccagcgtggcacatgtatacatatgtaactaacctgcacaatgtgcacatgtaccctaaaacttaaagtatatatatataaaaaaagacatcgctagtgagcacgctgtatacgacatcgctaatgaggacaccatacaaggcatcgctaacgatgacgc

SEQ ID NO: 728507 - DNA, 847 bp, Homo sapiens
aggaatgccacctagctttagttacttcataaaggttcctggactccagctattagaataggaaaactgagacttgtctagcttggtgagaggtctgagtgccccttaaagacttgggagcccccacccaaaccttttgtttacagaagaggagtaaatgccacagaatgctttgaaattccccctctgtgccccatcagcaccccagaaagaggagccggagaccatggaatagcaatagtctctcaggccctctgggctccccctttggaagccagtctcccagctcctgccctggggggaacgttccaacagggtctcagagacatcctgggataatgagggtcccctccttctggagcccaactggaaggcagagaatggtcactttgacctcgaggggcatctataaggggcactaagcagaggccagatttgctgaggaaatcctgaatgaggagcaggtggagagaaaaaggaggccattctcaactgaggaagggtgggctgggagggaggggccagggataatttatgatatcattgctcccccgccgcacttacttcccagccctctgctactgtaccgttgctaggagagcctggctctgtctggggctgggagggtgtaacaagcgggaggctgttccatctgcactcctcctcccccacccaggggagggcaccgcatggagctggatccaccaccccttcccaggccctgacagacaccagtctcttctgtcgttcccccaaatctagccactcaagggatagcaggactcccagttgggctgaggatctagagcaaggaatgggcaagagagcatggaaggagacacactgg

SEQ ID NO: 728508 - DNA, 1021 bp, Homo sapiens
  misc_feature (818)..(818): n is a, c, g, or t
  misc_feature (839)..(839): n is a, c, g, or t
  misc_feature (1013)..(1013): n is a, c, g, or t
gctctgccctccgcctcctcttctccgcccactctcgccgcggtctcttggcggcggaggctttgtctcgtgggctggtccccagcggctccctccccgaacagctgctgctccagggaggaagcggcgcgggtgctgtccagcttcccggtgctgaaaaccggagggctcgtcatccaccactaccatgtaagggccatgagaagggctcatcctggcgcacgcggacatggaggaggacttattccagctaaggcagctgccggttgtgaaattccgtcgcacaggcgagagtgcaaggtcagaggacgacacggcttcaggagagcatgaagtccagattgaaggggtccacgtgggcctagaggctgtggagctggatgatggggcagctgtgcccaaggagtttgccaatcccaccgatgatactttcatggtggaagatgcagtggaagccattggctttggaaaatttcagtggaagctgtctgttctcactggcttggcttggatggctgatgccatggagatgatgatcctcagcatcctggcaccacagctgcattgcgagtggaggctccaagctggcaggtggcattgctgacctcggtggtctttgtaggcatgatgtccagctccacgctctggggaaatatctcagaccagtacggcaggaaaacagggctgaagatcagcgtgctgtggactctgtactatggcatccttagtgcatttgcgcccgtgtatagctggatcctggtgctccggggcctggtgggcttcgggatcggaggagttccccagtcggtgacgctgtntgccgagttccttcccatganagccagagctaaatgtattttgctgattgaggtattctgggccatcgggacagtgttcgaggtcgtcctggctgtgttcgtgatgcccagcctgggctggcgttggctgctcatctctcagctgtccgctcccctctttgccgtgctgtgtttctggctgctgaaatgcaaggnatgatgtg

SEQ ID NO: 728509 - DNA, 847 bp, Homo sapiens; identical to SEQ ID NO: 212130

SEQ ID NO: 728510 - DNA, 2815 bp, Homo sapiens; identical to SEQ ID NO: 238003

SEQ ID NO: 728511 - DNA, 2762 bp, Homo sapiens
tagtacattgaaattcaaagtcatgcttgttactgttaatgaaagcagatttaaagcaacaccaccatcactggagtatttttagttatatacgattgagactaccaagcatgttgctcttattcagtgtaatcctaatctcatgggtatccactgttgggggagaaggaacactttgtgattttccaaaaatacaccatggatttctgtatgatgaagaagattataaccctttttcccaagttcctacaggggaagttttctattactcctgtgaatataattttgtgtctccttcaaaatccttttggactcgcataacatgcacagaagaaggatggtcaccaacaccgaagtgtctcagaatgtgttcctttccttttgtgaaaaatggtcattctgaatcttcaggactaatacatctggaaggtgatactgtacaaattatttgcaacacaggatacagccttcaaaacaatgagaaaaacatttcgtgtgtagaacggggctggtccactcctcccatatgcagcttcactaaaggagaatgtcatgttccaattttagaagccaatgtagatgctcagccaaaaaaagaaagctacaaagttggagacgtgttgaaattctcctgcagaatcacctaactttccaacatgcaaaggacaagtacgatcatgtggtccacctcctcaactctccaatggtgaagttaaggagataagaaaagaggaatatggacacaatgaagtagtggaatatgattgcaatcctaattttataataaacgggcctaagaaaatacaatgtgtggatggagaatggacaactttacccacttgtgttgaacaagtgaaaacatgtggatacatacctgaactcgagtacggttatgttcagccgtctgtccctccctatcaacatggagtttcagtcgaggtgaattgcagaaatgaatatgcaatgattggaaataacatgattacctgtattaatggaatatggacagagcttcctatgtgtgttgcaacacaccaacttaagaggtgcaaaatagcaggagttaatataaaaacattactcaagctatctgggaaagaatttaatcataattctagaatacgttacagatgttcagacatcttcagatacaggcactcagtctgtataaacgggaaatggaatcctgaagtagactgcacagaaaaaagggaacaattctgcccaccgccacctcagatacctaatgctcagaatatgacaaccacagtgaattatcaggatggagaaaaagtagctgttctctgtaaagaaaactatctacttccagaagcaaaagaaattgtatgtaaagatggacgatggcaatcattaccacgctgtgttgagtctactgcatattgtgggccccctccatctattaacaatggagataccacctcattcccattatcagtatatcctccagggtcaacagtgacgtaccgttgccagtccttctataaactccagggctctgtaactgtaacatgcagaaataaacagtggtcagaaccaccaagatgcctagatccatgtgtggtatctgaagaaaacatgaacaaaaataacatacagttaaaatggagaaacgatggaaaactctatgcaaaaacaggggatgctgttgaattccagtgtaaattcccacataaagcgatgatatcatcaccaccatttcgagcaatctgtcaggaagggaaatttgaatatcctatatgtgaatgaagcaagcataattttcctgaatatattcttcaaacatccatctacgctaaaagtagccattatgtagccaattctgtagttacttcttttattctttcaggtgttgtttaactcagttttatttagaactctggatttttagagctttagaaatttgtaagctgagagaacaatgtttcacttaataggagggtgtcttagtccatattacattgttataacagagtatcacagactggataacttctaaccaatagtttatttgtttcataaatctaaaagctgagaagtccaagatggtggggctgcctctggtgagggtcttctcgaagcatcataatatgctggaaggcatcacaacatggtggaagggatcacgtggcaaaagagcatgtacatgggagtgagagaaaaagagagagagagacagagtggcgggggccggggaggagcgcaaactcatcctttataaagacaccactcctgagataacaatccaatcccatgataatgacattaatccattcaagaagatagagctctcgtgacttaatcaccttctaaagatctcacctgacaacactgttgcattggcagttaagtttccacgtaaactttcggggacacattcaaaccacaggagaaactcaaattgttcctgggcaaatcacaacatggggaattttattcataaatgtccacagaaacagtaaatgttctcgcttcagaacttaattcatctaatccctcctgtttgtctcaaattataggataactttgaaactttctgaattaacgttatttaaaaggaaatgtagatgttattttagtctctatcttcaggttattatcacttaaaaacctgcgaaagctgtcaacttttgtggttgtagcaagtattaataaatatttataaatcctctaatgtaagtctagctacctatccaatactaaataccccttaaagtattaaatgcactatctgctgtaaacgg

SEQ ID NO: 728512 - DNA, 650 bp, Homo sapiens; identical to SEQ ID NO: 246010

SEQ ID NO: 728513 - DNA, 591 bp, Homo sapiens
cgcaccccctttgtttttctgcgtaagtgaaaacattttggtgaagtctagcaggaactagagcactagctcctctatttgaagtgaacgcccaaaccgtggcacgtggccagctgtcttttgggtggcacagggaacagttggtgacagctggatacaatcaagttccattacaaacagattttaagtgtcatttacacacagaagaaattgcaagctttagcaaaataaaatctgggggttttcaaagcaagacaatgccccaatccaagcctgtgtgagcagttcgctttgcagcctcttgcggggattaacaccccttcttcaccaggctccaccctctctgcaaggtctatgctgcaaaattagcaagtccaggaggcttgctccctggcagagctgctgagtcctctgtcttctatttattcactttttgaagaaccctgaattaaaggcctgtctaaccactgttcagcctactccttttgggtgggaggggtcagaggctggcttctagaatcacacagtgattgggcaagtgaaggctggcatgcccagctaaacctcatctcctttttttttttttttttt

SEQ ID NO: 728514 - DNA, 867 bp, Homo sapiens
ctgtagtgggccactcagttagttcacccaggctcccacattctccatgctctgtttcaggaaacaaccagaactgtggacagtcttaccaaagacactaacatcatcaccagagaattaaagaaatccagtgagtggcccacaacaattggctggcataggacatgatcctagcttcccacagggcacttgggattgtgcagtcagaagtgattgatgtgcatatgtttccacagacctctctgatgtctatgccgtcaccaaaaatattcagactgcaaaccaggaaatgcattgaattgccaccattgtccttatacttccgtttaaggacactccaggcccaacgtctcaaggccttttaggctagcttccttcaaacctcaaatcttggttgctgtctaatttaacctttaacccttttaccatttgccctgagaacacttgccggcagcacttccagctgcagcgtttacccaaagatacctctgccaggaaagaccttgcttttattattacttttgcatttctctagcatattgacattggaaacaaaagacatcattctatatatagcattctggttttagtggtggtagttccatttacaaaatatagtaattcttgatcactgaaaatgtcagagcctagaaaacggagcattcctatgcgtgatgttaacatcattaaacagttgttggccaaagactcatgtgatgaatccaatttttctaaaataaatagctcagatgattcagatgattctgatattaggtctgtttagaaataaaacttcaaaaacagtttttatattttacttccacattgaaaatcagtcagatttgctttggcctcaaagaatgtgtt

SEQ ID NO: 728515 - DNA, 398 bp, Homo sapiens; identical to SEQ ID NO: 250541

SEQ ID NO: 728516 - DNA, 350 bp, Homo sapiens
gactggttgcaaattctgttttttattattgtcttggcatcttgatatctagaccactcctacaagtttatctggcagtaggaacttggtgcatttttttctacgctacacccccccacccttaatctttctttgctgtcataatattcagtagcatttataaaagctgtctagttagctctttaaaaacttttgtcctgcaaaatgtttgttagtcaacacactactttgtgtaaacaactattatgtttccttgggaccatcacaagctctttaacaaacacaaggactcaattcattcagcaggtggggattaaagaatcaaagcccagtagcaaaaccaaaactga

SEQ ID NO: 728517 - DNA, 1048 bp, Homo sapiens
tataggcagaaatatatatatttggctattttcctctgaagaactctgactaatacaacctgtgttttaattaggatacttttgattacatataaaagcaaccctgagtcaaactgacttaaacttcattacacaataaggacaggtagcacaactttcaggactggttctttccctggctaacatttatgcatatcttatcaaagatgcagaatttattttatctgtcacatctaccatgctcataatcagtttcatcttcaaactgcagctcatactgcaagtaatcttattattacccaaacacaatcatattcaggagaagaagctaaaacattttttttctgtgtccattgatattaatgagtacatttttttttccagaagcttattagacaacttctcttcatgattgaagaattggggagttgggtctcatacaattactggtatcagttctattgaaataaattggtattggataagatcccgagaatacaaactcacgcgtgatgattgggtaattaacaaaaattgtgactcttttaggaaggaatgagtaggtagttgcaatacacaaattgactacatccgatggtccttagtttctctatttataaaatgggtggaggaatagtgtctaccacataagcttttcttgaatgttaaatctgattctgtaattaataaaagggcttatccccatgattgatgcataatacctacttgataagtgttagttaccattcatttaaagatcggtattttattttccattatgtactactcaactaataatctgtaaggaagaaaacgatggggagagaggaagagggaaagaggaaggtttctacctttcctttacacttactgatttattgttaccaatcctgagattaaatattaactgataatgttatgcaaactatttttaccgagcaggacagattatttttcaaaatcatgttttccaaacaggcattttattattttcctatttttgaataattttggatccattgagcgtatttgtaaatcctcaaagtaa

SEQ ID NO: 728518 - DNA, 831 bp, Homo sapiens; identical to SEQ ID NO: 229710

SEQ ID NO: 728519 - DNA, 912 bp, Homo sapiens
aatctgagaatacacgtagaaacatttcggctgaagagaacaactatgaaagagatatttcaagagaatgaaaaatattttttgtttgtctgaaagtgaataatgtgaaggtgctttatagggccctgtatattttacattttaataataataaagacaatagctaaaagtaaatgagctccgtaatttgcttggtgatttctatataagtcttcttttatgtaaaacacaaaacaaaacataacccaaaaaatctatgcaaaatataccaggatatatctttttttttttttggttctactactgtattagttcattttcacgctgctgataaagatatacccgagactgggatatttacaaaagacgaggttttattggacttacagttctgtatggctggggaggcttcacaatcatggtggaagaaaaggaggagaaagtcacatcttacggggatggcaggaggcaaaaagaaaccttgtgcagggaaactgccatttttaaaaccgtgagatctcatgagactcattcagtaccatgagaacagtgaaggaaagacctgaccccatatttcagtcacctcccactgggttcttctcatgacatgtgggaattgtgggagttacaattgaaaatgagatttgggtagggacatagccaaaccatattaactactatacaaattaactatttaaatttatttttttaatgtacattaaaaactgtaaatttcttaaggaggaaagaagaaactgtttttcattttctaggtgataagttaggaaacattaagaaacaagcttgtgatcttatcctgatctcaaatgacataaatttagaccatatttcatctgctgcctaaagtttcagcatcctagggaaagaaaagaacagatattttaaaaagaa

SEQ ID NO: 728520 - DNA, 640 bp, Homo sapiens; identical to SEQ ID NO: 202286

SEQ ID NO: 728521 - DNA, 713 bp, Homo sapiens
ccgcctactactactaaattcgcggccgcgtcgacgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcatgtcctaaagtgtgtatttctcattttccgtgattttcagttttctcgccatattccatgtccttcagtgtgcatttctcatttttcacttttttagtgatttcgtcatttttcaagtcgtcaagtggatgtttctcattttccatgattttcagttttctgtcgacgcggccgcgaatttagtagtagtaggcggcgg

SEQ ID NO: 728522 - DNA, 465 bp, Homo sapiens
ggtgtgcacagctaagcatgctttcagctcgctggctgcatcttttccagtggggactcactgtgcgtcaggagcacacaaagaaagctgacatttgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatgtcgacgcggccgcgaatttagtagtagtaggcggcgg

SEQ ID NO: 728523 - DNA, 439 bp, Homo sapiens
ccttcagtgtgcatttgtcatttttcacgtttttcagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatgtcgacgcggccgcgaatttagtagtagtaggcggcgg

SEQ ID NO: 728524 - DNA, 840 bp, Homo sapiens
ccttcagtgtgcatttgtcatttttcacgtttttcagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcatgtcctaaagtgtgtatttctcattttccgtgattttcagttttctcgccatattccatgtccttcagtgtgcatttctcatttttcacttttttagtgatttcgtcatttttcaagtcgtcaagtggatgtttctcattttccatgattttcagttttctgtcgacgcggccgcgaatttagtagtagtaggcggcgg

SEQ ID NO: 728525 - DNA, 510 bp, Homo sapiens
ccttcagtgtgcatttgtcatttttcacgtttttcagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttgtcgacgcggccgcgaatttagtagtagtaggcggcgg

SEQ ID NO: 728526 - DNA, 383 bp, Homo sapiens
ccgcctactactactaaattcgcggccgcgtcgacgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttgtcgacgcggccgcgaatttagtagtagtaggcggcgg

SEQ ID NO: 728527 - DNA, 312 bp, Homo sapiens
ccgcctactactactaaattcgcggccgcgtcgacgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatgtcgacgcggccgcgaatttagtagtagtaggcggcgg

SEQ ID NO: 728528 - DNA, 866 bp, Homo sapiens
ggtgtgcacagctaagcatgctttcagctcgctggctgcatcttttccagtggggactcactgtgcgtcaggagcacacaaagaaagctgacatttgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcatgtcctaaagtgtgtatttctcattttccgtgattttcagttttctcgccatattccatgtccttcagtgtgcatttctcatttttcacttttttagtgatttcgtcatttttcaagtcgtcaagtggatgtttctcattttccatgattttcagttttctgtcgacgcggccgcgaatttagtagtagtaggcggcgg

SEQ ID NO: 728529 - DNA, 536 bp, Homo sapiens
ggtgtgcacagctaagcatgctttcagctcgctggctgcatcttttccagtggggactcactgtgcgtcaggagcacacaaagaaagctgacatttgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttgtcgacgcggccgcgaatttagtagtagtaggcggcgg

SEQ ID NO: 728530 - DNA, 719 bp, Homo sapiens
ctgctctgggaagatatatttaatttatgtatttttgtttactctgaactcttccaggtactataagagaagctgacttattaagattgcatcctctctctctccaatccctttaatggtttatggtctaagagtagattgaactcttagacagagaagactattgattgatagaccgatagcataagcaaagataatgataccaactctgcctttcactttctttcttttttttttttttttttgttagacggagtcttactctgtcacccaggttggagtgcaatggtgccatctcggctcactgcaaccactgcctcctaggtttaagcaattctcctgccttagcctcctgagtagctgggattacaggcacctaccaccatgcccagctaatttttttgtatttttagtggacacagggtttcgccatgttggccgggctggtctcaaactcctgacctcaggtgatccactcacctcggcctctgaaagtgctgggactgcaggcttgagccaccacacctggcctgcctttcattttttgagcccctgctttataccaggcactgtactctctgctttatgtatatttgcatttttcaaatgtggatctgcagacctgttttcaagttatatttaagaatgtcttaattttgctgctcttctagaagatgccctataaccaagtttctatgtttgcatttaaaagaagaaag

SEQ ID NO: 728531 - DNA, 777 bp, Homo sapiens
  misc_feature (406)..(406): n is a, c, g, or t
tccacattcactttcttccctgttttagggaagaaaatgatcatagacattcgattttccaaattggcgctcttattttcaatgctaattggattacttctcttccaaccctcctgcccatccatccatcccagtccccaggcatcttaaccttaccatctgagcttcagctgaaatctgtttataggcaacattgaaagtaccagattggggccaggtgtagcggcccacacctgtaatcccagcactttgggaggcggaggctagcggatcatgaggtcaggagttcaagaccagcctggccaacatggtgaaacccccatctctactaaagatataaaaaactagccgagcgtggtgttgcatgcctgtgatcccagctactcgggaggctgaggcgggggantcgcttgaaccggggaggcagaggttgcggtgagccagatcgtgcattgcactccagcctggccgacagggtgagactccatctcaaaaaagagaaagtaccagattgtacttttaacatctgtctagcgtatcgacgaattttagtgggagctcgttgatttatttctcagggcatacatgtgccaatctgtctcactgatgtctctctctttttcaaaataaatacaggaagaaggactccacttgtgtcacccaaaggcgtagcaaaggagcaaaccatcagggacacagagggcatagagacccagaaatcacagagaacaggaggccaaagctcgcgaagagagtgggaatcacggcacaaaacag

SEQ ID NO: 728532 - DNA, 674 bp, Homo sapiens
ttgtatgtctgtactgatctatactgggtgctgggcaaacgggcattcttaaacactcctagtagggaagaaattggtacaacctttccggaggacaatttaactgatttatttaaagcccgaaaaatgtacatacctttaactcagcagtttcgttactgatttatcttaaggaagtaatttagaatctgtgcctaactgtttacaataactcatagatgaaaaaggcaaaacaaaacacaagtaacctcaaatctccccatgtaacagtttgcttaaacactatagcgttattttacgcaagctacagaagcattgttgaaacatatatttattaggacagaaaaaaattcatgaaatgttattttatcttcttttttcttaaaatggaacttaaaaaaaatttttttaactccaacctaccttttacaccatctgcagagctttcctctcccaaatcaaagctactcctgttcctacctccaggatggaatccccaccttcgtatgcaagggtcttcatgatatggcctcagccaagctatcttagctccagtcacggccccatcttccatatcctatgctgcttgcacaggaagcagctcgctaaccccaggcacacctgctttcatctggagcgtctgcccatcatgattcctccccctggtcccttca

SEQ ID NO: 728533 - DNA, 876 bp, Homo sapiens
agaccataatggatccttaccttagaaaaaaagcacatacatcaaaatttggcatgcaatttcaggagtttgttaacctcctaaggacctccacaaacctgctagaagtacaaagaacctaggttaaaaaaatccctgttttagagtgacatatgcaaaaatggtgcagaatggaactccaggtgcttgtccctcccaggaacaccaagaaacttgcaaacactgtcagaatcaagtttattagaactctgaagatagtcaaaagtttatggcaactaagataacttttaaccaggaaagggctgaaatgtagtaggaaagctttgcggcattttaacctactcttacgcaaccccctccccagcctggcagcaacctttaagacagcagcctgagttctcactgtgggttcctggttctggaaggagtagagcagaacttgtttccaagaaattgtgtttgtctgttttgacctgtttggaggttccctgaaaaactgatgcaaagggcttgcctttgttttgcataactgggaattctctcagggtggaaaagtagctttgtaaataaagaatggtcctcaaaaacattaaaaggcaaatgaatgagatgttgaaacctcaacaaaagatacagttgaggcaaacaagacacatgttgaaaacctggctggaaaggtggggagtaagatacttgggctatgagggatgtgaaaagctcccacatgtatcagacagtctgaaggcccatgcacatgtccagggcagagtccacaatcagaaaaaacatgaagagacctacgcttttacttctagttttcctttaggcttagcacaagcagggagtaaagtagtgctaagtcatagctgtaatcag

SEQ ID NO: 728534 - DNA, 152 bp, Homo sapiens
cactgatttgttgtgaggctctaggactctaagccagctgcgaggtctctgtgacagtggactcatgcctctcttccaattcgccagtgattgctgccagacctttcaccatcccctacctgacagctcttcttccgtctgaactggagatg

SEQ ID NO: 728535 - DNA, 695 bp, Homo sapiens
ggtgcgcaccatcacacccagctaatttttgtatttttagtagagatgggggtttcaccatgttggccaggctggtctcgaactcctgacctcatgatccacccaccttgacctcccaaagtgctgggattacaggcgtcagccaccgcgtccagccagggaagatgatttctataggacagagggaaagagcatattctaggttgaagaaaccatatggataaagaggcaggaaaacacagaccatgttcagtaaacaataagaaatccagtttgcctgaattatagagtacttgttaaagaagaggagaactaggagaaaagtagtattatagtagggcataaaggactaggatatcaggctgagtttatcctgaattccatttttaaactctagctgtgaatcaaaataatttgtagaactttatttatttatttttaaatacagatatctgcatctcacctaagactttaatcaatgaggaaatcactgaaggtttctgagccaggaaatgccattgattgttaatttatttattcaatcaacaaatatgataagcagctaccatttgtcaggcactgtgctaggaaccagtggatgtcaatgtaaataaaacaatcgttgccctcaaggaatttataatctacacatacaaacagtcagttgaaatcaatgataaattatattgtattat

SEQ ID NO: 728536 - DNA, 241 bp, Homo sapiens; identical to SEQ ID NO: 203216

SEQ ID NO: 728537 - DNA, 615 bp, Homo sapiens
agtgatttattcgtaacctgtttcctgaagtccagatcatcagttacagcttggtgcattttcacaaacacccacgtagtcactgttcaggtccagaaaccaccagcctgcagcccccaaaggccccagcacaggcgccctgtggtgctgctgtctggcctgacgagtctgcctgttgctcactgaatataaacggagtcaaagcagggcttcttaggtctgacctctttgtcctgtgtgtaggtgaaagcagtctcatttctgtgtagtactgtggcgggaatgcacccagctctgctgtaggtggagggtctcagttacctgctgtacttcctccagacaggactgttgttctagtaactctcagcaatgaaggaaccaatgcagtctccgactttactggcttgagtttcgctcttgttgcccaggctgagtgcaggggcgtgatctcggctcactgcagcctctgcctcctgggttcaagcgactctcctgcctcagcctcctgggtagctgggattacaggtgcccaccaccaggcctggctaatttttgtatttttaatagagacggggcttcgccacgttgcccaggctgatctcgaactcaagggat

SEQ ID NO: 728538 - DNA, 716 bp, Homo sapiens
gtggtgacctagaggaccccggcagaatacactcaaagtccactgcctccatgaccagtgcatctccaggtttgcctaaggaatatagtccttgtgacctgactgtcactcatatgtattcagggccccaggccactttggtcagctggtggcagaaccagctgggactcaggtctgtcccactctacctgaggattctcctctggcccagagctgatctaaatgtgtcctctgtgggtgccagcagaattctgctcagtgtagtgctgtgctgtgacagggcagcagtgagttccaatgcaaaatcccacactcctctcgctccaccacatgcacagattctctctccaagctgttgtgccagaggtgagggaggggggcataggcgatgcaggaccgtctttcccaccctcttcagtgcctcttcttgatacgatgtgaaaaccaggtactgtgatcactcacctgattttttgtttcttatgaagatgctttttttttttttttaaataaggagtctcactctgtcacccaggctggagcgcagtggcaccatttcgtctcactgcaacctctgcttcccaggttcaagcaattcttctgcctcagcctcccaagtagctgggattataggcccccaccaccacgcccagctaatttttgtatttttagtagagatggggtttctccatgttggccaggccagtcttgaactc

SEQ ID NO: 728539 - DNA, 762 bp, Homo sapiens
acccttgcccatcttctcacatcaccaatttcctggtatccagctctactcaagtatggtaaggctcctgtcttatgttcttatttgtgtgcttccctgccctactaggcatgttccttgaaggcgtggacttaacttttatatctacagtgcttgtcacataagaagcactctaagaagagtagaccttgaacctgttaacagaaccattactgttcactatggaagaatcagaatacatgccctgcatttaaaaaatcaacctgtagttcacaacagctggtagtcagagggctaggccctaggctcaatagtcagacttaatagatagcactgatttttattaatttgaccgatttagacatttcagaggcattagcaaatatgtgattagggtattcattaaattttagctgcaggatttcgttacagcagttttttctctaaaggactgctgtggttaatgatctgtcagcatttccattataaccatcactgttaaagaatatttttgctgtttcagctatctccatttgaaagttggcagtttctaagcacagaattagtttttgaaaatgtattaggctgaatgttaaatggaattggcccttacttttcccatttttgtgttttggaacactgagcatctttccacacactgctccaaccaccctgaattataatcacatttgctcttgcttgaaagttaatagagcttcagtcatccttcttgttcctaagttccaaagtattgtatattcc

SEQ ID NO: 728540 - DNA, 1163 bp, Homo sapiens; identical to SEQ ID NO: 398426

SEQ ID NO: 728541 - DNA, 497 bp, Homo sapiens
ggaacattccatgctaaggggtgcattcatggacagggactgggactcaggagtccacagattatgatcagggagtgcctgtcaccctggggaaggtggtggagaatggggttggaaatacagagggggccttgagtaacagattcccagttatctccctttcttcgccatactttttatctcaagttctcagtttaggccttctgatcaataccatcctacaggactctccccaacatcctccacatttcacacatatttcttctgctggggaaaggtgcctgcctctactctgcctacttttttttttttttctttttgagatggagtctcactccatcgccccaggctggagtgcggtggcgccatctggcctcactacagcctccacctcctgggtttaagcaattctcatgccttagcctcctgagtagctgagattacaggcacccaccaccacacctggctaatttttgtatttttagtaaagacagcgt

SEQ ID NO: 728542 - DNA, 1013 bp, Homo sapiens
gaaaatagaggatcccgtgctgcacaaaggatgcctggaactctcttcttacgggccacccctcagccacagctgtggggccagcgaagtgagagcctgcccagaggggccaagtccctgtcaggttacaaaattgttaagccaacccctcaccaaacacagggcattattagtaaacaggtgaggaaaatcctctaggtcggctagctggacgtgcaggactgagggttcaacttcacagcctgtctacagcaccagccctaccatcactgtggattaatcacccaccaaatcctacccatcccaattatgaaaaaaatgacgagcgtccagtgcaatgcccatctccaacctctgtgcagaggaagcctggcctctccctggagcaggtccttgttcagaggattgctccaggagaacctcgtccctcacccaggtcagcatttcagaaggagacacctgatctgcctctatcgctgccacacaccatgctatgcaggcttggactgctcagaaatctcttgtgggagccacattatttttcctgcagaacagaattatctagaagggggtaaataatagtttctaaggtggtatctgatcacagaataaaatatgaagtgagatgaagtatacagacgggctcagagacagcctgtattcactgcagcactggctctgaaggctgctgggtaggaacgtgagcaggagctggggtcccctgtgctgtttctgcctctgctcatgattctctttgggaggttcagctggtaatgtcatctctgctcactcaggtccttgatctagagaactatttcagtatttgccacccaccacaagcccacatcctggggatgctgtgaacattcctgaacctgtgaagtttcccaaatctctcagaactagagggcctacacagggaggggccatatgccttttcctggtagacagaataaacaactgttaagaggcatcctttgtgcagcacgggatccatgcctataatcccagca

SEQ ID NO: 728543 - DNA, 666 bp, Homo sapiens
catagtattctcagtaaccagacatctaaaagcagtgataacaggtaagctattaattaaattttagagcttaaggattttaacttacaagttttgagtttaggggattcttccctaaaaagttatgctagtaaccctcagtttacctacagattctcttttcattacagctttttctatgcctatacatactgtttactatggacattttttctaccctactacctcattctttatttctttatttatttattttttagagttgaggtcttgctcacttacccaggctggagtgcagtggcacaatcactgcagccttgaactcctgggctcaagtgatccttctgcctcagcctcccatgtagctaggactatagtgtggcaccatacctggataattaaaaaaaattctttttttagagagaaggtcttgctatgctgctcaggctggtctcgaactcctggcctcaagtgattctcccacctcggcctctcaaatctctgggattataggtgtgagccacagtatctggcagctaccttattcttctaaattctgcattaaatttcattgtgtgactttaccgtggtttaacagttctatgctttatgaacattttggatatttctggttcatttctatccagaaaagacaaatcctatgtt

SEQ ID NO: 728544 - DNA, 548 bp, Homo sapiens
catagtattctcagtaaccagacatctaaaagcagtgataacagggagacaccacgaaatcattctttgcctaagtgtaattcccatttggagataacaattccaaaggacttgaaactaaaagaagcagagaaaactgatgggagcaagatggcccatcagtgtcccgtaccctcaccaccccttacatgcgcttacacagcaaccatagtgttagggtgtgtgccggctgtggttgggcttctttgctgtggcgtgtgagtgatgcactagggccttccgcaggttgtcacggcccagaggctctggcactgaccaacacgaatggataactgtctgatgtcagtatttctttggagctgatattagccaaaatgactaaagactttgcgaagaataacttgatggagtatcatgggaaaggactggtccacaacagaaggggacatgagcattttgcctcacagagagagcctggagtcacaaggtggttcaaaagatggcatctagttaatgatctgatgggagcagactggggatcctctaag

SEQ ID NO: 728545 - DNA, 325 bp, Homo sapiens
gatgagccggtccgccaagaagcttagtaatactagtaactgggattacaggtgtgtgccaccacgcccaactaacttttgtaattttagtagagacaaggtttcaccatgttgggcaggctggtctaattaattaagctttttaaacaatttaaccaaaacaaaattctggcattagattcagcatatcaggaggtactctttgaagaccattgcatttctttctttttcagtaaaatgaaggggaaaaaaagtgtgttgacctgaattgatttgatatggggaagaggccttttaagatcaagtcctttctttttgttacaaa

SEQ ID NO: 728546 - DNA, 396 bp, Homo sapiens
gcagagtctcactctgtcacccacgctggagtacagtggcacaatcttggctcactacaatctctgcctcccaggttcaagtgattctcctgcctcagcctccctagtaactgggattacaggtgtgtgccaccacgcccaactaacttttgtaattttagtagagacaaggtttcaccatgttgggcaggctggtctaattaattaagctttttaaacaatttaaccaaaacaaaattctggcattagattcagcatatcaggaggtactctttgaagaccattgcatttctttctttttcagtaaaatgaaggggaaaaaaagtgtgttgacctgaattgatttgatatggggaagaggccttttaagatcaagtcctttctttttgttacaaa

SEQ ID NO: 728547 - DNA, 523 bp, Homo sapiens; identical to SEQ ID NO: 300843

SEQ ID NO: 728548 - DNA, 563 bp, Homo sapiens
aaaacgtctttaaatgttttattgtttttacaatcagaatatgaatgttgtaataacacaatctaaattttctgacaaactgcacttattataaggcaggattttcaaacaatttaccacaaagccattttacatggtatatatgccacaagaaaaaagtgtcaggcgaaaaacatgtctacatacaaacagaatacaaaatgagaaattatatatttctgatgacagaaccaaaaatcatgtatttatggtaataacagtttatgatattaggtacataatgtgactgatatttgtcctataaggacacaaaagctatttattatagggtaggaagtgtaactttgcttggattcatgcacagaaaggtaccgataatatataataatggtaatattacgcaagtattaaataacataaaaatctacaaaaggatatctatagcatcaaaaaggtacattagcaaaaataaagatatcccatccaattcttaaccttaaaacatgtcagagaatctccaggactggataaacattagagaaatttactttgaagtagagatg

SEQ ID NO: 728549 - DNA, 658 bp, Homo sapiens
ctttgataagtctggctacagagtaaagttaacattctattatgaagcaaggaataaatccatccctgtatcaattaaaggaagagaatatcaatgtgaaagggggcattagaaaccacgcttcaaaaggattcccacagtgacagaacttctcaatgaaacaccacaccccaagtaacgggggcggggtggtgcaccatagaatctgcccctaggaggcacagccacctccacaccgagggtttccagtttcccattcacataaaagaaacaagtaagagattctgggaggcgctgggctaggaaggcatctactcactgtctccaccaacaattccctcagtaaagcagccattgcccaataatgcttctatttattttacccagaagcagatctattagccagacattctaaaaacacaaacgcttcgttgtgcttggagtaactccaatattgatgccttgctgcagaacgatgctgcaggaatataaagtgagccatgtgctagctgtacccacttatgaagcacactgtcagaaactgtcacatcctggagaccaacccatccgaaagactgagaataaaccccctacgagaacactgtggaaggagggagaaagccaaagataggatgaagcagggccctcctaaagtctc

SEQ ID NO: 728550 - DNA, 685 bp, Homo sapiens
ccagcttctgaccatcctggtggtggtggctgaggacctgggtgtgtacacctgcagcgtgagcaatgcgctggggacagtgaccaccacgggcgtcctccggaaggcagagcgcccctcatcttcgccatgcccggatatcggggaggtgtacgcggatgtggtgctgctggtctggaagcccgtggaatcctacggccctgtgacctacattgtgcagtgcagcctagaaggcggcagctggaccacactggcctccgacatctttgactgctgctacctgaccagcaagctctcccggggtggcacctacaccttccgcacggcatgtgtcagcaaggcaggaatgggtccctacagcagcccctcggagcaagtcctcctgggagggcccagccacctggcctctgaggaggagagccaggggcggtcagcccaacccctgcccagcacaaagaccttcgcattccagacacagatccagaggggccgcttcagcgtggtgcggcaatgctgggagaaggccagcgggcgggcgctggccgccaagatcatcccctaccaccccaaggacaagacagcagtgctgcgcgaatacgaggccctcaagggcctgcgccacccgcacctggcccagctgcacgcagcctacctcagcccccggcacctggtgctcatcttggag

SEQ ID NO: 728551 - DNA, 359 bp, Homo sapiens
tcatgcctggctaatttttctgtatttttggtagagatggggttttgccatgttggccaggctggcctctaactcctggcctcaagtgatctgcccacctcagcctcccaaagtgctgggattacaggcatgagtcaccatgcctacctgagaagggaattttctagtcttcatattcttccctagtcttgacattgatttggaacagacagctagaaagaggagagaaaaacagagtatatatttatgaatataaaatcttgagtgcttgctctgtgggcccgtttgtccctacctttatttagcgtttcagaacccaagttgatggttactaaaaggctgatcgctttaggttcttt

SEQ ID NO: 728552 - DNA, 812 bp, Homo sapiens
  misc_feature (483)..(483): n is a, c, g, or t
  misc_feature (505)..(505): n is a, c, g, or t
  misc_feature (523)..(523): n is a, c, g, or t
cagcgagaactcagatggcgacgtggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttgnaggcatctctgacaccaatcanatcttcggcctgagcganacggaacctgctccttcctgtatatgctcccttcgatggcatcctggggctggcctaccccagcatatcctcctccgtggcccacaccccgtcttttgacaacatctggaaccaggggcctgtattctcaggacctactactctgtctacctcagcgccgatgaaccagagtggcagcgttggtgatctttggtgacattgactcttcttactacactggaagtctgaactgggtgcctgttaccgtcgagggtactggcagatcacgtggacagcatcccatgaacgg

SEQ ID NO: 728553 - DNA, 320 bp, Homo sapiens; identical to SEQ ID NO: 177147

SEQ ID NO: 728554 - DNA, 417 bp, Homo sapiens; identical to SEQ ID NO: 191187

SEQ ID NO: 728555 - DNA, 494 bp, Homo sapiens
aaacagaactagttgtagtgtaggaaaaagccactgataaaacaggttatattcttaagcctctctttattgagaacccctagaattgcaggataaacttgatcgaagtaaaatccaaatcttaaactaagttctgtgagatttaagagcaataatcaacagttctaagcctaataaagagagctcttaatcagctcagtggtggttaaaaccagctatcttttaaagaagagaaaaaacaaaacacagcaatgccctgtctcttcagaaaattgttttaaaaagttagccaggcatagttagtggcccacgcctgtagtccgagctgtttgggaggttgaggtgggaagattggttgagcccaagattttgaggctgcagtaagccataattgtaccactgcactccagcctgagcgacagagaacaagaccctgtctcaaaaataaagtgggggaaggggtgcaaaattacactgtgagaagccaagaagtt

SEQ ID NO: 728556 - DNA, 183 bp, Homo sapiens
ggctctttgcgtgcgaggcatacatagtcaatgagggagtatcattgagcccaagattttgaggctgcagtaagccataattgtaccactgcactccagcctgagcgacagagaacaagaccctgtctcaaaaataaagtgggggaaggggtgcaaaattacactgtgagaagccaagaagtt

SEQ ID NO: 728557 - DNA, 650 bp, Homo sapiens
gccctctacccagggcataagggactgttagttaagaaaaggttgtaatagccgggcatggtggctctcgcctgtaatcccaggactttggaaggctgaggcgggtggatcacttgaggtcaggagttcaagaccagcctggccaacatggtgaaaccctgtctctactaaaaatacaaaaattagccaggcatggtggcaggcacctgtaatccagctacgcaggaggctgaagcaggataatcgcttgaacccatgaggtggaggttgcagtgagctgagatcatgccactgtgacagagcaagactctatttaaaaaaaaaaagaaagaaagaaagaaaagattgtgtgacatcatagtctgtgtattgcagcccccgtgctgtcctggtgctatggggagtagaagagaggctttgagaggcactgggatggattaaaagagggctggacttgaagccaaggctcacattctacaggtaccatttagtaattgtatgaccttgagcaaatttcatcacctccagagcctctatttcctcatctgtaaaatgaaaggggaggcatctctgctttactcatacaattgttatgagtttcacctaagagcatgagaggtagtttttacacaataaaactctgcacaagt

SEQ ID NO: 728558 - DNA, 340 bp, Homo sapiens; identical to SEQ ID NO: 166953

SEQ ID NO: 728559 - DNA, 724 bp, Homo sapiens
  misc_feature (1)..(1): n is a, c, g, or t
ntctatacgatccccttcgcggttccataaattatcaattatttcaaatatatttattttggcacagttttagtgcaatcaaaatgtggacagtcacaagaagatttttgattgtaagtgagtaaggaatcaattaaaacagtgttctagaagaactgtagtcttgaattttagactcttagaccacaaacgaacctggaaaagtcacacataaactgtacaaaattagataatatgggcttcaaacaaaaacaacagcaagctctctttcggtatgaaaactctacttttttttttttttttttttttttaaagagccagtccttgttttcttgtctctaaaatgtggatggttatactgtatctgcttgccaaattcatagaattcttgtgaaaattaaatggattaatttatgctagagaaatctataaattataaatctctgtacaataatttttcaaaatatggtatgcagataattttcaggggggtgacaaaatttttatgttttaatgattacatatctatatttacttcttgtttatgatgagtgatatgctacttttattgtagcttcctttgaaattaatgtatggaggtaaaaatgtgagtcaacttaaaagaaaagaaaattactaatactataggtaaaatgtggatatgacaaaaatcgtgatgatggtatgtgcacaagcgaagttcagaaaacattgcattgtgaag

SEQ ID NO: 728560 - DNA, 428 bp, Homo sapiens
atcctatagtggagacacctacttttgtccagtacttgcaactgggctcagtggtctctactcttccctgcctacaaagctagaagagaaaggcgaggaatggcactgccttctgaaagatgactggcttctacttccttctcttgtccagttcatgaactccctggagttttgcaatgcagtcatacaggtggctcaccccttgattcgaaatcagcttgtcaattacatttacaatggatttttggtaccagtcttggctcctgctctccataaggtgactgtggaagaggtcatgaccacaactgcatatctggaccttttcctgcgtagcatctccgagccagcactacttgagatcttcctccgttttatcctattgcaccagcacgagaatgtccacatcctagacactcccacgatgatct

SEQ ID NO: 728561 - DNA, 537 bp, Homo sapiens; identical to SEQ ID NO: 179179

SEQ ID NO: 728562 - DNA, 340 bp, Homo sapiens
tgctacgtgtggaatgaggtcattgtgcccgcaggttgtttgtgattagctgtctctaacaattgttcatacaataattgttcattattctcctcaacttggggctctccccaacctggggacccttccttattgttgcttacttagcaggactccacataagggtgtggaaacttcattcactcatatcttcaacacaaattgtaggtagcctgtttttttaaaaaatttattcaacaaatatttagtccaagccactattacttattaccttctcaacttctgtatggacctttaactatctctgacactattcactattcttccacacgtcactatt

SEQ ID NO: 728563 - DNA, 333 bp, Homo sapiens
gggccatccagtgaagccctgggtgagtgacctcagccctgacaaaagactgtgccataagtgggtccagtgcatagagtcagcagcgagcagtgcctcactgagctgtcggggactgtctggaaggtgagtcatcaagccaaagaggatgcttcttgaaccttagggtttgatggagtttgccctgttaggttttagatttacttgggatccagcattcatatattttatttttttcgaatagtggttctttttggaatgggaatgtttatcctatgcctgtctcaccattgtattttgagagttcatgttgtttgattccacaggttcaca

SEQ ID NO: 728564 - DNA, 657 bp, Homo sapiens
gtttatgttacagatttttttcatctgctgagtaaacttgggcatgcttttgactaaaggcatttgaactggctgttaaattcatctctacagttgtcctgccatatccacagggaattggtcccaaaatgtccacggacaccaaaattcatggatgctcctcaagttcggcagtctgccctgaagataggaaaacgtcctatacacacatacaaaaggtcagccgtctgtatctgtgggttccacatcctacaaatgctattatcttccatcccagttggttgaatctgcaggtgcaaaacccgtggatacagaagcccgactgtatttcctttttttctgagacagagtcttgctctgttgcccaggtgggagtgcagtggtgcgacctcagctcaccaccacctccacctcccagattcaagcggttctcctgcctcagtctcccaagtagctgggactacaggtgcacaccaccaatgcctggctaactgtctcactttgttgccgaggctggtctcaaacccttggctcaagtgatcctcctgccttggcttcccaaagtgctgggattacaggtgtgatgcatcacacctgctgtcttttattatataattttcctacctccctgaggtttatctaatattaatacactgt

SEQ ID NO: 728565 - DNA, 714 bp, Homo sapiens
ggggaaaaggcatcaacagcaccagcaaataaagaacagatgctcaattagtgatggtgatggacaagattcctttatttttgaagcaaatgaagcttggaaagattttcatggttctcttcttcgattttatgaaaatggagaactctgtgatgtcacactcaagtcacagcaaactgtacaatggcagttgagtgggttttgaaaaacgtctgaattgtagtgtctacatctaccttctgccttctctctaccctttgaaaaaaaataaatggcatgtttgagaagagagctctattaaaagaggaatattgcaaatggcttcagattctatgagtagtaaacaagctaggaatcacattacaaaggggaaaaggcaacaacagcaccagcaaataaagaacagatcctcaattagtgatggtgatggagaagattcctttatttttgaagcaaatgaagcttggaaagattttcatggttctcttcttcgattttatgaaaatggagaactctgtgatgtcacactcaaggttggctcaaagctaatctcttgtcacaagctggtattggcttgtgttattccctactttagagccatgtttctttctgaaatggctgaagccaagcaaacgctgattgagattagagattttgatggtgatgcaatagaagacttggtaaagtttgtctattcttcacggctcactttga

SEQ ID NO: 728566 - DNA, 591 bp, Homo sapiens
gcccaagccgttgcagcaggaagaacaggtcgagtgatcgaggtcacagcaaactgtacaatggcagttgagtgggttttgaaaaacgtctgaattgtagtgtctacatctaccttctgccttctctctaccctttgaaaaaaaataaatggcatgtttgagaagagagctctattaaaagaggaatattgcaaatggcttcagattctatgagtagtaaacaagctaggaatcacattacaaaggggaaaaggcaacaacagcaccagcaaataaagaacagatcctcaattagtgatggtgatggagaagattcctttatttttgaagcaaatgaagcttggaaagattttcatggttctcttcttcgattttatgaaaatggagaactctgtgatgtcacactcaaggttggctcaaagctaatctcttgtcacaagctggtattggcttgtgttattccctactttagagccatgtttctttctgaaatggctgaagccaagcaaacgctgattgagattagagattttgatggtgatgcaatagaagacttggtaaagtttgtctattcttcacggctcactttga

SEQ ID NO: 728567 - DNA, 752 bp, Homo sapiens
gccctaagcccactgtgtgggcgtcccatctcgtacagtggccgtctccagcctccactgggcccaaataggtaaaaagaaagcctggggaaggaagagccaggaaacctcgggagagtggaatttcaggaatggcaggtcagaactggttccagcatgggtccctttgccttgtgcttagctgagggatttttgttattaattttttttttcctgttcaacactcctaacctcttttgaatttcagttctctttttttatcctgaaggattattttattgtacttttgagggtttttttttttttttttttttgccttgcacaaagtactgactcatgttgctaatggctgtggctgtatgctagttatatgtctcattatcctaccccttaagattgatcatttctgtgttggtttctatttcaaaccagaataggccaggtgggtcaattcatgtatttctgaattcaataatgaggcttccctaccgtgaaatgtacatatcttgtcatgggcggacaggtactaaatagagcctatctatactagattttaaaacaatggatttctccccaaaaaacaacatttccagcagacaatgggctttgtgctccaaatcttgtaattttggttttaaataaatttcatgtaaggaggcagggctaactagactgtcttcttttcagatcataacttgatctctttttaagattatttctgggacttgtacagcctcaggaaacttgggtct

SEQ ID NO: 728568 - DNA, 1001 bp, Homo sapiens
tttttcaaaatttctgtgctacactgtgagttttttcaaattgtcacaaatttcacaaaaaaattcaaatgtatctattgaaaaaaatctgcataacagtgagccttcacagttcaaggctgtgttattcaagggttagttgtatatgttattaaaattcacaatctcacaaggagcttatgctgctttctgacagcccaagaatgcttcccatgctagctcatgtctttatttgatagtaaatatgttccccacctaaaagatgtctgaagcccattagctttactcatggtgccagaagtagtgtaatattttttcttctcttagtgaatttcttttccagaaaaaagagttgaaacttaataagatcaatatagaaggccaaaagttgtcctgagcaatggggttatttcttaaccagatgcttgtctcttctccccagctgcaacattcctctgtactgaatttctttagtgccaagggggataagtggaaagagatgaaaatatagctgctgttgcatggatgaccccattcactctgactccttcagcaagtttcatttttccttataattctcggaggaatgctttgcctaaccacctaccccaacatctaggatttacttttaagatggtcagttaatattgcttgaacataaacttttggccagagtaactggaaatttaagtttattaaacttttacatacttaactatggtctacagggtattttaaactctgccatttgggtttagatctgcttttttacccccacccccaaatgtgcagcagtgtgaaatgtatgagaactaattggataaagtaatttttttaagaccttggtatcttatttctgccagataatagagaacaaatataaaatattcccatgattaaacacaccagatacagcttgaatttttagaatattaaacaggagtgataatgaggaagaacttaggtccctaattacaaaaggtttacacacacacagacac

SEQ ID NO: 728569 - DNA, 815 bp, Homo sapiens
ttaacatgatacgaatcgagctggtacccaggctgcagcttggaatctcatactatttgattatattgatcactctcccaatgtttagtcactttccctcattctttgcagtctttacaacctgacttaactgccattattttgatgtctcatttaaattacttatcttctttgacatttgacctcatcatttccaatgtacttgctatcttcagtatctagctattcaatctcatgatctcagctcaaaccacgttattactcctaattgcaaatttttacaatctaacttttaagtctcctgccttccgaacattaacttctatctttctagttcattccatttactacaacttcaaaaatactgtgactcatcctggatctacaatctcatacaatatacaatacagtccttatacaattctcaatccagttttctccacacatcctttacttctcagcaaacccaccttcaaaacatttaaataatttttactactgctgttatccacccaggccaagccaaaatcatgtctcatctgaatttttatcccccttcctgcttctgcattggccctcaccctcagtctattctcaatacccaagcaagaatataacatagtatcatggagatcatgccactctgctcattcacttttaaggacttctaattccactctgggtcattattgtacagattatacagctctactcatgctccccaccaggcacacctctttgatcacagccctgttgctcttcccctcatgcctctgttctagttttgctgtacccaacacttcctggtgctcttt

SEQ ID NO: 728570 - DNA, 408 bp, Homo sapiens
gtggctggtagagtgtcctattaggcattatactaattatataaatagtgaaatattgcttaagaataattgacctaatttaaaatgatacagatcaagtaacctaaaggccattaggagtttccattttttcatgaaatttggctctaacccttcgccccctggtgataaatacatttggtttattttgtgctcacaggcactttaatgttttgttatgtgtgtgatgcccagatcctttaccctgatgtgacccgcaccagagttcaaggaatactttgcatttatgatactcagaggatcctttaaaaacctaagtgtgttacagtttgaagagcttagaatcacttgatgaagagttgaggaaaaactatacaaaactgatttttgtgagctgaatagttgatt

SEQ ID NO: 728571 - DNA, 1035 bp, Homo sapiens
cagcagtgttggattggacctcggttcctaaggtactgccatctttgatgaaactaccactaccagttcatttaagttttattcttttccattgctgcctttgccctatgtctcagacttcaatgcatggaccaaaagacctttccagtaataaactcttgagatgcttagaattattgccaccctttgatgcctttctactttacttaaaaagaatattctcttttcctgtgattaattctttctcatttctcattttttccttatccttcaagtaaacatacccacaccttattcatcctcaaagcctagccagacactcctgaatctttagatgtatacatcttcagatcaggtggagaaccccatctgtacttagttataaaggaacacttcaaatcaccattgactgtcagctatttatttctgctaccaagaccaatatatgttttttatttcataaagatttttcatagcgagtataaaaactactttgtaattaatgccctcctaaatcaccagttcttcttctctttctgcattctgggctcaaaactttgttggggaaaatggagaaaaatgaagactttacctgccaaaaagcatggtgccaaaccattgatgtgtacctgccatagttacccactttttttttaatcaggaaagaccttattaacacattcatccccaacctctccattacctggtgatctagtttgtgaatgaagatgttcaaaggtgttgattgttttttagtttttgttacaggtctctcctttgttgcaccttaccaagatttccagaccaatggcttattcttattgtctcttttatttattgcttagtttctcctcatttcactgagaagtgccttcaaattctgttgaattccctgaaattctatgaaatctatagatttttcttaacttattctcctgatatttttgcatctgaaagaaaccaaagtacttagttaactgctagactacaaggtgaagtggccttcattgcatatcccagaaagaatccagagca

SEQ ID NO: 728572 - DNA, 166 bp, Homo sapiens
ctagctttgactcctctgtcacttgtccgctttggcatcacctcctcatagaagacttctatgactcccgagattctcaggagcatggcaggtgaagtgctcctcccatgaatggatggagattaaggagtgtgtgttattcatgcttaattcaccagtgcttagc

SEQ ID NO: 728573 - DNA, 622 bp, Homo sapiens
ataaactggaaggtcggattgtcaccatgcccggcctcactgcttcttttcttttagtattaggtgccaactaaaagtgttcaccacgtctgttcaacattgcactagatgttctagccagtgcagtaaggcaaggaaaaacaataaaaggcttccagatcttaagagggaaatgtaaaaatttctttattcaaagataacataactgtctgtgtagaaaatcctacggtatctacaaagaaaactgttttgttaggactaataagtgaattttacatggttacaagataccaaggaaatacagaaaaatccattatatttctgtattctagtaatgaacaatcagaaattgaaattctaaaacagtatcataatctgtcaaaaatatgaaatacttagagataaatttgacaacagatgtgcaagatcgtgcactaaaaaatacaaacattaataaaagaaatgatctaaataaatggagcaagctgctgtattcatagatcagaaaactcaatgttgctatgatataaattctctcaattgatctatagatctcaattaaaatctcagcagacatttcagtagaaattgacatgctggccgggcgcagtggctcacgcct

SEQ ID NO: 728574 - DNA, 407 bp, Homo sapiens
caatttttgtgtgtttagtagagacagggtttcatcctgttggccagtctggtctcgaaccagtcctggcctcaagtgatccgcctgccttggcctcccaaagtgctaggatacaggcatgagccactgcaccctgccagtttttcttttcttctctttttttgagatggagtttcactcttttgcccagcctgtagtacacattttaaatttgggtgtgttgtattggtctatgctgctggagacctgggtctgtacttgactcatccagctgaccactggaaaggatttcataaattcgtgtttgtcttgtcatcagttaagctcctggtatgttaatttaagctggcatgacaggaggagatcaagtatttatggcttggacatggcgagcagtggagaaactc

SEQ ID NO: 728575 - DNA, 526 bp, Homo sapiens
ttacattactgtgacacttttgttgtagtttataaaagtattagtctgcagtggattggaaatttaaaagactggtccttaccatggataatttgagatgcactggaaatgtgtgagttttcaaactgcctaggttcaaatccttactccattccttacaactgtgtgataatgggcaaactgttagcctatgactcagtttctgttcccagaatgggaatagcacctccctcagggttatgtgaagataaagtgagataacttgtttactcaaatatttattcatcatctgctatgtaggatactgttctggatgatgaaaacattagtgcacaagacagagtctctgtactcatagcatattacagtaaatcctagtgaggaagataaataatagaccagtagatatataatatctcatcaggtaacaactgaagaaaaaaaaaactaagtcaaaggtatgaagagtggtggggattgctattttagataaagcagtgaggggaaactcttttgaagatacagc

SEQ ID NO: 728576 - DNA, 413 bp, Homo sapiens
aaggtaaagaaatgaaacaaaaccgttagattattataaaacagagtgacagcttaaatttgtcagtgtataagaattttgtgtatacttgaaaaacactggcctggcaacttagtagaagataaatttgagtgtagtgtttctgtagttgagaatgagtgaatggaaacctgtagaagcaaagcagttaggagaaaatcatctagagaaatgttagccttgagagtgagttccacaaccacttagctgtagtggttgaaggaggaaagaatcctacctccaaattacaactttacaagaaacagaactactaaccttgagaaaccattatttatgccatttatcagcccaaactgaaaatttagtgctcaaagctggcactattgtataacataagttgcccgccaatcgaa

SEQ ID NO: 728577 - DNA, 403 bp, Homo sapiens
gcatttagaggatccaactttatcccaacacaggactctcctaacatgtaggaagagtgagagcaaatctgacagcatggactcatcagggtatgaagatggtttgggtgttttgttttgttttgttttgtttttttgagataggatctcgctgtgttatccaggctggtctcgaactcctgggctcaagggatcctcccacttcagcctcccgagtagctgggacaacaggcatgagccaccccacctggctggtttggggtttttttgtttggtttggggttttgactacttttttgggggaaatgtttgggcaagaacatgtgaggacagggataaggccgacagggggctatctggcatttagaatgtgttgggcgataacatcacgggtaccgagctc

SEQ ID NO: 728578 - DNA, 399 bp, Homo sapiens
ctgacttgaggatcccatcgccaacacaggactctcctaacatgtaggaagagtgagagcaaatctgacagcatggactcatcagggtatgaagatggtttgggtgttttgttttgttttgttttgtttttttgagataggatctcgctgtgttatccaggctggtctcgaactcctgggctcaagggatcctcccacttcagcctcccgagtagctgggacaacaggcatgagccaccccacctggctggtttggggtttttttgtttggtttggggttttgactacttttttgggggaaatgtttgggcaagaacatgtgaggacagggataaggccgacagggggctatctggcatttagaatgtgttgggcgataacatcacgggtaccgagctc

SEQ ID NO: 728579 - DNA, 278 bp, Homo sapiens
tgatccacatttgttgctttctagcatatcataacttccactgcggattttgtcctcacctctgtctttaatgaaagcaaatcttcattgcatttagatggacttttggcctcagaagattactctgtgactgaattaacattttttagttgtggtttttgtcatatttgtttctttgtttagggctaaatgaaaagatcccagaggtcatcagaaaacagcaggtagttcatggaaaaggttcctttgtactaattgaagttacagaaggctgacca

SEQ ID NO: 728580 - DNA, 445 bp, Homo sapiens
cactctagatgatcccctttccccaggggtatcctgcagcctcttctaaatgtgttaccaggagaatgccatcagaatctgggagctcactgagctgtacgaaaaatgtgtgggaaatgaggaggaaagaagaggctggccttttttcttcgtgttacagatactcgtgaacacaaaagccagcggggttcgattatgaaaataacatttcatcctttatgaggaaaaaaatgagtagtttcctttagaggttaaaataaaatatatgctgtattcatgtcacaagagggaaaagcctgaatcataatattttacaccaactgagacaagtatgaaagattttaaggaactccatgttcttctatgaaaatacctgctaagtaagcctttagtaagcctttcattggtttgtgaggaatgcttcatgaagttcttgttttggaaa

SEQ ID NO: 728581 - DNA, 771 bp, Homo sapiens
gggcgactctagagtataccctctctgcctgccagattcccaaaaacacgagatttttctcctatttcagcagttggccacaacttcattgctgggaaaaggccaagaaagaagagagaactctcaccacaacatttcaaagggaatacattgccagaacttggaatactctactggacaaacatttcctccaaggtaaatattaccattgtaccaataaagggacacatcactagaatttttgaatggcagtggtacagcacaaaggtttaattgtttagtctcatacagacctagagtgacataagagaaagagagagagggagagagagagaagaaagcagtgctgttggggtatcctgcagcctcttctaaatgtgttaccaggagaatgccatcagaatctgggagctcactgagctgtacgaaaaatgtgtgggaaatgaggaggaaagaagaggctggccttttttcttcgtgttacagatactcgtgaacacaaaagccagcggggttcgattatgaaaataacatttcatcctttatgaggaaaaaaatgagtagtttcctttagaggttaaaataaaatatatgctgtattcatgtcacaagagggaaaagcctgaatcataatattttacaccaactgagacaagtatgaaagattttaaggaactccatgttcttctatgaaaatacctgctaagtaagcctttagtaagcctttcattggtttgtgaggaatgcttcatgaagttcttgttttggaaa

SEQ ID NO: 728582 - DNA, 339 bp, Homo sapiens
  misc_feature (24)..(24): n is a, c, g, or t
ggtccagttgtgctggtcccaggntcttggtgaggaggtggcaggaggggatggcttatagtacttgtatacaaatttatttgcttgtttattaattacggggtctctctctgttgcccaggctggagtacaggggcacaatcgtaactcctgggctcaagtgatcctcctgcctcaggctcctgagtaacttggattacaggcacatgccaccaggcccagctgattttttcaaattgtctcactatgttgcccaggctggtctccaacttctgggctcaagtgatacttccaccttagcctcctattagtttttcccttacagcaattcctgcaata

SEQ ID NO: 728583 - DNA, 490 bp, Homo sapiens
ctcgggaggcagaggcagaagaatctcttgaacccgggaggcagaggttgcagtgagctgagattgcgccactgcactccagcctgggtgacagagcaagactccgtctcaaaaaataaataaaaataaaaagagtaggactgaaagacacaggcacagggggctgtcacaacagtccaggtgtgaggccctctatgacaaggagggcatgaggctgcaataagatggaaagagaaaggaagggcaggatgcagagaacgtgccagggcaggtgggaaggatttggtgacattggtgtgaagggaaaggaagagggcatcaaagatggttttgagattctgatctggggtgaactggaggataacaagactgtgggaataggaaaggtggcaggaggggatggcttatagtacttgtatacaaatttatttgcttgtttattaattacggggtgacagagcaagactccgtctcaaaaattaattaaaat

SEQ ID NO: 728584 - DNA, 688 bp, Homo sapiens
ctcgggaggcagaggcagaagaatctcttgaacccgggaggcagaggttgcagtgagctgagattgcgccactgcactccagcctgggtgacagagcaagactccgtctcaaaaaataaataaaaataaaaagagtaggactgaaagacacaggcacagggggctgtcacaacagtccaggtgtgaggccctctatgacaaggagggcatgaggctgcaataagatggaaagagaaaggaagggcaggatgcagagaacgtgccagggcaggtgggaaggatttggtgacattggtgtgaagggaaaggaagagggcatcaaagatggttttgagattctgatctggggtgaactggaggataacaagactgtgggaataggaaaggtggcaggaggggatggcttatagtacttgtatacaaatttatttgcttgtttattaattacggggtctctctctgttgcccaggctggagtacaggggcacaatcgtaactcctgggctcaagtgatcctcctgcctcaggctcctgagtaacttggattacaggcacatgccaccaggcccagctgattttttcaaattgtctcactatgttgcccaggctggtctccaacttctgggctcaagtgatacttccaccttagcctcctattagtttttcccttacagcaattcctgcaata

SEQ ID NO: 728585 - DNA, 141 bp, Homo sapiens
  misc_feature (24)..(24): n is a, c, g, or t
ggtccagttgtgctggtcccaggntcttggtgaggaggtggcaggaggggatggcttatagtacttgtatacaaatttatttgcttgtttattaattacggggtgacagagcaagactccgtctcaaaaattaattaaaat

SEQ ID NO: 728586 - DNA, 769 bp, Homo sapiens
acataggagtggtaaccagaaggaaatgaggagtctaaacaaggttagctttttaaaatgggagatattgtagaatgttggtatgccaaaaggagtgattcagtcaagaggaaggaattgatacaaaagaaagaggggctaattatagaagccaagtcccttcgtaggtgtgggagataatccagtgcataattggaggagttagtctttgaaagtatatgaccatggagtggttggctgtgtgtggtggaagaaaagataattagaaatgaggcattcaaagaacttaaaggccatatgttaagatattttaagccttaagactggatgcggttaccaaagatatgagtacagataaacaagaagtccaaggactgagctctagagcactatgatgttaacatgtctgtttatatcacagattatctataaagatatcacttacacctgaaacagtgacagtagtagcaatggggaaaaagacattaattcagaatgagaaggagttagtaaaagattgattgatgactataatgtgaaaaggtatgaggaggtattatctgatggcctgcacttcaaagacaatgagatttttgagggaggaagttttgggtaagaatttcttttagatcagaattcattcattactagactatgcaaatttgccagcatttaagatttcattaaattaatgtgaattaatgcatctaggctctgatcaacagtggcttccaatgtgtcagaaaaagagacacattatatgcctttg

SEQ ID NO: 728587 - DNA, 328 bp, Homo sapiens
gatcattacacagatgtatcaaaatatcactctgtatcccataaatatctacaattattacacgtcaaccaaaaacaaaaggaaaggaaaataaaaagacacaaatattttccttaaaaaaaaaaggccctcaaattggaaaggaagaagttaaactgtctctgtttgcagatgacatgaaaactctaaagactctaccaaaaatgttggcactaataaaaaatttcagcaaagttgcaggatacaaaatcaataacaataaaaaaatgtagcatttccatgttctaacaatgaactatctgaaaaagaaatcaagaaaacaatccca

SEQ ID NO: 728588 - DNA, 883 bp, Homo sapiens
tcggtaccccacccacctgagtccagaaaacttattctagcctccctcccctagccctcattccttttattatttattttctttagaaaacaaattagggaatgaaatatttagaaacaaagatccaggtgctaactgtgggcattgctactgttactcttcttaaaaaaaaaaaaaaaaaaaaaaacttcacatttccaaataaatagtaacactttttaatgtgttcttaacgttttatttggcattaatctaaattcccctctagcacaatgaaaacagaaagagaaagttaaaatttcaagtaaactgaaaacaacaatagtgctcagaggatttttttttaagtgaaaagggatagtgcttaattatgacaaataaaagctaacttgagatgcacatatacagatgcagccacttattttggcgggggacacttcaggaattaaaatttaaatagcgagagatcaaatagatacttggtaaatgtgtctgaattggatgttcccagacacaaaaataaaatgagttattgacagctcttgggagacaacattataaagactagacacgttatttattttaactctatgttctaaattaccattgagtaattgacattcgtatttgactatggtttgtggttaagttcttaattgcaataatgttaaataaaatgtgaagcccaaagcaaacaacaacaaaaattatagcaatacttcaacagaggtaataataatatgctgcatcaatggttcagaatccagcatctacataaaacaagcaacagggtaatgaaattattttcttttcaaatattctggcagagctactttagttttcttaagttatagattgtggtcttaactgcaacttttcgctc

SEQ ID NO: 728589 - DNA, 887 bp, Homo sapiens
tcggtaccccacccacctgagtccagaaaacttattctagcctccctcccctagccctcattccttttattatttattttctttagaaaacaaattagggaatgaaaattttagagaaccaaagaatcccggggctaaactgtgggcattgctactgttactcttcttaaaaaaaaaaaaaaaaaaaaaaacttcacatttccaaataaatagtaacactttttaatgtgttcttaacgttttatttggcattaatctaaattcccctctagcacaatgaaaacagaaagagaaagttaaaatttcaagtaaactgaaaacaacaatagtgctcagaggatttttttttaagtgaaaagggatagtgcttaattatgacaaataaaagctaacttgagatgcacatatacagatgcagccacttattttggcgggggacacttcaggaattaaaatttaaatagcgagagatcaaatagatacttggtaaatgtgtctgaattggatgttcccagacacaaaaataaaatgagttattgacagctcttgggagacaacattataaagactagacacgttatttattttaactctatgttctaaattaccattgagtaattgacattcgtatttgactatggtttgtggttaagttcttaattgcaataatgttaaataaaatgtgaagcccaaagcaaacaacaacaaaaattatagcaatacttcaacagaggtaataataatatgctgcatcaatggttcagaatccagcatctacataaaacaagcaacagggtaatgaaattattttcttttcaaatattctggcagagctactttagttttcttaagttatagattgtggtcttaactgcaacttttcgctc

SEQ ID NO: 728590 - DNA, 2406 bp, Homo sapiens; identical to SEQ ID NO: 398447

SEQ ID NO: 728591 - DNA, 2047 bp, Homo sapiens; identical to SEQ ID NO: 398446

SEQ ID NO: 728592 - DNA, 859 bp, Homo sapiens; identical to SEQ ID NO: 398445

SEQ ID NO: 728593 - DNA, 1274 bp, Homo sapiens
atcgagaccggcggaggcaggtcagagccgtctggaatgcgcgcaccttcaacggtatttggagattattcgcactgaattttctgcccgccaagaacgaataggattgccaagccacaccactttttggagcccgcttattcgcgcctatccaccctctcctgtgccccaggttccctgagcacgggaatcctttccgggcatggccaagtttgttcggtggctcagagcgggaagggaagtgcagttcgacacctgtccagctgctccgcttggagatcaaaggccggctatgggctgagcgacagatttacgggacggtggtacagattaaggcgagaaccctgccggtcctggactcgagttcgcacccaaggaaagcgtacaggtccctggaagcgggtggatgtcggagaggccgaggcagcctgcgctgtggccaggcaggcttggtgggctttagtctcagtatgtgttctttaaagtcttgacaggttattagtaaaggaaggggcaccccagggtcatgaagatgcttctcgctctggcccaagcatgctgaggctcgcttattcctcggccaggcccagtaaaacagctcaagcacagcctggagtcttcccgcatctgcgcgggagtagagtctggctttgggccccgcgtaccccgcagtcgtcggggaccagttcgaggccccgggaagggtttccgcggcagggcgcggagtaaagaggggaagaaggaatcctctccgcgtgatcagtagggcgggcttgtgatactctcacacccaggttccagctcagcccccaaactgctgccccaagaaaacaagttggggagtgtggatttagacataacaacgggtgtgagctgatgtccttacaaccaaaaatattgagactagaaattcagctccgaatccacgaccctcagattgatgcttaatcgcaccctcgactccagaaaagctgccggggacagacatggacaggttttgccaagggttcattaaaatagtctgcactggaataaccggggtgcaagagatcacgtcttcactcagggctttggggatcccctcgtcgccccaggtcagtgggtggggaggagggcaaacttctgtcttttgtttgtgggtgagggatgcgaattgtggcagcagccgagaaaaggggggaaattaattgcagccaattaataattaatcccctttaaacagctttattatctcttctgggcgacagagatttgtctgataaccccctgaagac

SEQ ID NO: 728594 - DNA, 1571 bp, Homo sapiens
ttagcgatggtttgggaacccgggcgctggaaaggcgcgggtgcggagggcggctgagccgcgcggctgcggcaccgtgggcgcgagacccctgccgagaggagcgcgcggacgccgggggaagcgcctcggggcggctggaggcgcagcaccctgggggagccggggcgcgggagagacaaaactgttcgaaccttctctcccttccccacccccagcgcccaaacccggggcgggtgagcgcgacccttgcagcgaccccttgccgagccctgcccgcgcgattactaaggagacgcggcctccggcactgccgtccccgcgccgtttgaaaacggatccatcagcggggtatttggagattattcgcactgaattttctgcccgccaagaacgaataggattgccaagccacaccactttttggagcccgcttattcgcgcctatccaccctctcctgtgccccaggttccctgagcacgggaatcctttccgggcatggccaagtttgttcggtggctcagagcgggaagggaagtgcagttcgacacctgtccagctgctccgcttggagatcaaaggccggctatgggctgagcgacagatttacgggacggtggtacagattaaggcgagaaccctgccggtcctggactcgagttcgcacccaaggaaagcgtacaggtccctggaagcgggtggatgtcggagaggccgaggcagcctgcgctgtggccaggcaggcttggtgggctttagtctcagtatgtgttctttaaagtcttgacaggttattagtaaaggaaggggcaccccagggtcatgaagatgcttctcgctctggcccaagcatgctgaggctcgcttattcctcggccaggcccagtaaaacagctcaagcacagcctggagtcttcccgcatctgcgcgggagtagagtctggctttgggccccgcgtaccccgcagtcgtcggggaccagttcgaggccccgggaagggtttccgcggcagggcgcggagtaaagaggggaagaaggaatcctctccgcgtgatcagtagggcgggcttgtgatactctcacacccaggttccagctcagcccccaaactgctgccccaagaaaacaagttggggagtgtggatttagacataacaacgggtgtgagctgatgtccttacaaccaaaaatattgagactagaaattcagctccgaatccacgaccctcagattgatgcttaatcgcaccctcgactccagaaaagctgccggggacagacatggacaggttttgccaagggttcattaaaatagtctgcactggaataaccggggtgcaagagatcacgtcttcactcagggctttggggatcccctcgtcgccccaggtcagtgggtggggaggagggcaaacttctgtcttttgtttgtgggtgagggatgcgaattgtggcagcagccgagaaaaggggggaaattaattgcagccaattaataattaatcccctttaaacagctttattatctcttctgggcgacagagatttgtctgataaccccctgaagac

SEQ ID NO: 728595 - DNA, 1196 bp, Homo sapiens
gatgtaagaagtgtctttcgcctcctgccatgattctgaggtctccccagccatgtggaactgggaagaatggaaggcaacgcctccgaattaaattttgggacccccagtaaaatttcaggaaagcccagaattgatctgagaatgcacaaactcggcatgtctttgacagagaaggctctgggatttcagcgcgttcattgccctccactaaggagctgctcagcaaaggggcttccctctgctctgctctcgggttcggaatccggagcgagtttccagtgagcggcgcccgctgagcgagtgggaaagcatcgcgcgtgcctttccccgcgcgcgtctgcggatcagcgcaggcgaggtgggtgggaatgcagatgtgaggctggaggcagtagagccatctcgcaatcatgcagcaacaagcaaggcagagctggcatgttgttgactgataacatcgagaagctgctatattaatcctggactgccaatctctgaacttcttggtatattgggaacataaactcttttggttaggcactgcgtcagatttctactacatgcagccaaatgcaatctagattgaaatacccctttacctaagttagctttagctgttctcacaacttgctgtttgtgctccacccacagcatatgagatcccttttgcccacagcaccctccctcagtgtgatgtcgtcccccaaccagtatttgcaggttttttgttttttttttttaatcacaaaactgctctcagtctgccaaatctgttggccctagagccagaagtgctatctcctgggaattttttttttttttgagacaggatcttgctgtcatccaggctggagggcagtggcacacactcctgggctcaagcgatcctcctgcttcagccttccgagtggttgggactataggtgagtgccaccactcccagctaattgtttttattttttgtagagatggggatgggcagggatcttactttttgcccaggctggtcttgaactcctggactcaagccatcctcctgccttgatctctcaaagtgctgggattacaggcatgagccaccatgcccggcctgggatctattcttaacccttgccctagtcagggtggtcttcctgcaggattaagagttagactctgagactctgatatcacaccctggcttggccttccct

SEQ ID NO: 728596 - DNA, 834 bp, Homo sapiens
cgcctcctgccatgattctgaggtctccccagccatgtggaactgaatgcagatgtgaggctggaggcagtagagccatctcgcaatcatgcagcaacaagcaaggcagagctggcatgttgttgactgataacatcgagaagctgctatattaatcctggactgccaatctctgaacttcttgagatgggtcttgctctgtcacccaggctggagtgcagtggcaggattgcagctcactggagcctccaaatcctggcctcaagcgatcctcccgcctcagcctcctgagtatctgggactacaggtgtgcaccaccacactaggctatttattatttttgttattattttgtaaagatagggtctcaccatcttgctcaggctggtcttaaactcctgggctcaagcgatgctccccctgtggcccctcaaagtgcaaagaaaacttaacagctttatccacagtgttattttcttttctcttgatgctgtgaattatccccttgatgtcagtgaagctggggttgttttgaaagacttaaatcaatacttccattgagaaaattggaccttgctggctaaagatgaaaagctggaaccctttccaacagctcacttctgtgggctgagatcaggggcagatggctcagtgtcccttgaggtgatttgattacccgtcacggccggacgcctggtctgggtacgtgaagagaagcacagacaggcagctgtagttacactgtttaaaaaagcagaggtactttttcaattcaatgacaggaaggcaaaatacccctacaggtttgaaggaaaaataatttttttcaaaatg

SEQ ID NO: 728597 - DNA, 1159 bp, Homo sapiens; identical to SEQ ID NO: 343433

SEQ ID NO: 728598 - DNA, 871 bp, Homo sapiens
cgcctcctgccatgattctgaggtctccccagccatgtggaactgaatgcagatgtgaggctggaggcagtagagccatctcgcaatcatgcagcaacaagcaaggcagagctggcatgttgttgactgataacatcgagaagctgctatattaatcctggactgccaatctctgaacttcttggtatattgggaacataaactcttttggttaggcactgcgtcagatttctactacatgcagccaaatgcaatctagattgaaatacccctttacctaagttagctttagctgttctcacaacttgctgtttgtgctccacccacagcatatgagatcccttttgcccacagcaccctccctcagtgtgatgtcgtcccccaaccagtatttgcaggttttttgttttttttttttaatcacaaaactgctctcagtctgccaaatctgttggccctagagccagaagtgctatctcctgggaattttttttttttttgagacaggatcttgctgtcatccaggctggagggcagtggcacacactcctgggctcaagcgatcctcctgcttcagccttccgagtggttgggactataggtgagtgccaccactcccagctaattgtttttattttttgtagagatggggatgggcagggatcttactttttgcccaggctggtcttgaactcctggactcaagccatcctcctgccttgatctctcaaagtgctgggattacaggcatgagccaccatgcccggcctgggatctattcttaacccttgccctagtcagggtggtcttcctgcaggattaagagttagactctgagactctgatatcacaccctggcttggccttccct

SEQ ID NO: 728599 - DNA, 906 bp, Homo sapiens
caccatccatgtaagatgtgacttgctcctccttgccttctgccatgattgtgaggcctccccagccacttggaactgaagcaaacactgctattgccacctttttgcagaggaaggtactgaggtgaagcgacttgcccaaaccctacaaaaataactggccattgcatcaacagcagtgtcaagagcatcatagcatcggatgatgatggacagatgcctctgctgcagagttatgcccccgccccaacactcaattggcaatcatctggggaagtctgtcacaatggtccctgtccacctttcttttagtggtttcagcatctgtcaaaggttcttatttgaatttccatcctatcaagggctgcaaaatggtgactttctgaccgtattattgcatctacattcacagctgacattcttcaataaagaaaagttttccttcatcaagtagaactatttagttatgctgaaattcagtatcttctagaaagacattaaatctttaattatttttaattctcaattctcagaataaccaattcatgtaataatcacctccagtgatggcaaatgagttttgttttggaagacattctcttttctagttatgtacttgcggagttttatatattcatagtcatttttaaatgctcaggttgtctcacacttgccactgtatactcttcaactagaatgctacttaacccagattaaaatccacgtttcccgtgtaaaacaccaacctgacatcacacaaaaatctcgggggcttttttccgggggggggaaaagcgtgtttagacatggggcctgggcctagtggttccccgggcccttttttggcccaaggggagaacgcggggcccccaagggggcgaaattgaaagcccgtacttattccaa

SEQ ID NO: 728600 - DNA, 469 bp, Homo sapiens
caccatccatgtaagatgtgacttgctcctccttgccttctgccatgattgtgaggcctccccagccacttggaactgaagcaaacactgctattgccacctttttgcagaggaaggtactgaggtgaagcgacttgcccaaaccctacaaaaaacagagtcttactctattgcccatgctggagtgcaatggcgctatctccgctcactgcaacctccgcctcccgggttcaagcgattctcctgcctcagcctcccaagtagctgggattacaggcacccaccaccatgcccggctaatttttgtatttttagtagagacggggtttcaccatgttagccaggctggtctcaaactcctgacctcgctatctgcccgcctcagcctctcaaagtgctgggattacaggtgtgagccactgggcctggcctatctttttattccttaataaaaaatgtttgtttcctc

SEQ ID NO: 728601 - DNA, 763 bp, Homo sapiens
gccacactggtcatctacaaagtaatgtttaccaattgacgacagggatttaactagattaaaaagatcaaagtgtggtttttctctgctttttaaaatttcactcggaatttgtagctgggccaattcaacacattttacttttcagtggaattgatttttctaatgtttcagaattttaacatatcaagaagaaaacaacgttctcaaagtctggcctctttagcatgatgtaaacctatagaaatgctttgaaatgtgctggtgtaagataagagttatcttgtatgatttaatcatatgcagtgttgtctcagttacgttcagggaaatgtttctgtgtcattcagagatgcttgatgaattaacacctcccaccctgagtgaggggttgacttgttgggagatgatttgggcttcactgggatctgtgacaggtgggggctgggctgggtgtcacaaagagaatagtggtagaaatcgggcgaaggaagaaagaagttactggtaaaaatcattacaccataaagcaccaaggaaataactgagttaaaataggtgaagtttcttttttcccccctgtaacaggagagttttccttatgataattattctgagacttggtcactttgttctttgaatgtggagctgctgaactcattcagaagccatttgctgcctatcaggactttctgaagaagttcttttgcctctgcctaccctctggcaccctcccatggaggcacaggggacccagagctaa

SEQ ID NO: 728602 - DNA, 715 bp, Homo sapiens
gtgttgctgggtcgacccacgcgtctgtggtttttctctgctttttaaaatttcactcggaatttgtagctgggccaattcaacacattttacttttcagtggaattgatttttctaatgtttcagaattttaacatatcaagaagaaaacaacgttctcaaagtctggcctctttagcatgatgtaaacctatagaaatgctttgaaatgtgctggtgtaagataagagttatcttgtatgatttaatcatatgcagtgttgtctcagttacgttcagggaaatgtttctgtgtcattcagagatgcttgatgaattaacacctcccaccctgagtgaggggttgacttgttgggagatgatttgggcttcactgggatctgtgacaggtgggggctgggctgggtgtcacaaagagaatagtggtagaaatcgggcgaaggaagaaagaagttactggtaaaaatcattacaccataaagcaccaaggaaataactgagttaaaataggtgaagtttcttttttcccccctgtaacaggagagttttccttatgataattattctgagacttggtcactttgttctttgaatgtggagctgctgaactcattcagaagccatttgctgcctatcaggactttctgaagaagttcttttgcctctgcctaccctctggcaccctcccatggaggcacaggggacccagagctaa

SEQ ID NO: 728603 - DNA, 2721 bp, Homo sapiens; identical to SEQ ID NO: 191265

SEQ ID NO: 728604 - DNA, 2618 bp, Homo sapiens; identical to SEQ ID NO: 191266

SEQ ID NO: 728605 - DNA, 689 bp, Homo sapiens
atggatgaagaaactgacgctcaggtgacgtcacctgcctaagtttgcacaggtagtaggttatagagctgggatttgactcagttctgtttgtctccaaagccggggtcctgacaatgacgtgattctgcccaaattctttaaattcaaactgtttgattatttaagaacctgtaaaactggccctgtcttacctctcctgttttctctctcattactttgtagcacaaactcagtttcagccaaggtagtctcactatctccaaatctgttgtatttttttccctctcctaaacttttgttcatatgggttcttctgcttggaatacccttccctctactcactgcttgttcatattttatacatctttgaaggactaggtcaaatatttatttatgtatttatttatttattgagacagggtctcatattgttgccaggctggagtgcagtggcacaattgtggctcactgcagcttcaatctcccaggctcaagggatcctcccgcttcagcctcctgagtagctagggtctactgacatgtgtaccacatgtgcccggctaatttttttttttcttttagtagagatgaggtcttgttgttacccaggctgatctcgaactcgtgagctcaaggattcctcctgccttggcttcccaaagtgctgggattacaggcataagcca

SEQ ID NO: 728606 - DNA, 879 bp, Homo sapiens
ggcaaccctgactcggaccgctcgggagagccccaggagaggccagcgccgcgcagcagccgccccgctgcgcccacctccccggctgctcccggagggctcacaaaggcggtggccgcccgagtggccttctccatccaggcgttcgcgtcctcctccccaccttctctcccgaaggcgaaaatggcagggccaggcgagaacctgggacagcggtggccctagccctgcgatcctcacccctcctgctgggagaggctgcgggctgcccgcggacgatgtggccgcggctgctcccgagcgcatcttcggcccgggtccccgccgccacccctcttctctgctccttccatcccgcccagaggagttgatgccgctgtcgccgccgccgccgctgctgaagccgcggctgatggatgccagggagtgccgcattgcttagcgaccccgcctctgggtttgctggtaggagcggctgctctttcttctttcttgcttggggtccatagaacagatacggacattccatctattcttcacaacgtcctcccctttctcttcgtttctgacatgtgcattcccagaagattatccccgggtccacatcacaacaaaacgcccctgtcgtacaacaccgaggcaaggtcccgaggaaaatgaagggctacacgacaggcacgcagtagcgggagcgaaaagcacggaaacacaccgacgagaaccaagggccacccggcaacgcccctgaagggagcgcccacggcagaaccccccgcagcaacccccaaaaggagaaagcgccacaaggggcgcccgacacggacgaagccgccacgcgagcgcgcagcgacacaaacgccagcaaacaacaggccacac

SEQ ID NO: 728607 - DNA, 691 bp, Homo sapiens
  misc_feature (675)..(675): n is a, c, g, or t
ggcaaccctgactcggaccgctcgggagagccccaggagaggccagcgccgcgcagcagccgccccgctgcgcccacctccccggctgctcccggagggctcacaaaggcggtggccgcccgagtggccttctccatccaggcgttcgcgtcctcctccccaccttctctcccgaaggcgaaaatggcagggccaggcgagaacctgggacagcggtggccctagccctgcgatcctcacccctcctgctgggagaggctgcgggctgcccgcggacgatgtggccgcggctgctcccgagcgcatcttcggcccgggtccccgccgccacccctcttctctgctccttccatcccgcccagaggagttgatgccgctgtcgccgccgccgccgctgctgaagccgcggctgatggatgccagggagtgccgcattgcttagcgaccccgcctctgggtttgctgatgatctctctccgccctggagctcagcgctgaagagctaccttattattaatcagaatttccatcgccacccctggcaggcgtatccttcagcagggaccgcaggaacattcacagtgcaggggctgagatgtgcgtgggggttgtttttgttacatcttggaagagaagagaagaggacagtaccaagatcagaaacacccgtgctangtggaaaatagggtga

SEQ ID NO: 728608 - DNA, 661 bp, Homo sapiens
cagaaatctatagctgtaaatgtctacattaaaaaagaagaaagatctcaaatcaataacctaaccttccagcttggagcagttaagagagagacagagagcgcaaactaaacccaaagcaaacagaagggagaaataataatgttttagagcagagataatacaaaatagagaacagaaaaacaatggagcaaatcaaggaaaccaaaagttggacccttaaaaagacaaataatattggcatgccttacctagactgaccaagagaaaagttactaaattactaaaatcagaaataaaaatgaggacattactactaaccttacagaaataaaaacaattataagaaaatgagcaatgggatatcaacaagtcacataacttagataaaatagacgaattcctagaaacacacaaactaccaacactgactgaaaaagaaacacaaaatctgaaatctataacgagaaaagaatgaatcagtatcaaaaaacttccagataagaaaagtccaggcccagaaagtttcactgatgaattctgccaaatgtttaaagaattaacactaatctctctcaaattcttgaaaaaaaatgaagagaagggagcatctcctaacctattctatgagatcagtattactctgatcctaaagcccgac

SEQ ID NO: 728609 - DNA, 862 bp, Homo sapiens; identical to SEQ ID NO: 538429
  misc_feature (82)..(82): n is a, c, g, or t
  misc_feature (90)..(90): n is a, c, g, or t
  misc_feature (97)..(97): n is a, c, g, or t
  misc_feature (100)..(100): n is a, c, g, or t
  misc_feature (103)..(103): n is a, c, g, or t
  misc_feature (141)..(141): n is a, c, g, or t
  misc_feature (166)..(166): n is a, c, g, or t
  misc_feature (172)..(172): n is a, c, g, or t
  misc_feature (183)..(183): n is a, c, g, or t
  misc_feature (194)..(194): n is a, c, g, or t
  misc_feature (208)..(208): n is a, c, g, or t
  misc_feature (210)..(210): n is a, c, g, or t

SEQ ID NO: 728610 - DNA, 1009 bp, Homo sapiens
aaaaggtggagatccagatctagggggagaattggctaggttcttcatcacagtcactgtcttgagacacataggtggtccatggaaacatttccatgagggatttcagaggggagaatgggcagactgcaaagcctcggtactctaataccaggcaaaaagaagaaagggaacaggcattttagttttcacattgaaacagagtgtatgtgtatggccctatgcaaatgttgttcctggtgaatattcatcaatgtactcatcacacataggtatatttagacagaaaggggtcctcatcacagacacccaaattatgagcacattactgcctcctctcccctagaggtgcttcttccagcctcccccattggaggccagcacaagacgggctctccaacccaatatcttccccttccctccttcctttctgctcaggtggctgagtatacacattgaactcttttgtttcaacttcacgtgtatataggttggtgcaaaagtaactgtggtgttttccattaaaagcaatgtcaagaaccgcaattactttggcaccaacctaatatgtatgcaagtacattctttaacctttccaactcccagtccaagccatcaggctaatttccgcgtggaatttgtggtcactggtttgcagtcctttcatttctggtgtggtcagaagtctccttcagactcttcccgataagattgccataggcttcttcatcacctttagtacctacccacttttgctgggataacactacccaagataaattcaaaaaaattgtcctaagtgttagtgtgtttctgttttggttgaagtctattattgctatatggttttctactgtttctacttgatggaagactattaagggttaagtaggctggcctaggaagctgaccaccatttataacatacttttgagtgggaaaatgcattcagaggcctgtaatcaatacttaggtggactttgggaatatagtatttattttatgagtg

SEQ ID NO: 728611 - DNA, 1033 bp, Homo sapiens; identical to SEQ ID NO: 205317

SEQ ID NO: 728612 - DNA, 1141 bp, Homo sapiens; identical to SEQ ID NO: 205316

SEQ ID NO: 728613 - DNA, 1074 bp, Homo sapiens
ctcttgccactgccatgtaagaagtgcctttcaccacccccacaccctgccatgactctgaggcctccccagccacgtggaactgaggcagctgtatggaggccaatatgcagacaagggaagtaactcaggcattttgggggagaggtacagaaagaagagaaaagactgaactgactgctgttctgaacaagaactgtgactatatgtggtactcccagaatggctggtttcctttcagacccatcaagtggccatcctattggcttggactgaagacccccactggagaactgtctctgcagccttagagagaatccagattttgcatttccagtgcagggattgatggagccttgtgtatcaaagtgccaatttctttctaacaagctagggaggataccgttgacagcagcagaaaggggtagcagtggtttgctttccaaatggtaataagaagggcctggcagtggcaacctgtccacgtatcattaaaaatggactctcctgcttcgtttggaattcaacccaatgaacttgaataaactctggacaatgaccagcacagagccctaagcaggatacagcaagattatttgctttactcatccactgagtacctaccatgtgccaaatactatgctatatgccgagtatacactggcaaataaaacacatatggtccctggagcctatgaatcttaccccatctagccacaaataataaaaataagaagaatctgaaggacaagtgggacagaaatactcaagcagaatgagggtgagattgaagtccctgaacatacagtgccctttacacttgatcttagccaaaaggccgagaagagattacagtgctttttaaaggtagcatttcacccagccaataatcaatccctttggccttcttgaggtgcaaggccacacactcaaattctttaatcaaacaataggctagtgcaaatggagctatttcttaaacccagctgtttacacagcagctacaaatctgttcagaaggaatcccccaccatccacaactgtctatcgagcagatgtgcaagagtatttgtc

SEQ ID NO: 728614 - DNA, 1100 bp, Homo sapiens
ctcttgccactgccatgtaagaagtgcctttcaccacccccacaccctgccatgactctgaggcctccccagccacgtggaactgaggcagctgtatggaggccaatatgcagacaagggaagtaactcaggcattttgggggagaggtacagaaagaagagaaaagactgaactgactgctgttctgaacaagaactgtgactatatgtggtactcccagaatggttggactgaagacccccactggagaactgtctctgcagcctatactgatgacactggccactgtccagggctccaccccaaggagtccaagccccagacatttagccttagagagaatccagattttgcatttccagtgcagggattgatggagccttgtgtatcaaagtgccaatttctttctaacaagctagggaggataccgttgacagcagcagaaaggggtagcagtggtttgctttccaaatggtaataagaagggcctggcagtggcaacctgtccacgtatcattaaaaatggactctcctgcttcgtttggaattcaacccaatgaacttgaataaactctggacaatgaccagcacagagccctaagcaggatacagcaagattatttgctttactcatccactgagtacctaccatgtgccaaatactatgctatatgccgagtatacactggcaaataaaacacatatggtccctggagcctatgaatcttaccccatctagccacaaataataaaaataagaagaatctgaaggacaagtgggacagaaatactcaagcagaatgagggtgagattgaagtccctgaacatacagtgccctttacacttgatcttagccaaaaggccgagaagagattacagtgctttttaaaggtagcatttcacccagccaataatcaatccctttggccttcttgaggtgcaaggccacacactcaaattctttaatcaaacaataggctagtgcaaatggagctatttcttaaacccagctgtttacacagcagctacaaatctgttcagaaggaatcccccaccatccacaactgtctatcgagcagatgtgcaagagtatttgtc

SEQ ID NO: 728615 - DNA, 1063 bp, Homo sapiens
ttcctcacttaggtccttgtccctgaagggccatggagctaagtgaccagcgtgcctctctgggtcccgtgtgtgtggtaggaatcttcacactgccttgctgtgaccgtgggccatcgcatcacctccctgtgccttggtttcctggcctctaaagactgaccttaaggggttgtttgtaaggatgaaggcacaaatgcaagccaagtccttagaattctcagcacatagcaagtgctcaatgaaccgcctggctgctgttcgctggggacacagtcttttgctctctggatgtctgaccgtgccctgtccctgcctcacagggccatccatcagtgctggtgagctgagctcagctgacaagccagcctggcacggagcgctgcccctcctgctggtcccagatccgttctgtccggaggagaatttcttatccccaggagatgcctggcctcgttaggagcctcctcacccgcccgcccgaccaaccctctgactccctccacctcaccgcctgggaacaacaggaagagagcaggacagcagcagaaaggagtgctgcttatgtggctcttctcagaatcaggaggctcccaggccaggaatgtgaaaccattatgcagatgaagaagatgaagcccgagaggttatgaaacagacccaagtgggctcgctcttcagtctcggcataaggaatccggaacctgggcccgtgtccggaactgctgtgcccaggcagcttgcctggaaatcaggtagcgtggggggaccccaaaatccccctgtgacagaccacgaatctgccgtgtttgtgcacctctgttttgcttcccagaaacgaaactttggcaactggagagggatggagtggggcgggtggggtacagcaagatcgggaaacagcaccgtcctcaaatgcctgcagaaggtgagagaaccagcaagtgtgatgaagcacctgtgtgcttcgcagccattaccgtgtctaaatctcacaaccacacagtgaggaagggtttctgtttccattttatagataagcaaactgaggctcagagaaagt

SEQ ID NO: 728616 - DNA, 684 bp, Homo sapiens
agttcccagtcatctttatccctttaagcatggtttattttctgagcaaggagtcatcatgggagaccttttttccttattttgggaggtagatcctcccccaatacctgtaaattgtgccattccaaatcaggattatgaatgctggaaggatgactcttgtggaaccatagggagcttcctgctttggtattttgttatcgtatttgtcctgatgttcttctctagggcttctgtctggatgtctgaggataaaaaggatgaaggcagtgggacaagtacttcagtaaggaaagcaagcaaagagacttcctgtaagcggcaaagcaaagacagtgcctgggatccctcacaaacaatgaagaaaccaaagcagaaccaacttacccctgtaaccaactcagaagtggctttggtcaatgcctatcctgaacaaagacgagccaggcgccagtctcagttcaatgaggtgaaccagaaccaacatgacagtgatactacggagtatggcagtgaagagtctaactcagaagcctcctcgtggaaggagagtgaaagtgaacaccacccatcaccagacagtattaagaggagaaaaatggctcagaggcaaaggaatctgggaagttaccaaatgagcgaaaggcactgcctccactgcaaagccttgagaaccaacgaatg

SEQ ID NO: 728617 - DNA, 721 bp, Homo sapiens; identical to SEQ ID NO: 157842

SEQ ID NO: 728618 - DNA, 630 bp, Homo sapiens; identical to SEQ ID NO: 497230

SEQ ID NO: 728619 - DNA, 2835 bp, Homo sapiens
tttctcatctgtacattgaggcaatgagtaaccacctcataggtggtaagggttagataggaaagaacacagtagaatgcctagcacacctaagtactcaatcaatgttagttctggacctttcatttgaatactgcttgagctctgtgcccaatctccctttcctggatcaaataagatttttctttgttagtgatttctttctagatacttccttggccagaactatagatcctctgtctttcactaactcttgttgatctatggttctcattcaagtttgtgtagaacatccagagatttcagaggcattgtttactcctgatgaacagggaacattgcgtgtccaggaaccagcacactgcctgagttatgggggatattcaggaagcatgctgaaccaatgaatgaatgaacaaatgaatgaatagctgattctgactagtcaaccaaaacttaattagcgccattgcttccagatgttattgcttctcaagggagtatgcaatgtgaaagaagaaagaaaaaaaggcgcctctcaatcgtcaaatatcagtagatgcattggttttattaactgatattttctcttcaaaggaaaggctgattcagtcttgcacaggcgaaagatccagtgggtcccattggttctctgtgtctcctgctacacaaattactgacggaaagatttgagccttcattgtgaccacatccacagagaccatagtccagagagagcaattggggcctgaatcaactgctggtgtttgttgagcagaaacagtgagtctctgacttcccaccaacagctaacctgatatggaagagccaagaggcatctcagatttgtcaacattgctttaatgagctgaggaacttctcatggtaaactcagcagctgagtaacaggatgatggcaccacaacaggtagataatcaaggcaggaggtcaaagcactggagccaacacccgcccaggatggggtataaaagggttgggaggagaggaggcttcagtctcagtggctcagccttcccagctgatctgaagctcctgtgcagcctcagccctacaccatgacctccttctacagcacctcctcatgccctctgggttgcaccatggctcctggagcaagaaatgtctttgtctctcctatcgatgttgggtgccagcctgtggcagaggccaatgctgcctccatgtgcctcttggccaacgtggcacacgccaacagagtccgtgtggggtcgactcccctgggccgccccagcctctgtctgcccccaaccagtcacactgcttgtcccttgccagggacctgtcacattcccggcaacatcggaatctgtggggcctacggcaaaaacaccctgaatggccatgagaaggagaccatgaagttcctgaatgaccgcctggccaactacctggagaaggtgcgccagctggagcaggagaatgcagagctggagaccacactcctcgagaggagcaagtgccacgagtccaccgtgtgccccgactaccagtcctacttccgtacaatcgaggagctccagcagaagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttactcccctgcaatccctgttccacgcctgcctcctgtacttcttgtccaagctgtggccctgtcaccggtgggtctccctctggccatggagccagcatggggagatgattctgaaggcccgagttaggagattgaggctggttgcactggggtcaggagtgccctcaccttgcccagtcttccttcaagactagactcactgaggcattttccctaaatcaaccggtagcagatacttccaaggagtggctccctgcctatgcctctaagctgtattttttgttgttgctaaaatgttgtaattatcttccatgaaagcaattatttttcctggtgtctcttcttggtacttttagttctattccagtgtttcagaatctccaaaaatgtaactgggttccctgcattaaatggtcaataaacctccttcctgcaccaagtgctgtctccccggtgttggttgtatgtgagatgtcggagagtcctggtcgtcaggtcctgtgtcctcactggctctgacatcttgcttccaggag

SEQ ID NO: 728620 - DNA, 411 bp, Homo sapiens
gacaggggatacccggcgactcctacttccgtacaatcgaggagctccagcagaaggtgaggtgtgggatcgcctgggcatgctgggtctgagaaggcagaagccttcgcaggaggaatctgcataaggtccagagagctttgggttcttggtttctcttggacatgagcgtaaataccacacatggagtgggagcttagagtatggtgctttgtgtgtgaaccgtctttccgttttcctcagatcctgtgcagcaaggctgagaatgccaggctgattgtacaaattgacaacgcgaagctggctgctgatgactttaggatcaagtaagtcaggatgaggagggtcagtgtgacttctctcctgctgtatttccaagggcccgccccattactcagtctatattgtagg

SEQ ID NO: 728621 - DNA, 598 bp, Homo sapiens; identical to SEQ ID NO: 338675

SEQ ID NO: 728622 - DNA, 1924 bp, Homo sapiens
tttctcatctgtacattgaggcaatgagtaaccacctcataggtggtaagggttagataggaaagaacacagtagaatgcctagcacacctaagtactcaatcaatgttagttctggacctttcatttgaatactgcttgagctctgtgcccaatctccctttcctggatcaaataagatttttctttgttagtgatttctttctagatacttccttggccagaactatagatcctctgtctttcactaactcttgttgatctatggttctcattcaagtttgtgtagaacatccagagatttcagaggcattgtttactcctgatgaacagggaacattgcgtgtccaggaaccagcacactgcctgagttatgggggatattcaggaagcatgctgaaccaatgaatgaatgaacaaatgaatgaatagctgattctgactagtcaaccaaaacttaattagcgccattgcttccagatgttattgcttctcaagggagtatgcaatgtgaaagaagaaagaaaaaaaggcgcctctcaatcgtcaaatatcagtagatgcattggttttattaactgatattttctcttcaaaggaaaggctgattcagtcttgcacaggcgaaagatccagtgggtcccattggttctctgtgtctcctgctacacaaattactgacggaaagatttgagccttcattgtgaccacatccacagagaccatagtccagagagagcaattggggcctgaatcaactgctggtgtttgttgagcagaaacagtgagtctctgacttcccaccaacagctaacctgatatggaagagccaagaggcatctcagatttgtcaacattgctttaatgagctgaggaacttctcatggtaaactcagcagctgagtaacaggatgatggcaccacaacaggtagataatcaaggcaggaggtcaaagcactggagccaacacccgcccaggatggggtataaaagggttgggaggagaggaggcttcagtctcagtggctcagccttcccagctgatctgaagctcctgtgcagcctcagccctacaccatgacctccttctacagcacctcctcatgccctctgggttgcaccatggctcctggagcaagaaatgtctttgtctctcctatcgatgttgggtgccagcctgtggcagaggccaatgctgcctccatgtgcctcttggccaacgtggcacacgccaacagagtccgtgtggggtcgactcccctgggccgccccagcctctgtctgcccccaaccagtcacactgcttgtcccttgccagggacctgtcacattcccggcaacatcggaatctgtggggcctacggcaaaaacaccctgaatggccatgagaaggagaccatgaagttcctgaatgaccgcctggccaactacctggagaaggtgcgccagctggagcaggagaatgcagagctggagaccacactcctcgagaggagcaagtgccacgagtccaccgtgtgccccgactaccagtcctacttccgtacaatcgaggagctccagcagaaggtgaggtgtgggatcgcctgggcatgctgggtctgagaaggcagaagccttcgcaggaggaatctgcataaggtccagagagctttgggttcttggtttctcttggacatgagcgtaaataccacacatggagtgggagcttagagtatggtgctttgtgtgtgaaccgtctttccgttttcctcagatcctgtgcagcaaggctgagaatgccaggctgattgtacaaattgacaacgcgaagctggctgctgatgactttaggatcaagtaagtcaggatgaggagggtcagtgtgacttctctcctgctgtatttccaagggcccgccccattactcagtctatattgtagg

SEQ ID NO: 728623 - DNA, 2445 bp, Homo sapiens
tttctcatctgtacattgaggcaatgagtaaccacctcataggtggtaagggttagataggaaagaacacagtagaatgcctagcacacctaagtactcaatcaatgttagttctggacctttcatttgaatactgcttgagctctgtgcccaatctccctttcctggatcaaataagatttttctttgttagtgatttctttctagatacttccttggccagaactatagatcctctgtctttcactaactcttgttgatctatggttctcattcaagtttgtgtagaacatccagagatttcagaggcattgtttactcctgatgaacagggaacattgcgtgtccaggaaccagcacactgcctgagttatgggggatattcaggaagcatgctgaaccaatgaatgaatgaacaaatgaatgaatagctgattctgactagtcaaccaaaacttaattagcgccattgcttccagatgttattgcttctcaagggagtatgcaatgtgaaagaagaaagaaaaaaaggcgcctctcaatcgtcaaatatcagtagatgcattggttttattaactgatattttctcttcaaaggaaaggctgattcagtcttgcacaggcgaaagatccagtgggtcccattggttctctgtgtctcctgctacacaaattactgacggaaagatttgagccttcattgtgaccacatccacagagaccatagtccagagagagcaattggggcctgaatcaactgctggtgtttgttgagcagaaacagtgagtctctgacttcccaccaacagctaacctgatatggaagagccaagaggcatctcagatttgtcaacattgctttaatgagctgaggaacttctcatggtaaactcagcagctgagtaacaggatgatggcaccacaacaggtagataatcaaggcaggaggtcaaagcactggagccaacacccgcccaggatggggtataaaagggttgggaggagaggaggcttcagtctcagtggctcagccttcccagctgatctgaagctcctgtgcagcctcagccctacaccatgacctccttctacagcacctcctcatgccctctgggttgcaccatggctcctggagcaagaaatgtctttgtctctcctatcgatgttgggtgccagcctgtggcagaggccaatgctgcctccatgtgcctcttggccaacgtggcacacgccaacagagtccgtgtggggtcgactcccctgggccgccccagcctctgtctgcccccaaccagtcacactgcttgtcccttgccagggacctgtcacattcccggcaacatcggaatctgtggggcctacggcaaaaacaccctgaatggccatgagaaggagaccatgaagttcctgaatgaccgcctggccaactacctggagaaggtgcgccagctggagcaggagaatgcagagctggagaccacactcctcgagaggagcaagtgccacgagtccaccgtgtgccccgactaccagtcctacttccgtacaatcgaggagctccagcagaaggtgaggtgtgggatcgcctgggcatgctgggtctgagaaggcagaagccttcgcaggaggaatctgcataaggtccagagagctttgggttcttggtttctcttggacatgagcgtaaataccacacatggagtgggagcttagagtatggtgctttgtgtgtgaaccgtctttccgttttcctcagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccaggtgagtgggggttacagagccagggagtacctggcctccatctgagcagggaggtgactgtgtttctctgtgctccagtctgaaggcatcagcctgcaggccatgtcctgctccgaggagctgcagtgctgccagtcggagatcctggagctgagatgcacggtgaatgccctggaggtggagcgccaagcccagcacaccttggtacgtgtccttcaccctcactgcactgcaaatgccccatgccatgtcctggtagtagcatctcttaaagtctcacaaatcag

SEQ ID NO: 728624 - DNA, 2605 bp, Homo sapiens
tttctcatctgtacattgaggcaatgagtaaccacctcataggtggtaagggttagataggaaagaacacagtagaatgcctagcacacctaagtactcaatcaatgttagttctggacctttcatttgaatactgcttgagctctgtgcccaatctccctttcctggatcaaataagatttttctttgttagtgatttctttctagatacttccttggccagaactatagatcctctgtctttcactaactcttgttgatctatggttctcattcaagtttgtgtagaacatccagagatttcagaggcattgtttactcctgatgaacagggaacattgcgtgtccaggaaccagcacactgcctgagttatgggggatattcaggaagcatgctgaaccaatgaatgaatgaacaaatgaatgaatagctgattctgactagtcaaccaaaacttaattagcgccattgcttccagatgttattgcttctcaagggagtatgcaatgtgaaagaagaaagaaaaaaaggcgcctctcaatcgtcaaatatcagtagatgcattggttttattaactgatattttctcttcaaaggaaaggctgattcagtcttgcacaggcgaaagatccagtgggtcccattggttctctgtgtctcctgctacacaaattactgacggaaagatttgagccttcattgtgaccacatccacagagaccatagtccagagagagcaattggggcctgaatcaactgctggtgtttgttgagcagaaacagtgagtctctgacttcccaccaacagctaacctgatatggaagagccaagaggcatctcagatttgtcaacattgctttaatgagctgaggaacttctcatggtaaactcagcagctgagtaacaggatgatggcaccacaacaggtagataatcaaggcaggaggtcaaagcactggagccaacacccgcccaggatggggtataaaagggttgggaggagaggaggcttcagtctcagtggctcagccttcccagctgatctgaagctcctgtgcagcctcagccctacaccatgacctccttctacagcacctcctcatgccctctgggttgcaccatggctcctggagcaagaaatgtctttgtctctcctatcgatgttgggtgccagcctgtggcagaggccaatgctgcctccatgtgcctcttggccaacgtggcacacgccaacagagtccgtgtggggtcgactcccctgggccgccccagcctctgtctgcccccaaccagtcacactgcttgtcccttgccagggacctgtcacattcccggcaacatcggaatctgtggggcctacggcaaaaacaccctgaatggccatgagaaggagaccatgaagttcctgaatgaccgcctggccaactacctggagaaggtgcgccagctggagcaggagaatgcagagctggagaccacactcctcgagaggagcaagtgccacgagtccaccgtgtgccccgactaccagtcctacttccgtacaatcgaggagctccagcagaaggtgaggtgtgggatcgcctgggcatgctgggtctgagaaggcagaagccttcgcaggaggaatctgcataaggtccagagagctttgggttcttggtttctcttggacatgagcgtaaataccacacatggagtgggagcttagagtatggtgctttgtgtgtgaaccgtctttccgttttcctcagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccaggtgagtgggggttacagagccagggagtacctggcctccatctgagcagggaggtgactgtgtttctctgtgctccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttctggagagcgaggactgcaagtacgtgtgatctgggcaattc

SEQ ID NO: 728625 - DNA, 3100 bp, Homo sapiens
tttctcatctgtacattgaggcaatgagtaaccacctcataggtggtaagggttagataggaaagaacacagtagaatgcctagcacacctaagtactcaatcaatgttagttctggacctttcatttgaatactgcttgagctctgtgcccaatctccctttcctggatcaaataagatttttctttgttagtgatttctttctagatacttccttggccagaactatagatcctctgtctttcactaactcttgttgatctatggttctcattcaagtttgtgtagaacatccagagatttcagaggcattgtttactcctgatgaacagggaacattgcgtgtccaggaaccagcacactgcctgagttatgggggatattcaggaagcatgctgaaccaatgaatgaatgaacaaatgaatgaatagctgattctgactagtcaaccaaaacttaattagcgccattgcttccagatgttattgcttctcaagggagtatgcaatgtgaaagaagaaagaaaaaaaggcgcctctcaatcgtcaaatatcagtagatgcattggttttattaactgatattttctcttcaaaggaaaggctgattcagtcttgcacaggcgaaagatccagtgggtcccattggttctctgtgtctcctgctacacaaattactgacggaaagatttgagccttcattgtgaccacatccacagagaccatagtccagagagagcaattggggcctgaatcaactgctggtgtttgttgagcagaaacagtgagtctctgacttcccaccaacagctaacctgatatggaagagccaagaggcatctcagatttgtcaacattgctttaatgagctgaggaacttctcatggtaaactcagcagctgagtaacaggatgatggcaccacaacaggtagataatcaaggcaggaggtcaaagcactggagccaacacccgcccaggatggggtataaaagggttgggaggagaggaggcttcagtctcagtggctcagccttcccagctgatctgaagctcctgtgcagcctcagccctacaccatgacctccttctacagcacctcctcatgccctctgggttgcaccatggctcctggagcaagaaatgtctttgtctctcctatcgatgttgggtgccagcctgtggcagaggccaatgctgcctccatgtgcctcttggccaacgtggcacacgccaacagagtccgtgtggggtcgactcccctgggccgccccagcctctgtctgcccccaaccagtcacactgcttgtcccttgccagggacctgtcacattcccggcaacatcggaatctgtggggcctacggcaaaaacaccctgaatggccatgagaaggagaccatgaagttcctgaatgaccgcctggccaactacctggagaaggtgcgccagctggagcaggagaatgcagagctggagaccacactcctcgagaggagcaagtgccacgagtccaccgtgtgccccgactaccagtcctacttccgtacaatcgaggagctccagcagaaggtgaggtgtgggatcgcctgggcatgctgggtctgagaaggcagaagccttcgcaggaggaatctgcataaggtccagagagctttgggttcttggtttctcttggacatgagcgtaaataccacacatggagtgggagcttagagtatggtgctttgtgtgtgaaccgtctttccgttttcctcagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccaggtgagtgggggttacagagccagggagtacctggcctccatctgagcagggaggtgactgtgtttctctgtgctccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttactcccctgcaatccctgttccacgcctgcctcctgtacttcttgtccaagctgtggccctgtcaccggtgggtctccctctggccatggagccagcatggggagatgattctgaaggcccgagttaggagattgaggctggttgcactggggtcaggagtgccctcaccttgcccagtcttccttcaagactagactcactgaggcattttccctaaatcaaccggtagcagatacttccaaggagtggctccctgcctatgcctctaagctgtattttttgttgttgctaaaatgttgtaattatcttccatgaaagcaattatttttcctggtgtctcttcttggtacttttagttctattccagtgtttcagaatctccaaaaatgtaactgggttccctgcattaaatggtcaataaacctccttcctgcaccaagtgctgtctccccggtgttggttgtatgtgagatgtcggagagtcctggtcgtcaggtcctgtgtcctcactggctctgacatcttgcttccaggag

SEQ ID NO: 728626 - DNA, 2367 bp, Homo sapiens
tttctcatctgtacattgaggcaatgagtaaccacctcataggtggtaagggttagataggaaagaacacagtagaatgcctagcacacctaagtactcaatcaatgttagttctggacctttcatttgaatactgcttgagctctgtgcccaatctccctttcctggatcaaataagatttttctttgttagtgatttctttctagatacttccttggccagaactatagatcctctgtctttcactaactcttgttgatctatggttctcattcaagtttgtgtagaacatccagagatttcagaggcattgtttactcctgatgaacagggaacattgcgtgtccaggaaccagcacactgcctgagttatgggggatattcaggaagcatgctgaaccaatgaatgaatgaacaaatgaatgaatagctgattctgactagtcaaccaaaacttaattagcgccattgcttccagatgttattgcttctcaagggagtatgcaatgtgaaagaagaaagaaaaaaaggcgcctctcaatcgtcaaatatcagtagatgcattggttttattaactgatattttctcttcaaaggaaaggctgattcagtcttgcacaggcgaaagatccagtgggtcccattggttctctgtgtctcctgctacacaaattactgacggaaagatttgagccttcattgtgaccacatccacagagaccatagtccagagagagcaattggggcctgaatcaactgctggtgtttgttgagcagaaacagtgagtctctgacttcccaccaacagctaacctgatatggaagagccaagaggcatctcagatttgtcaacattgctttaatgagctgaggaacttctcatggtaaactcagcagctgagtaacaggatgatggcaccacaacaggtagataatcaaggcaggaggtcaaagcactggagccaacacccgcccaggatggggtataaaagggttgggaggagaggaggcttcagtctcagtggctcagccttcccagctgatctgaagctcctgtgcagcctcagccctacaccatgacctccttctacagcacctcctcatgccctctgggttgcaccatggctcctggagcaagaaatgtctttgtctctcctatcgatgttgggtgccagcctgtggcagaggccaatgctgcctccatgtgcctcttggccaacgtggcacacgccaacagagtccgtgtggggtcgactcccctgggccgccccagcctctgtctgcccccaaccagtcacactgcttgtcccttgccagggacctgtcacattcccggcaacatcggaatctgtggggcctacggcaaaaacaccctgaatggccatgagaaggagaccatgaagttcctgaatgaccgcctggccaactacctggagaaggtgcgccagctggagcaggagaatgcagagctggagaccacactcctcgagaggagcaagtgccacgagtccaccgtgtgccccgactaccagtcctacttccgtacaatcgaggagctccagcagaaggtgaggtgtgggatcgcctgggcatgctgggtctgagaaggcagaagccttcgcaggaggaatctgcataaggtccagagagctttgggttcttggtttctcttggacatgagcgtaaataccacacatggagtgggagcttagagtatggtgctttgtgtgtgaaccgtctttccgttttcctcagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccagtctgaaggcatcagcctgcaggccatgtcctgctccgaggagctgcagtgctgccagtcggagatcctggagctgagatgcacggtgaatgccctggaggtggagcgccaagcccagcacaccttggtacgtgtccttcaccctcactgcactgcaaatgccccatgccatgtcctggtagtagcatctcttaaagtctcacaaatcag

SEQ ID NO: 728627 - DNA, 2527 bp, Homo sapiens
tttctcatctgtacattgaggcaatgagtaaccacctcataggtggtaagggttagataggaaagaacacagtagaatgcctagcacacctaagtactcaatcaatgttagttctggacctttcatttgaatactgcttgagctctgtgcccaatctccctttcctggatcaaataagatttttctttgttagtgatttctttctagatacttccttggccagaactatagatcctctgtctttcactaactcttgttgatctatggttctcattcaagtttgtgtagaacatccagagatttcagaggcattgtttactcctgatgaacagggaacattgcgtgtccaggaaccagcacactgcctgagttatgggggatattcaggaagcatgctgaaccaatgaatgaatgaacaaatgaatgaatagctgattctgactagtcaaccaaaacttaattagcgccattgcttccagatgttattgcttctcaagggagtatgcaatgtgaaagaagaaagaaaaaaaggcgcctctcaatcgtcaaatatcagtagatgcattggttttattaactgatattttctcttcaaaggaaaggctgattcagtcttgcacaggcgaaagatccagtgggtcccattggttctctgtgtctcctgctacacaaattactgacggaaagatttgagccttcattgtgaccacatccacagagaccatagtccagagagagcaattggggcctgaatcaactgctggtgtttgttgagcagaaacagtgagtctctgacttcccaccaacagctaacctgatatggaagagccaagaggcatctcagatttgtcaacattgctttaatgagctgaggaacttctcatggtaaactcagcagctgagtaacaggatgatggcaccacaacaggtagataatcaaggcaggaggtcaaagcactggagccaacacccgcccaggatggggtataaaagggttgggaggagaggaggcttcagtctcagtggctcagccttcccagctgatctgaagctcctgtgcagcctcagccctacaccatgacctccttctacagcacctcctcatgccctctgggttgcaccatggctcctggagcaagaaatgtctttgtctctcctatcgatgttgggtgccagcctgtggcagaggccaatgctgcctccatgtgcctcttggccaacgtggcacacgccaacagagtccgtgtggggtcgactcccctgggccgccccagcctctgtctgcccccaaccagtcacactgcttgtcccttgccagggacctgtcacattcccggcaacatcggaatctgtggggcctacggcaaaaacaccctgaatggccatgagaaggagaccatgaagttcctgaatgaccgcctggccaactacctggagaaggtgcgccagctggagcaggagaatgcagagctggagaccacactcctcgagaggagcaagtgccacgagtccaccgtgtgccccgactaccagtcctacttccgtacaatcgaggagctccagcagaaggtgaggtgtgggatcgcctgggcatgctgggtctgagaaggcagaagccttcgcaggaggaatctgcataaggtccagagagctttgggttcttggtttctcttggacatgagcgtaaataccacacatggagtgggagcttagagtatggtgctttgtgtgtgaaccgtctttccgttttcctcagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttctggagagcgaggactgcaagtacgtgtgatctgggcaattc

SEQ ID NO: 728628 - DNA, 3022 bp, Homo sapiens
tttctcatctgtacattgaggcaatgagtaaccacctcataggtggtaagggttagataggaaagaacacagtagaatgcctagcacacctaagtactcaatcaatgttagttctggacctttcatttgaatactgcttgagctctgtgcccaatctccctttcctggatcaaataagatttttctttgttagtgatttctttctagatacttccttggccagaactatagatcctctgtctttcactaactcttgttgatctatggttctcattcaagtttgtgtagaacatccagagatttcagaggcattgtttactcctgatgaacagggaacattgcgtgtccaggaaccagcacactgcctgagttatgggggatattcaggaagcatgctgaaccaatgaatgaatgaacaaatgaatgaatagctgattctgactagtcaaccaaaacttaattagcgccattgcttccagatgttattgcttctcaagggagtatgcaatgtgaaagaagaaagaaaaaaaggcgcctctcaatcgtcaaatatcagtagatgcattggttttattaactgatattttctcttcaaaggaaaggctgattcagtcttgcacaggcgaaagatccagtgggtcccattggttctctgtgtctcctgctacacaaattactgacggaaagatttgagccttcattgtgaccacatccacagagaccatagtccagagagagcaattggggcctgaatcaactgctggtgtttgttgagcagaaacagtgagtctctgacttcccaccaacagctaacctgatatggaagagccaagaggcatctcagatttgtcaacattgctttaatgagctgaggaacttctcatggtaaactcagcagctgagtaacaggatgatggcaccacaacaggtagataatcaaggcaggaggtcaaagcactggagccaacacccgcccaggatggggtataaaagggttgggaggagaggaggcttcagtctcagtggctcagccttcccagctgatctgaagctcctgtgcagcctcagccctacaccatgacctccttctacagcacctcctcatgccctctgggttgcaccatggctcctggagcaagaaatgtctttgtctctcctatcgatgttgggtgccagcctgtggcagaggccaatgctgcctccatgtgcctcttggccaacgtggcacacgccaacagagtccgtgtggggtcgactcccctgggccgccccagcctctgtctgcccccaaccagtcacactgcttgtcccttgccagggacctgtcacattcccggcaacatcggaatctgtggggcctacggcaaaaacaccctgaatggccatgagaaggagaccatgaagttcctgaatgaccgcctggccaactacctggagaaggtgcgccagctggagcaggagaatgcagagctggagaccacactcctcgagaggagcaagtgccacgagtccaccgtgtgccccgactaccagtcctacttccgtacaatcgaggagctccagcagaaggtgaggtgtgggatcgcctgggcatgctgggtctgagaaggcagaagccttcgcaggaggaatctgcataaggtccagagagctttgggttcttggtttctcttggacatgagcgtaaataccacacatggagtgggagcttagagtatggtgctttgtgtgtgaaccgtctttccgttttcctcagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttactcccctgcaatccctgttccacgcctgcctcctgtacttcttgtccaagctgtggccctgtcaccggtgggtctccctctggccatggagccagcatggggagatgattctgaaggcccgagttaggagattgaggctggttgcactggggtcaggagtgccctcaccttgcccagtcttccttcaagactagactcactgaggcattttccctaaatcaaccggtagcagatacttccaaggagtggctccctgcctatgcctctaagctgtattttttgttgttgctaaaatgttgtaattatcttccatgaaagcaattatttttcctggtgtctcttcttggtacttttagttctattccagtgtttcagaatctccaaaaatgtaactgggttccctgcattaaatggtcaataaacctccttcctgcaccaagtgctgtctccccggtgttggttgtatgtgagatgtcggagagtcctggtcgtcaggtcctgtgtcctcactggctctgacatcttgcttccaggag

SEQ ID NO: 728629 - DNA, 1737 bp, Homo sapiens
tttctcatctgtacattgaggcaatgagtaaccacctcataggtggtaagggttagataggaaagaacacagtagaatgcctagcacacctaagtactcaatcaatgttagttctggacctttcatttgaatactgcttgagctctgtgcccaatctccctttcctggatcaaataagatttttctttgttagtgatttctttctagatacttccttggccagaactatagatcctctgtctttcactaactcttgttgatctatggttctcattcaagtttgtgtagaacatccagagatttcagaggcattgtttactcctgatgaacagggaacattgcgtgtccaggaaccagcacactgcctgagttatgggggatattcaggaagcatgctgaaccaatgaatgaatgaacaaatgaatgaatagctgattctgactagtcaaccaaaacttaattagcgccattgcttccagatgttattgcttctcaagggagtatgcaatgtgaaagaagaaagaaaaaaaggcgcctctcaatcgtcaaatatcagtagatgcattggttttattaactgatattttctcttcaaaggaaaggctgattcagtcttgcacaggcgaaagatccagtgggtcccattggttctctgtgtctcctgctacacaaattactgacggaaagatttgagccttcattgtgaccacatccacagagaccatagtccagagagagcaattggggcctgaatcaactgctggtgtttgttgagcagaaacagtgagtctctgacttcccaccaacagctaacctgatatggaagagccaagaggcatctcagatttgtcaacattgctttaatgagctgaggaacttctcatggtaaactcagcagctgagtaacaggatgatggcaccacaacaggtagataatcaaggcaggaggtcaaagcactggagccaacacccgcccaggatggggtataaaagggttgggaggagaggaggcttcagtctcagtggctcagccttcccagctgatctgaagctcctgtgcagcctcagccctacaccatgacctccttctacagcacctcctcatgccctctgggttgcaccatggctcctggagcaagaaatgtctttgtctctcctatcgatgttgggtgccagcctgtggcagaggccaatgctgcctccatgtgcctcttggccaacgtggcacacgccaacagagtccgtgtggggtcgactcccctgggccgccccagcctctgtctgcccccaaccagtcacactgcttgtcccttgccagggacctgtcacattcccggcaacatcggaatctgtggggcctacggcaaaaacaccctgaatggccatgagaaggagaccatgaagttcctgaatgaccgcctggccaactacctggagaaggtgcgccagctggagcaggagaatgcagagctggagaccacactcctcgagaggagcaagtgccacgagtccaccgtgtgccccgactaccagtcctacttccgtacaatcgaggagctccagcagaagatcctgtgcagcaaggctgagaatgccaggctgattgtacaaattgacaacgcgaagctggctgctgatgactttaggatcaagtaagtcaggatgaggagggtcagtgtgacttctctcctgctgtatttccaagggcccgccccattactcagtctatattgtagg

SEQ ID NO: 728630 - DNA, 2258 bp, Homo sapiens
tttctcatctgtacattgaggcaatgagtaaccacctcataggtggtaagggttagataggaaagaacacagtagaatgcctagcacacctaagtactcaatcaatgttagttctggacctttcatttgaatactgcttgagctctgtgcccaatctccctttcctggatcaaataagatttttctttgttagtgatttctttctagatacttccttggccagaactatagatcctctgtctttcactaactcttgttgatctatggttctcattcaagtttgtgtagaacatccagagatttcagaggcattgtttactcctgatgaacagggaacattgcgtgtccaggaaccagcacactgcctgagttatgggggatattcaggaagcatgctgaaccaatgaatgaatgaacaaatgaatgaatagctgattctgactagtcaaccaaaacttaattagcgccattgcttccagatgttattgcttctcaagggagtatgcaatgtgaaagaagaaagaaaaaaaggcgcctctcaatcgtcaaatatcagtagatgcattggttttattaactgatattttctcttcaaaggaaaggctgattcagtcttgcacaggcgaaagatccagtgggtcccattggttctctgtgtctcctgctacacaaattactgacggaaagatttgagccttcattgtgaccacatccacagagaccatagtccagagagagcaattggggcctgaatcaactgctggtgtttgttgagcagaaacagtgagtctctgacttcccaccaacagctaacctgatatggaagagccaagaggcatctcagatttgtcaacattgctttaatgagctgaggaacttctcatggtaaactcagcagctgagtaacaggatgatggcaccacaacaggtagataatcaaggcaggaggtcaaagcactggagccaacacccgcccaggatggggtataaaagggttgggaggagaggaggcttcagtctcagtggctcagccttcccagctgatctgaagctcctgtgcagcctcagccctacaccatgacctccttctacagcacctcctcatgccctctgggttgcaccatggctcctggagcaagaaatgtctttgtctctcctatcgatgttgggtgccagcctgtggcagaggccaatgctgcctccatgtgcctcttggccaacgtggcacacgccaacagagtccgtgtggggtcgactcccctgggccgccccagcctctgtctgcccccaaccagtcacactgcttgtcccttgccagggacctgtcacattcccggcaacatcggaatctgtggggcctacggcaaaaacaccctgaatggccatgagaaggagaccatgaagttcctgaatgaccgcctggccaactacctggagaaggtgcgccagctggagcaggagaatgcagagctggagaccacactcctcgagaggagcaagtgccacgagtccaccgtgtgccccgactaccagtcctacttccgtacaatcgaggagctccagcagaagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccaggtgagtgggggttacagagccagggagtacctggcctccatctgagcagggaggtgactgtgtttctctgtgctccagtctgaaggcatcagcctgcaggccatgtcctgctccgaggagctgcagtgctgccagtcggagatcctggagctgagatgcacggtgaatgccctggaggtggagcgccaagcccagcacaccttggtacgtgtccttcaccctcactgcactgcaaatgccccatgccatgtcctggtagtagcatctcttaaagtctcacaaatcag

SEQ ID NO: 728631 - DNA, 2418 bp, Homo sapiens
tttctcatctgtacattgaggcaatgagtaaccacctcataggtggtaagggttagataggaaagaacacagtagaatgcctagcacacctaagtactcaatcaatgttagttctggacctttcatttgaatactgcttgagctctgtgcccaatctccctttcctggatcaaataagatttttctttgttagtgatttctttctagatacttccttggccagaactatagatcctctgtctttcactaactcttgttgatctatggttctcattcaagtttgtgtagaacatccagagatttcagaggcattgtttactcctgatgaacagggaacattgcgtgtccaggaaccagcacactgcctgagttatgggggatattcaggaagcatgctgaaccaatgaatgaatgaacaaatgaatgaatagctgattctgactagtcaaccaaaacttaattagcgccattgcttccagatgttattgcttctcaagggagtatgcaatgtgaaagaagaaagaaaaaaaggcgcctctcaatcgtcaaatatcagtagatgcattggttttattaactgatattttctcttcaaaggaaaggctgattcagtcttgcacaggcgaaagatccagtgggtcccattggttctctgtgtctcctgctacacaaattactgacggaaagatttgagccttcattgtgaccacatccacagagaccatagtccagagagagcaattggggcctgaatcaactgctggtgtttgttgagcagaaacagtgagtctctgacttcccaccaacagctaacctgatatggaagagccaagaggcatctcagatttgtcaacattgctttaatgagctgaggaacttctcatggtaaactcagcagctgagtaacaggatgatggcaccacaacaggtagataatcaaggcaggaggtcaaagcactggagccaacacccgcccaggatggggtataaaagggttgggaggagaggaggcttcagtctcagtggctcagccttcccagctgatctgaagctcctgtgcagcctcagccctacaccatgacctccttctacagcacctcctcatgccctctgggttgcaccatggctcctggagcaagaaatgtctttgtctctcctatcgatgttgggtgccagcctgtggcagaggccaatgctgcctccatgtgcctcttggccaacgtggcacacgccaacagagtccgtgtggggtcgactcccctgggccgccccagcctctgtctgcccccaaccagtcacactgcttgtcccttgccagggacctgtcacattcccggcaacatcggaatctgtggggcctacggcaaaaacaccctgaatggccatgagaaggagaccatgaagttcctgaatgaccgcctggccaactacctggagaaggtgcgccagctggagcaggagaatgcagagctggagaccacactcctcgagaggagcaagtgccacgagtccaccgtgtgccccgactaccagtcctacttccgtacaatcgaggagctccagcagaagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccaggtgagtgggggttacagagccagggagtacctggcctccatctgagcagggaggtgactgtgtttctctgtgctccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttctggagagcgaggactgcaagtacgtgtgatctgggcaattc

SEQ ID NO: 728632 - DNA, 2913 bp, Homo sapiens
tttctcatctgtacattgaggcaatgagtaaccacctcataggtggtaagggttagataggaaagaacacagtagaatgcctagcacacctaagtactcaatcaatgttagttctggacctttcatttgaatactgcttgagctctgtgcccaatctccctttcctggatcaaataagatttttctttgttagtgatttctttctagatacttccttggccagaactatagatcctctgtctttcactaactcttgttgatctatggttctcattcaagtttgtgtagaacatccagagatttcagaggcattgtttactcctgatgaacagggaacattgcgtgtccaggaaccagcacactgcctgagttatgggggatattcaggaagcatgctgaaccaatgaatgaatgaacaaatgaatgaatagctgattctgactagtcaaccaaaacttaattagcgccattgcttccagatgttattgcttctcaagggagtatgcaatgtgaaagaagaaagaaaaaaaggcgcctctcaatcgtcaaatatcagtagatgcattggttttattaactgatattttctcttcaaaggaaaggctgattcagtcttgcacaggcgaaagatccagtgggtcccattggttctctgtgtctcctgctacacaaattactgacggaaagatttgagccttcattgtgaccacatccacagagaccatagtccagagagagcaattggggcctgaatcaactgctggtgtttgttgagcagaaacagtgagtctctgacttcccaccaacagctaacctgatatggaagagccaagaggcatctcagatttgtcaacattgctttaatgagctgaggaacttctcatggtaaactcagcagctgagtaacaggatgatggcaccacaacaggtagataatcaaggcaggaggtcaaagcactggagccaacacccgcccaggatggggtataaaagggttgggaggagaggaggcttcagtctcagtggctcagccttcccagctgatctgaagctcctgtgcagcctcagccctacaccatgacctccttctacagcacctcctcatgccctctgggttgcaccatggctcctggagcaagaaatgtctttgtctctcctatcgatgttgggtgccagcctgtggcagaggccaatgctgcctccatgtgcctcttggccaacgtggcacacgccaacagagtccgtgtggggtcgactcccctgggccgccccagcctctgtctgcccccaaccagtcacactgcttgtcccttgccagggacctgtcacattcccggcaacatcggaatctgtggggcctacggcaaaaacaccctgaatggccatgagaaggagaccatgaagttcctgaatgaccgcctggccaactacctggagaaggtgcgccagctggagcaggagaatgcagagctggagaccacactcctcgagaggagcaagtgccacgagtccaccgtgtgccccgactaccagtcctacttccgtacaatcgaggagctccagcagaagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccaggtgagtgggggttacagagccagggagtacctggcctccatctgagcagggaggtgactgtgtttctctgtgctccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttactcccctgcaatccctgttccacgcctgcctcctgtacttcttgtccaagctgtggccctgtcaccggtgggtctccctctggccatggagccagcatggggagatgattctgaaggcccgagttaggagattgaggctggttgcactggggtcaggagtgccctcaccttgcccagtcttccttcaagactagactcactgaggcattttccctaaatcaaccggtagcagatacttccaaggagtggctccctgcctatgcctctaagctgtattttttgttgttgctaaaatgttgtaattatcttccatgaaagcaattatttttcctggtgtctcttcttggtacttttagttctattccagtgtttcagaatctccaaaaatgtaactgggttccctgcattaaatggtcaataaacctccttcctgcaccaagtgctgtctccccggtgttggttgtatgtgagatgtcggagagtcctggtcgtcaggtcctgtgtcctcactggctctgacatcttgcttccaggag

SEQ ID NO: 728633 - DNA, 2180 bp, Homo sapiens
tttctcatctgtacattgaggcaatgagtaaccacctcataggtggtaagggttagataggaaagaacacagtagaatgcctagcacacctaagtactcaatcaatgttagttctggacctttcatttgaatactgcttgagctctgtgcccaatctccctttcctggatcaaataagatttttctttgttagtgatttctttctagatacttccttggccagaactatagatcctctgtctttcactaactcttgttgatctatggttctcattcaagtttgtgtagaacatccagagatttcagaggcattgtttactcctgatgaacagggaacattgcgtgtccaggaaccagcacactgcctgagttatgggggatattcaggaagcatgctgaaccaatgaatgaatgaacaaatgaatgaatagctgattctgactagtcaaccaaaacttaattagcgccattgcttccagatgttattgcttctcaagggagtatgcaatgtgaaagaagaaagaaaaaaaggcgcctctcaatcgtcaaatatcagtagatgcattggttttattaactgatattttctcttcaaaggaaaggctgattcagtcttgcacaggcgaaagatccagtgggtcccattggttctctgtgtctcctgctacacaaattactgacggaaagatttgagccttcattgtgaccacatccacagagaccatagtccagagagagcaattggggcctgaatcaactgctggtgtttgttgagcagaaacagtgagtctctgacttcccaccaacagctaacctgatatggaagagccaagaggcatctcagatttgtcaacattgctttaatgagctgaggaacttctcatggtaaactcagcagctgagtaacaggatgatggcaccacaacaggtagataatcaaggcaggaggtcaaagcactggagccaacacccgcccaggatggggtataaaagggttgggaggagaggaggcttcagtctcagtggctcagccttcccagctgatctgaagctcctgtgcagcctcagccctacaccatgacctccttctacagcacctcctcatgccctctgggttgcaccatggctcctggagcaagaaatgtctttgtctctcctatcgatgttgggtgccagcctgtggcagaggccaatgctgcctccatgtgcctcttggccaacgtggcacacgccaacagagtccgtgtggggtcgactcccctgggccgccccagcctctgtctgcccccaaccagtcacactgcttgtcccttgccagggacctgtcacattcccggcaacatcggaatctgtggggcctacggcaaaaacaccctgaatggccatgagaaggagaccatgaagttcctgaatgaccgcctggccaactacctggagaaggtgcgccagctggagcaggagaatgcagagctggagaccacactcctcgagaggagcaagtgccacgagtccaccgtgtgccccgactaccagtcctacttccgtacaatcgaggagctccagcagaagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccagtctgaaggcatcagcctgcaggccatgtcctgctccgaggagctgcagtgctgccagtcggagatcctggagctgagatgcacggtgaatgccctggaggtggagcgccaagcccagcacaccttggtacgtgtccttcaccctcactgcactgcaaatgccccatgccatgtcctggtagtagcatctcttaaagtctcacaaatcag

SEQ ID NO: 728634 - DNA, 2340 bp, Homo sapiens
tttctcatctgtacattgaggcaatgagtaaccacctcataggtggtaagggttagataggaaagaacacagtagaatgcctagcacacctaagtactcaatcaatgttagttctggacctttcatttgaatactgcttgagctctgtgcccaatctccctttcctggatcaaataagatttttctttgttagtgatttctttctagatacttccttggccagaactatagatcctctgtctttcactaactcttgttgatctatggttctcattcaagtttgtgtagaacatccagagatttcagaggcattgtttactcctgatgaacagggaacattgcgtgtccaggaaccagcacactgcctgagttatgggggatattcaggaagcatgctgaaccaatgaatgaatgaacaaatgaatgaatagctgattctgactagtcaaccaaaacttaattagcgccattgcttccagatgttattgcttctcaagggagtatgcaatgtgaaagaagaaagaaaaaaaggcgcctctcaatcgtcaaatatcagtagatgcattggttttattaactgatattttctcttcaaaggaaaggctgattcagtcttgcacaggcgaaagatccagtgggtcccattggttctctgtgtctcctgctacacaaattactgacggaaagatttgagccttcattgtgaccacatccacagagaccatagtccagagagagcaattggggcctgaatcaactgctggtgtttgttgagcagaaacagtgagtctctgacttcccaccaacagctaacctgatatggaagagccaagaggcatctcagatttgtcaacattgctttaatgagctgaggaacttctcatggtaaactcagcagctgagtaacaggatgatggcaccacaacaggtagataatcaaggcaggaggtcaaagcactggagccaacacccgcccaggatggggtataaaagggttgggaggagaggaggcttcagtctcagtggctcagccttcccagctgatctgaagctcctgtgcagcctcagccctacaccatgacctccttctacagcacctcctcatgccctctgggttgcaccatggctcctggagcaagaaatgtctttgtctctcctatcgatgttgggtgccagcctgtggcagaggccaatgctgcctccatgtgcctcttggccaacgtggcacacgccaacagagtccgtgtggggtcgactcccctgggccgccccagcctctgtctgcccccaaccagtcacactgcttgtcccttgccagggacctgtcacattcccggcaacatcggaatctgtggggcctacggcaaaaacaccctgaatggccatgagaaggagaccatgaagttcctgaatgaccgcctggccaactacctggagaaggtgcgccagctggagcaggagaatgcagagctggagaccacactcctcgagaggagcaagtgccacgagtccaccgtgtgccccgactaccagtcctacttccgtacaatcgaggagctccagcagaagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttctggagagcgaggactgcaagtacgtgtgatctgggcaattc

SEQ ID NO: 728635 - DNA, 932 bp, Homo sapiens
gacaggggatacccggcgactcctacttccgtacaatcgaggagctccagcagaaggtgaggtgtgggatcgcctgggcatgctgggtctgagaaggcagaagccttcgcaggaggaatctgcataaggtccagagagctttgggttcttggtttctcttggacatgagcgtaaataccacacatggagtgggagcttagagtatggtgctttgtgtgtgaaccgtctttccgttttcctcagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccaggtgagtgggggttacagagccagggagtacctggcctccatctgagcagggaggtgactgtgtttctctgtgctccagtctgaaggcatcagcctgcaggccatgtcctgctccgaggagctgcagtgctgccagtcggagatcctggagctgagatgcacggtgaatgccctggaggtggagcgccaagcccagcacaccttggtacgtgtccttcaccctcactgcactgcaaatgccccatgccatgtcctggtagtagcatctcttaaagtctcacaaatcag

SEQ ID NO: 728636 - DNA, 1092 bp, Homo sapiens
gacaggggatacccggcgactcctacttccgtacaatcgaggagctccagcagaaggtgaggtgtgggatcgcctgggcatgctgggtctgagaaggcagaagccttcgcaggaggaatctgcataaggtccagagagctttgggttcttggtttctcttggacatgagcgtaaataccacacatggagtgggagcttagagtatggtgctttgtgtgtgaaccgtctttccgttttcctcagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccaggtgagtgggggttacagagccagggagtacctggcctccatctgagcagggaggtgactgtgtttctctgtgctccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttctggagagcgaggactgcaagtacgtgtgatctgggcaattc

SEQ ID NO: 728637 - DNA, 1587 bp, Homo sapiens
gacaggggatacccggcgactcctacttccgtacaatcgaggagctccagcagaaggtgaggtgtgggatcgcctgggcatgctgggtctgagaaggcagaagccttcgcaggaggaatctgcataaggtccagagagctttgggttcttggtttctcttggacatgagcgtaaataccacacatggagtgggagcttagagtatggtgctttgtgtgtgaaccgtctttccgttttcctcagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccaggtgagtgggggttacagagccagggagtacctggcctccatctgagcagggaggtgactgtgtttctctgtgctccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttactcccctgcaatccctgttccacgcctgcctcctgtacttcttgtccaagctgtggccctgtcaccggtgggtctccctctggccatggagccagcatggggagatgattctgaaggcccgagttaggagattgaggctggttgcactggggtcaggagtgccctcaccttgcccagtcttccttcaagactagactcactgaggcattttccctaaatcaaccggtagcagatacttccaaggagtggctccctgcctatgcctctaagctgtattttttgttgttgctaaaatgttgtaattatcttccatgaaagcaattatttttcctggtgtctcttcttggtacttttagttctattccagtgtttcagaatctccaaaaatgtaactgggttccctgcattaaatggtcaataaacctccttcctgcaccaagtgctgtctccccggtgttggttgtatgtgagatgtcggagagtcctggtcgtcaggtcctgtgtcctcactggctctgacatcttgcttccaggag

SEQ ID NO: 728638 - DNA, 854 bp, Homo sapiens
gacaggggatacccggcgactcctacttccgtacaatcgaggagctccagcagaaggtgaggtgtgggatcgcctgggcatgctgggtctgagaaggcagaagccttcgcaggaggaatctgcataaggtccagagagctttgggttcttggtttctcttggacatgagcgtaaataccacacatggagtgggagcttagagtatggtgctttgtgtgtgaaccgtctttccgttttcctcagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccagtctgaaggcatcagcctgcaggccatgtcctgctccgaggagctgcagtgctgccagtcggagatcctggagctgagatgcacggtgaatgccctggaggtggagcgccaagcccagcacaccttggtacgtgtccttcaccctcactgcactgcaaatgccccatgccatgtcctggtagtagcatctcttaaagtctcacaaatcag

SEQ ID NO: 728639 - DNA, 1014 bp, Homo sapiens
gacaggggatacccggcgactcctacttccgtacaatcgaggagctccagcagaaggtgaggtgtgggatcgcctgggcatgctgggtctgagaaggcagaagccttcgcaggaggaatctgcataaggtccagagagctttgggttcttggtttctcttggacatgagcgtaaataccacacatggagtgggagcttagagtatggtgctttgtgtgtgaaccgtctttccgttttcctcagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttctggagagcgaggactgcaagtacgtgtgatctgggcaattc

SEQ ID NO: 728640 - DNA, 1509 bp, Homo sapiens
gacaggggatacccggcgactcctacttccgtacaatcgaggagctccagcagaaggtgaggtgtgggatcgcctgggcatgctgggtctgagaaggcagaagccttcgcaggaggaatctgcataaggtccagagagctttgggttcttggtttctcttggacatgagcgtaaataccacacatggagtgggagcttagagtatggtgctttgtgtgtgaaccgtctttccgttttcctcagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttactcccctgcaatccctgttccacgcctgcctcctgtacttcttgtccaagctgtggccctgtcaccggtgggtctccctctggccatggagccagcatggggagatgattctgaaggcccgagttaggagattgaggctggttgcactggggtcaggagtgccctcaccttgcccagtcttccttcaagactagactcactgaggcattttccctaaatcaaccggtagcagatacttccaaggagtggctccctgcctatgcctctaagctgtattttttgttgttgctaaaatgttgtaattatcttccatgaaagcaattatttttcctggtgtctcttcttggtacttttagttctattccagtgtttcagaatctccaaaaatgtaactgggttccctgcattaaatggtcaataaacctccttcctgcaccaagtgctgtctccccggtgttggttgtatgtgagatgtcggagagtcctggtcgtcaggtcctgtgtcctcactggctctgacatcttgcttccaggag

SEQ ID NO: 728641 - DNA, 224 bp, Homo sapiens
gacaggggatacccggcgactcctacttccgtacaatcgaggagctccagcagaagatcctgtgcagcaaggctgagaatgccaggctgattgtacaaattgacaacgcgaagctggctgctgatgactttaggatcaagtaagtcaggatgaggagggtcagtgtgacttctctcctgctgtatttccaagggcccgccccattactcagtctatattgtagg

SEQ ID NO: 728642 - DNA, 745 bp, Homo sapiens
gacaggggatacccggcgactcctacttccgtacaatcgaggagctccagcagaagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccaggtgagtgggggttacagagccagggagtacctggcctccatctgagcagggaggtgactgtgtttctctgtgctccagtctgaaggcatcagcctgcaggccatgtcctgctccgaggagctgcagtgctgccagtcggagatcctggagctgagatgcacggtgaatgccctggaggtggagcgccaagcccagcacaccttggtacgtgtccttcaccctcactgcactgcaaatgccccatgccatgtcctggtagtagcatctcttaaagtctcacaaatcag

SEQ ID NO: 728643 - DNA, 905 bp, Homo sapiens
gacaggggatacccggcgactcctacttccgtacaatcgaggagctccagcagaagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccaggtgagtgggggttacagagccagggagtacctggcctccatctgagcagggaggtgactgtgtttctctgtgctccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttctggagagcgaggactgcaagtacgtgtgatctgggcaattc

SEQ ID NO: 728644 - DNA, 1400 bp, Homo sapiens
gacaggggatacccggcgactcctacttccgtacaatcgaggagctccagcagaagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccaggtgagtgggggttacagagccagggagtacctggcctccatctgagcagggaggtgactgtgtttctctgtgctccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttactcccctgcaatccctgttccacgcctgcctcctgtacttcttgtccaagctgtggccctgtcaccggtgggtctccctctggccatggagccagcatggggagatgattctgaaggcccgagttaggagattgaggctggttgcactggggtcaggagtgccctcaccttgcccagtcttccttcaagactagactcactgaggcattttccctaaatcaaccggtagcagatacttccaaggagtggctccctgcctatgcctctaagctgtattttttgttgttgctaaaatgttgtaattatcttccatgaaagcaattatttttcctggtgtctcttcttggtacttttagttctattccagtgtttcagaatctccaaaaatgtaactgggttccctgcattaaatggtcaataaacctccttcctgcaccaagtgctgtctccccggtgttggttgtatgtgagatgtcggagagtcctggtcgtcaggtcctgtgtcctcactggctctgacatcttgcttccaggag

SEQ ID NO: 728645 - DNA, 667 bp, Homo sapiens
gacaggggatacccggcgactcctacttccgtacaatcgaggagctccagcagaagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccagtctgaaggcatcagcctgcaggccatgtcctgctccgaggagctgcagtgctgccagtcggagatcctggagctgagatgcacggtgaatgccctggaggtggagcgccaagcccagcacaccttggtacgtgtccttcaccctcactgcactgcaaatgccccatgccatgtcctggtagtagcatctcttaaagtctcacaaatcag

SEQ ID NO: 728646 - DNA, 827 bp, Homo sapiens
gacaggggatacccggcgactcctacttccgtacaatcgaggagctccagcagaagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttctggagagcgaggactgcaagtacgtgtgatctgggcaattc

SEQ ID NO: 728647 - DNA, 1322 bp, Homo sapiens
gacaggggatacccggcgactcctacttccgtacaatcgaggagctccagcagaagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttactcccctgcaatccctgttccacgcctgcctcctgtacttcttgtccaagctgtggccctgtcaccggtgggtctccctctggccatggagccagcatggggagatgattctgaaggcccgagttaggagattgaggctggttgcactggggtcaggagtgccctcaccttgcccagtcttccttcaagactagactcactgaggcattttccctaaatcaaccggtagcagatacttccaaggagtggctccctgcctatgcctctaagctgtattttttgttgttgctaaaatgttgtaattatcttccatgaaagcaattatttttcctggtgtctcttcttggtacttttagttctattccagtgtttcagaatctccaaaaatgtaactgggttccctgcattaaatggtcaataaacctccttcctgcaccaagtgctgtctccccggtgttggttgtatgtgagatgtcggagagtcctggtcgtcaggtcctgtgtcctcactggctctgacatcttgcttccaggag

SEQ ID NO: 728648 - DNA, 536 bp, Homo sapiens; identical to SEQ ID NO: 166391

SEQ ID NO: 728649 - DNA, 317 bp, Homo sapiens
tcagtgtactcttctgctttgtaggagtgagatgaccgggaggaagaggaggaggatctggacgtgcctctcgctctccggtgcttcttctgcttctttgatcctttataagttttctgttttctcagctgacctttccctcgagtggctggagtctcgggaattcactgattctctagatttacctcgctgaagatctctctccttatgttttttatgacgttcaatatcaaggcggagatcaacaggatcatctctgtattttccctcagccttgatattgaacgtcataaaaaaaaaaaagggcggccgctcgc

SEQ ID NO: 728650 - DNA, 759 bp, Homo sapiens
aagtgtcaccggtcacactttaattccagtctaaaattaaagtcttcagtctccacattccctactttccaaattcagctttcccgggaggtctggagcagctgcctctctggggagatgctggaggtctcggaatcacctcacgcggcctcagggcccagttggagccaccccaagtgacaccagcaggcagatgaccagagagcctgagcctccggccccgagtctgtgaagcctagccgctgggctggagaagccactgtgggcaccaccgtgggggaaacaggcccgttgccctggcctctttgccctgggccagcctttgtgaagtgggcccctcttctgggccccttgagtaggttccatggcattttctgaactcctggacctcgtgggtggcctgggcaggttccaggttctccagacgatggctctgatggtctccatcatgtggctgtgtacccagagcatgctggagaacttctcggccgccgtgcccagccaccgctgctgggcacccctcctggacaacagcacggctcaggccagcatcctagggagcttgagtcctgaggccctcctggctatttccatcccgccgggccccaacagaggccccaccagtgccgccgcttccgccagccacagtggcagctcttggaccccaatgccacggccaccagctggagcgaggccgacacggagccgtgtgtggatggctgggtctatgaccgcagcatcttcacctccacaatcgtg

SEQ ID NO: 728651 - DNA, 652 bp, Homo sapiens
gagaattcttgtgtatgaaataaaatacatacaaaaatgtatacacacgttctttcctttgcaatattttttttcaaaaatggtagcagaatgttttctgtttttttctctcgattttcccttcttttatttattcatttatttgtttgtttttttgagacagtctgactcttgtcacccaggctggagtgtagtggcacagtctcagctcactgaaaccgctgccttgaggtagggattcaagtgattctcctgcttcagccacccgagtagctgggatcacaggcgtgccccaccacacccagctaatttttgcattttttgtagagatgggtttttgctgtgttggccagattggtcttgaactcctggcctcaagtgatctgcccaccttggcctcctaaggtgctggggttccaggtgtccctggtgtactaacctaatgttttttatgcttgcaaattatattaattatcttatgaatcactgcaacagaaatgcctatgtaaattaaaatgtaaaactatttacattttctgagttcataaggctcagagtcttaacatttttccttggatttttataataatagtatacattgtaaaatttttgataattagtaaaactaaaagtgtgacattttcataggaaa

SEQ ID NO: 728652 - DNA, 446 bp, Homo sapiens
ctcaaccagaggagccgggggtaaggtaaagggctctcctggggccagggactggggcacgtggcagccagctggcctggaaggcaggggcctaagggctggtagtgggttcccccagccgcggaaatagctggaactttgcccccgactcaggctcctgggaaggacaagtgcccggggcccctgtccctggagaggatcttgaccaggcaggtgtttgtcccgccattaggcaaggttctgaaatccctgggtgcctggcccagtacgtgtgttgaggactggaaggactcagtagatgaggtcccctcctccgaggaaagagctagtaaatagacaaacaggcaaaacagaggctagaaaaatacaaattaagaccctgcatgtgggctggaagggttagggcgtgatgcatgactggagttctttgtgttttcattcatcca

SEQ ID NO: 728653 - DNA, 256 bp, Homo sapiens
tgagccatatatcccaatgagcagccaaaatcacaagaaaaataactttgactttgaaaacaaataagttagaaatgcagtgtttgcacttcgtggtttatgtttgctttggtggcctctcattcccacttagcctcagtctccagggcctgggctccaccaaggaagactccatctgctctctctatttgcacactgggaacttttttccccaaggtacaggatatgattcagggtttatggatgacctccctac

SEQ ID NO: 728654 - DNA, 495 bp, Homo sapiens
gtgagctctgtcgtctctaagcccaccatgggtttaatcattcatcatcaaatcatccctaggctttaaatagtgaggaaaaatcaaggtgcagttttataaataaattcactgaaaggtcacatattgcatttgtctaacccagactccacagaggtgcgacccaggagagaaaggaagaaggtctacattcctcgaaactcatccagcacaattcattgaccatactgaataaggacatggtgagtttgaactttgccctactacaaagacctcttacgtacaaaataatttcctcctgtattaaatgcatgggacaaagttttagttaatgcaaaatttagtttatatcatatttgctccctcatattctcacaaatctaaattgccatgctcttccacagaggcaagaaaaaagtaatgcctaactcgtgggctctaatcatggaggttatgggatagcaaatatgcaactcctaaaagacctaaccacct

SEQ ID NO: 728655 - DNA, 813 bp, Homo sapiens
ggttagatctagaggatcccgctccaccgacggggtggtggtggggataatgataggggtggggatggtagcagtgatgctggtagcgatgtggatactggtgtggccacggtggtggcagtagctgtggagatggcagtggttacaatagtggggtgatggtgagggctgtagtgatgacggtggcggcagtggcagtgatatggtgatgatggtcatgagagaaatggtgatgatgttgggtggaggaggtggtggtggcgattgtggagatggtgatgttagcaatggtggtcgtgattgtagcagtgatgtggctgctgctggtggcatatggagtaaatgactgctaacgaaatcattccaaacccgagagttcatggcttcatgaagagctgtcaaatttatttagatgaacaaacaatcataagaagttcaaagacaaaccattttcagccaacatggcctctcctgagaaaggtgagaaacttaaactaattcattttttcctttaagaaattaacaaggcctacaaggaatttcccctttgcataccccaacccatgatggttttaagttttcctctgctaatcttgagaagagtttctgtaacactataattaggacttgctcctacacagcaaccattccctgctcatggtgagcaaaattagacacccctccagacaatgtcattatcatggttaagttctgagtttggcaagggcataaaaacatttgaagaaaccacttctacatcacatccccccttactcccacccaatacttacatacttccagcgttcttgcaga

SEQ ID NO: 728656 - DNA, 1018 bp, Homo sapiens
gttatcctacaaaataaggaccttaaccgcagaaatacaaagttggtaactgcatgcaagcagtttggctctgtacaaggagggagtttgtaataatcaaagctaccctataatgcaacatgccacctggcgagacagcaccctgtcaagccgcatgactccttcatggagaaaagagggaggatcagaatatgagtggctgacacattttaggcactcaagcatttgctgatgtgatggtggtggtggggataatgataggggtggggatggtagcagtgatgctggtagcgatgtggatactggtgtggccacggtggtggcagtagctgtggagatggcagtggttacaatagtggggtgatggtgagggctgtagtgatgacggtggcggcagtggcagtgatatggtgatgatggtcatgagagaaatggtgatgatgttgggtggaggaggtggtggtggcgattgtggagatggtgatgttagcaatggtggtcgtgattgtagcagtgatgtggctgctgctggtggcatatggagtaaatgactgctaacgaaatcattccaaacccgagagttcatggcttcatgaagagctgtcaaatttatttagatgaacaaacaatcataagaagttcaaagacaaaccattttcagccaacatggcctctcctgagaaaggtgagaaacttaaactaattcattttttcctttaagaaattaacaaggcctacaaggaatttcccctttgcataccccaacccatgatggttttaagttttcctctgctaatcttgagaagagtttctgtaacactataattaggacttgctcctacacagcaaccattccctgctcatggtgagcaaaattagacacccctccagacaatgtcattatcatggttaagttctgagtttggcaagggcataaaaacatttgaagaaaccacttctacatcacatccccccttactcccacccaatacttacatacttccagcgttcttgcaga

SEQ ID NO: 728657 - DNA, 906 bp, Homo sapiens
gttatcctacaaaataaggaccttaaccgcagaaatacaaagttggtaactgcatgcaagcagtttggctctgtacaaggagggagtttgtaataatcaaagctaccctataatgcaacatgccacctggcgagacagcaccctgtcaagccgcatgactccttcatggagaaaagagggaggatcagaatatgagtggctgacacattttaggcactcaagcatttgctgatgtgatggtggtggtggggataatgataggggtggggatggtagcagtgatgctggtagcgatgtggatactggtgtggccacggtggtggcagtagctgtggagatggcagtggttacaatagtggggtgatggtgagggctgtagtgatgacggtggcggcagtggcagtgatatggtgatgatggtcatgagagaaatggtgatgatgttgggtggaggaggtggtggtggcgattgtggagatggtgatgttagcaatggtggtcgtgattgtagcagtgatgtggctgctgctggtggcatatggagtaaatgactgctaacgaaatcattccaaacccgagagttcatggcttcatgaagagctgtcaaatttatttagatgaacaaacaatcataagaagttcaaagacaaaccattttcagccaacatggcctctcctgagaaaggtgagaaacttaaactaattcattttttcctttaagaaattaacaaggcctacaaggaatttcccctttgcataccccaaccccgaacacggatatatccgtgttcggggttgagagggggctaaacaaatggaggaagggaaaggggtaaacagcgttgcccaaggggagacctcagaggctctgacttgctgaagaaactacccagtagtggagatatg

SEQ ID NO: 728658 - DNA, 701 bp, Homo sapiens
ggttagatctagaggatcccgctccaccgacggggtggtggtggggataatgataggggtggggatggtagcagtgatgctggtagcgatgtggatactggtgtggccacggtggtggcagtagctgtggagatggcagtggttacaatagtggggtgatggtgagggctgtagtgatgacggtggcggcagtggcagtgatatggtgatgatggtcatgagagaaatggtgatgatgttgggtggaggaggtggtggtggcgattgtggagatggtgatgttagcaatggtggtcgtgattgtagcagtgatgtggctgctgctggtggcatatggagtaaatgactgctaacgaaatcattccaaacccgagagttcatggcttcatgaagagctgtcaaatttatttagatgaacaaacaatcataagaagttcaaagacaaaccattttcagccaacatggcctctcctgagaaaggtgagaaacttaaactaattcattttttcctttaagaaattaacaaggcctacaaggaatttcccctttgcataccccaaccccgaacacggatatatccgtgttcggggttgagagggggctaaacaaatggaggaagggaaaggggtaaacagcgttgcccaaggggagacctcagaggctctgacttgctgaagaaactacccagtagtggagatatg

SEQ ID NO: 728659 - DNA, 1055 bp, Homo sapiens; identical to SEQ ID NO: 176348

SEQ ID NO: 728660 - DNA, 301 bp, Homo sapiens; identical to SEQ ID NO: 176349

SEQ ID NO: 728661 - DNA, 377 bp, Homo sapiens
agcgaggttgcctggagagagcgcctgggcgcagaagggttaacgggccaccgggggctcgcagagcaggagggtgctctcggacggtgtgtcccccactgcactcctgaacttggaggacagggtcgccgcgagggacgcagagagcaccctccacgcccagatgcctgcgtagtttttgtgaccagtccgctcctgcctccccctggggcagtagagggggagcgatggagaactggactggcaggccctggctgtatctgctgctgcttctgtccctccctcagctctgcttggatcaggaggtgagttctggacaagtgagcagctgcagcctgcctgccaccctttcatctccccctaggctcccaccccat

SEQ ID NO: 728662 - DNA, 979 bp, Homo sapiens
tggaagtgagggaaaggggaccactgggaggggcaggggaagtgatgagtaacttctgctttctgagaagttggtagtcaggatatgggagccggctgggggcggagggcagtgttgcaacaccccctctggctccagtctgacgtccctcccctggcctttggtttgcaggccctggctgtatctgctgctgcttctgtccctccctcagctctgcttggatcaggaggtgttgtccggacactctcttcagacacctacagaggagggccagggccccgaaggtgtctggggaccttgggtccagtgggcctcttgctcccagccctgcggggtgggggtgcagcgcaggagccggacatgtcagctccctacagtgcagctccacccgagtctgcccctccctccccggcccccaagacatccagaagccctcctcccccggggccagggtcccagaccccagacttctccagaaaccctccccttgtacaggacacagtctcggggaaggggtggcccacttcgaggtcccgcttcccacctagggagagaggagacccaggagattcgagcggccaggaggtcccggcttcgagaccccatcaagccaggaatgttcggttatgggagagtgccctttgcattgccactgcaccggaaccgcaggcaccctcggagcccacccagatctgagctgtccctgatctcttctagaggggaagagcctattccgtcccctactccaagagcagagccattctccgcaaacggcagcccccaaactgagctccctcccacagaactgtctgtccacaccccatccccccaagcagaacctctaagccctgaaactgctcagacagaggtggcccccagaaccaggcctgccccctacggcatcaccccagagcccaggcctctggcacagagcccccctcacccacgcactccttaggagaaggtggcttcttccgtg

SEQ ID NO: 728663 - DNA, 656 bp, Homo sapiens
atgaagagctttttgctgttcagctgagtttaacttgaattactttttttaatgaaaggtaaaatagcacaaaattagcagcaaaaagatgttcattaacaagaagcacagtggcttggtgttcagttaaattgaattttcaaccatgttttcgacccgcaaaggcatccttccctgtctttttagtaatgaaagggtttcttctcttccaccgctgcagtcaggagcagcagagctaacatggttgtcttacagacgtttaatgtactgtggtcataattaaactaaaggattcttaggggagaattggccctcagttgaattttcctcttccctaatgtgtgtggaatgaacaagatgattgggaaatagctattttcacacttactacgttacaagatgctctattgctgatctcaggaacaagcttcactgcccaccagtcaattttacagaatgttcttgctaggacagcagtacctcttagctcctcatagccttaaaatctcttcttactttccctagaaaaaagaaagctggctgtgcacagtggctcacatctgtaatcctagcactttgggaggccgaggcgggtggatcatgaggtcaggaattcaagaccagcctggccaagagagtgaaaccccatcgctact

SEQ ID NO: 728664 - DNA, 481 bp, Homo sapiens
gacagagaagaaagccctggaattctagcttcaaatagctaataagcaccatttctttttcttcataaggtgtgctaccagaggggaatctgaataagcagcattcatttttaaccaggagcttcctctgcagttgaaattctgccttgctgctgcagacgcctctgtatgcatgacttgaggcttctgcctctcgagcttgtagctttcagaagcaataagtgaaggcagggaacgtttttatctagcacagggcttaaccctgttttccagccaatatcaggaaatgtccttgttttaatagggcccaagataatcactataaaaattataaaagtcactttttaatctctgaataatctcaagaaggaaagagagaagacagcatgagacctcctagtaaaacaggtgccccctcgaagtctggaggaggttgtgtttagaataaatcaaagcaagcagttgtacagcaggcagcctc

SEQ ID NO: 728665 - DNA, 306 bp, Homo sapiens
gggcacctgtcttcagcctttaatgatctagggcagccattctctctgaaggctgagggagcctggaggggcaggagaggcaaggcaggtccctgtggtcagagagcgccttctggatacagccacggtttgctttcattatgcaaggcacagaggaatgtgatgctagacacagcactaccgccgagacaggagcgagacagtgctgtgggatgcccagggttaaaaaaagttgccgcggtggctcacgcctgtaatcccagcactttgagaggccgaggtgggcagatcacctgaggtcaggag

SEQ ID NO: 728666 - DNA, 768 bp, Homo sapiens
agcggacagggcggggacatgaccgcggcgccgggagggtcagcgcagcccgctggccccggcccgcgcctgggtttcagcaccgcggacagcggcgtcggcatgagctgggctaaaccccggtcccgccgtacccatgaaggaccacgacgccatcaagctcttcgtggggcagatcccgcggggcttggacgagcaggacctcaagccgctgttcgaggagttcggccgcatctacgagctgacggtgctgaaggaccggctcaccggcctccacaaaggctgtgccttcctcacctactgcgcccgggactctgctctcaaggcccagagtgcactgcacgagcagaagaccctgccagggatgaatcgtccgatccaagtgaagccagctgccagtgagggccgaggagaggaccgaaagctgtttgtggggatgctgggcaagcagcagggtgaggaggacgtcagacgcctgttccagccctttggccacatcgaggagtgcacggtcctgcggagtcctgacggcaccagtaaaggctgtgcctttgtgaagttcgggagtcaaggggaagctcaggcggccatccggggtctgcacggcagccggaccatggcgggcgcctcgtccagcctcgtggtcaagctggcggacaccgaccgggagcgcgcgctgcggcggatgcagcagatggccggacacctgggacgccttccaccccgcgccactgccgctaggggcctgcggcgcctacaccacggcgg

SEQ ID NO: 728667 - DNA, 661 bp, Homo sapiens
ccacgcgtcgcggacgcgtgggtcgacccacgcgtccggggaaggccgctgtttttccctcctggcactcagctgcctgccccccaacaataattcctcacctcccacgcacccagctcttggcagtttacaaagaccttttgcgtccccattacctcatgtgatccccacaacacccatgagaggaagatgaatcgtccgatccaagtgaagccagctgccagtgagggccgaggaggctcctgaacaggatgatctcagatcccccctcaaacaacagctggaactctgttctctatcttctagaggaccgaaagctgtttgtggggatgctgggcaagcagcagggtgaggaggacgtcagacgcctgttccagccctttggccacatcgaggagtgcacggtcctgcggagtcctgacggcaccagtaaaggctgtgcctttgtgaagttcgggagtcaaggggaagctcaggcggccatccggggtctgcacggcagccggaccatggcgggcgcctcgtccagcctcgtggtcaagctggcggacaccgaccgggagcgcgcgctgcggcggatgcagcagatggccggacacctgggacgccttccaccccgcgccactgccgctaggggcctgcggcgcctacaccacggcgg

SEQ ID NO: 728668 - DNA, 836 bp, Homo sapiens
agcggacagggcggggacatgaccgcggcgccgggagggtcagcgcagcccgctggccccggcccgcgcctgggtttcagcaccgcggacagcggcgtcggcatgagctgggctaaaccccggtcccgccgtacccatgaaggaccacgacgccatcaagctcttcgtggggcagatcccgcggggcttggacgagcaggacctcaagccgctgttcgaggagttcggccgcatctacgagctgacggtgctgaaggaccggctcaccggcctccacaaaggctgtgccttcctcacctactgcgcccgggactctgctctcaaggcccagagtgcactgcacgagcagaagaccctgccagggatgaatcgtccgatccaagtgaagccagctgccagtgagggccgaggaggctcctgaacaggatgatctcagatcccccctcaaacaacagctggaactctgttctctatcttctagaggaccgaaagctgtttgtggggatgctgggcaagcagcagggtgaggaggacgtcagacgcctgttccagccctttggccacatcgaggagtgcacggtcctgcggagtcctgacggcaccagtaaaggctgtgcctttgtgaagttcgggagtcaaggggaagctcaggcggccatccggggtctgcacggcagccggaccatggcgggcgcctcgtccagcctcgtggtcaagctggcggacaccgaccgggagcgcgcgctgcggcggatgcagcagatggccggacacctgggacgccttccaccccgcgccactgccgctaggggcctgcggcgcctacaccacggcgg

SEQ ID NO: 728669 - DNA, 593 bp, Homo sapiens
ccacgcgtcgcggacgcgtgggtcgacccacgcgtccggggaaggccgctgtttttccctcctggcactcagctgcctgccccccaacaataattcctcacctcccacgcacccagctcttggcagtttacaaagaccttttgcgtccccattacctcatgtgatccccacaacacccatgagaggaagatgaatcgtccgatccaagtgaagccagctgccagtgagggccgaggagaggaccgaaagctgtttgtggggatgctgggcaagcagcagggtgaggaggacgtcagacgcctgttccagccctttggccacatcgaggagtgcacggtcctgcggagtcctgacggcaccagtaaaggctgtgcctttgtgaagttcgggagtcaaggggaagctcaggcggccatccggggtctgcacggcagccggaccatggcgggcgcctcgtccagcctcgtggtcaagctggcggacaccgaccgggagcgcgcgctgcggcggatgcagcagatggccggacacctgggacgccttccaccccgcgccactgccgctaggggcctgcggcgcctacaccacggcgg

SEQ ID NO: 728670 - DNA, 761 bp, Homo sapiens
tgtgggtttccttcttgagggattgtggggtatctatgagttctctaatggaaacatttattttatgttttcctttagatgagagtcaaaaagcatgctagggatcacctgcttgctgctgccttataaccatgtatgtcggacttcaggcctgctggagtgtctttgctacagtcgtgagagacttgggggaagagaccacatccaggaaccatgaatatgtaatgatggatttgtgccacaggagggtggttcttggagccatcacccacacagggtcacgaaggtggctgaactgggaagaacctgcaccagggaagtcagcccgatagtcatactgtgaatagaactttagtttcagtgaagcatccacttgtcacattaagttaatgtgattcacttaaatggttattgtttgggggtaaatttgatttgtaaactttgggggaaggctgtaaaattatctaataagctatagctcaaatatattttaaaaccctcagtggcttctcattaccctttagaacagagtctaagccacttagtaggccaaaaagaccatacattatctgaccactgattagcttttcaagctcatcttctgtcggttcagttttttgttgttgttgttgcaggcatgaagacctctgtcctgttcctcacacaaaccaagtcaagcttgctcctgattcacagactttaacacttgctccctctgtcctccatcttcacagggctaactacttttgaagattcgtatc

SEQ ID NO: 728671 - DNA, 3022 bp, Homo sapiens
  misc_feature (1876)..(1876): n is a, c, g, or t
  misc_feature (2024)..(2024): n is a, c, g, or t
  misc_feature (2281)..(2281): n is a, c, g, or t
  misc_feature (2442)..(2442): n is a, c, g, or t
tagtcctcctgctacaccactgaccaacaggaaagtttgtgtctccagagtggacacatccataaagaggccaaacccagtcaaggtctaagcatctgatggctataactttgcttctttgaaagataataaaaagcttctgacctcccatcaacagccaacctgatttcaaagagccaagaggcctcagattcgtcaacattcctttaacgagctgagaaacttttcatggtaaactcagcagctgagtaacaggatgatggcaccacaacaggtagataatcaaggcaggaggtcaaagcattggagccaacacccgcccaggatggggtataaaagggctgggaggagaggaggcttcagtctcagtggttcagctttcccagctgatctgaagctcctgtgcagcctcagcccaacaccatgacctcttcctacagcagctcctcatgccctctgggttgcaccatggctcctggagcaagaaatgtctctgtctctcccatcgacattgggtgccagcctggggcagaggccaacattgcccccatgtgccttttggccaacgtggcacatgccaaccgagtccgtgtggggtccactcccctgggccgccccagcctctgtctgccgcctacctgccacactgcttgtcccttgccagggacctgccacattcctggcaacattggaatctgtggggcctatggtgaaaacaccctgaatggccatgagaaggagaccatgcagttcctgaatgaccgcctggccaactacctggagaaggtgcgccagctggagcaggagaatgcggagctggaggccacactcctcgagaggagcaagtgccacgagtccaccgtgtgccccgactaccagtcttacttccacaccatcgaggagctccaacagaaggtgaggtgtgggatcgcttgggtgtgctgggtctgagatggcagaggcaagacaggaggaatccatgtaaagctcagagaactttgggttcttggtttctcttggacatgatcatagacaccacacgtggagaaggagcctagggcatgatgctttgtgtgtgaactgtcttcctgttctcctcagatcctgtgcagcaaggccgagaatgccaggctgattgtacaaattgacaatgccaagctggctgccgatgactttaggatcaagctggagagtgagcgctccctgcgccagctggtggaggcagacaagtgtgggacacagaagctcctggatgatgcgaccctggccaaggccgacctggaggcccagcaggagtccctgaaggaggagcagctctccctcaagagcaaccacgagcaggaagtaaagattctgaggagtcagctgggggagaagctccggattgagctggacattgagcccaccattgacctgaacagggtgctgggggagatgcgggctcagtatgaggccatgttggagaccaaccgccaggatgtggaacagtggttccaagcccagtctgaaggcatcagcctgcaggacatgtcctgctccgaggagctgcagtgctgccagtcggagatcctggagctgagatgcacggtgaatgccctggaggtggagcgccaagcccagcacaccttgaaggactgtctgcagaactccctgtgtgaagccgaggaccgcttcggcacggagctggcccagatgcagagcctcatcagcaacgtggaggagcagctgtctgagatccgggccgacctggagcggcaaaaccaggagtaccaggtgctgctggacgtgaagacccggctggagaatgagattgccacgtaccggaaccttctggaaagcgaggactgcaaactcccctgcaatccgtgctccacgnctccctcctgcgtgactgccccctgtgctcctcgcccaagctgtggcccctgcaccacctgtgggcccacctgtggagccagcaccaccggaagccgattctgaattcctgtggacccacaggggctggctaaggcgagggatacccnaagagagatgcttgttatacctttagaaaatctggcttctaactttctgtatgtataggcctgtccaaaggctatgagataccagggacagtggaatcttgatggaaatccttcctttcctgctcttggttttcccaggtgagctctatgccctcagtggctggattgcagccacccatggtggctcagaatatctggattggagaggcataaggttgaaaagcattttggagtaggaacacggcatgatttaaaantgcacttgcacttcaagaacaccaactttaacttgaaatttttatagtttatgacaaaggaagtgaagaacagacttcactgtctgagatttcccacatttcttgggttgtttctaacattggcagcctggattatggccctagggagagggaaatagaancagaattgtacctgaccctgtcttttctaattcccttctcctatcctcctgcctccctatcttggaaactgattaagtggaaactttccttgtatcaaatcctgagttttctctacttcagggtttctagctttgacaaaggaccaggcttgccttttctgtggcaacacagcctcttacatatggcttccatagcttcttgctatgtgaaaggaactttcagattaagaaatttctctcttttttctctataaattctgactctccagacttgtctggctataacccctgtccctgtctaattctcccagtctaaaatctaaacaatgacttcatttttttctagtactttctcctgaagtattgaaacctattgattcaatgggtagagatttgctaagtatgatgtgcttccacctcttctcttcatactctctaccttccttaccatgattcagccacactggcctttctgttccttggacatgcctggagacctgtccctgctcttccttctctctggggtgctcttcccctccttataaatgttcaggtcagcggaaatgttccttcctctgag

SEQ ID NO: 728672 - DNA, 2836 bp, Homo sapiens
  misc_feature (1690)..(1690): n is a, c, g, or t
  misc_feature (1838)..(1838): n is a, c, g, or t
  misc_feature (2095)..(2095): n is a, c, g, or t
  misc_feature (2256)..(2256): n is a, c, g, or t
tagtcctcctgctacaccactgaccaacaggaaagtttgtgtctccagagtggacacatccataaagaggccaaacccagtcaaggtctaagcatctgatggctataactttgcttctttgaaagataataaaaagcttctgacctcccatcaacagccaacctgatttcaaagagccaagaggcctcagattcgtcaacattcctttaacgagctgagaaacttttcatggtaaactcagcagctgagtaacaggatgatggcaccacaacaggtagataatcaaggcaggaggtcaaagcattggagccaacacccgcccaggatggggtataaaagggctgggaggagaggaggcttcagtctcagtggttcagctttcccagctgatctgaagctcctgtgcagcctcagcccaacaccatgacctcttcctacagcagctcctcatgccctctgggttgcaccatggctcctggagcaagaaatgtctctgtctctcccatcgacattgggtgccagcctggggcagaggccaacattgcccccatgtgccttttggccaacgtggcacatgccaaccgagtccgtgtggggtccactcccctgggccgccccagcctctgtctgccgcctacctgccacactgcttgtcccttgccagggacctgccacattcctggcaacattggaatctgtggggcctatggtgaaaacaccctgaatggccatgagaaggagaccatgcagttcctgaatgaccgcctggccaactacctggagaaggtgcgccagctggagcaggagaatgcggagctggaggccacactcctcgagaggagcaagtgccacgagtccaccgtgtgccccgactaccagtcttacttccacaccatcgaggagctccaacagaagatcctgtgcagcaaggccgagaatgccaggctgattgtacaaattgacaatgccaagctggctgccgatgactttaggatcaagctggagagtgagcgctccctgcgccagctggtggaggcagacaagtgtgggacacagaagctcctggatgatgcgaccctggccaaggccgacctggaggcccagcaggagtccctgaaggaggagcagctctccctcaagagcaaccacgagcaggaagtaaagattctgaggagtcagctgggggagaagctccggattgagctggacattgagcccaccattgacctgaacagggtgctgggggagatgcgggctcagtatgaggccatgttggagaccaaccgccaggatgtggaacagtggttccaagcccagtctgaaggcatcagcctgcaggacatgtcctgctccgaggagctgcagtgctgccagtcggagatcctggagctgagatgcacggtgaatgccctggaggtggagcgccaagcccagcacaccttgaaggactgtctgcagaactccctgtgtgaagccgaggaccgcttcggcacggagctggcccagatgcagagcctcatcagcaacgtggaggagcagctgtctgagatccgggccgacctggagcggcaaaaccaggagtaccaggtgctgctggacgtgaagacccggctggagaatgagattgccacgtaccggaaccttctggaaagcgaggactgcaaactcccctgcaatccgtgctccacgnctccctcctgcgtgactgccccctgtgctcctcgcccaagctgtggcccctgcaccacctgtgggcccacctgtggagccagcaccaccggaagccgattctgaattcctgtggacccacaggggctggctaaggcgagggatacccnaagagagatgcttgttatacctttagaaaatctggcttctaactttctgtatgtataggcctgtccaaaggctatgagataccagggacagtggaatcttgatggaaatccttcctttcctgctcttggttttcccaggtgagctctatgccctcagtggctggattgcagccacccatggtggctcagaatatctggattggagaggcataaggttgaaaagcattttggagtaggaacacggcatgatttaaaantgcacttgcacttcaagaacaccaactttaacttgaaatttttatagtttatgacaaaggaagtgaagaacagacttcactgtctgagatttcccacatttcttgggttgtttctaacattggcagcctggattatggccctagggagagggaaatagaancagaattgtacctgaccctgtcttttctaattcccttctcctatcctcctgcctccctatcttggaaactgattaagtggaaactttccttgtatcaaatcctgagttttctctacttcagggtttctagctttgacaaaggaccaggcttgccttttctgtggcaacacagcctcttacatatggcttccatagcttcttgctatgtgaaaggaactttcagattaagaaatttctctcttttttctctataaattctgactctccagacttgtctggctataacccctgtccctgtctaattctcccagtctaaaatctaaacaatgacttcatttttttctagtactttctcctgaagtattgaaacctattgattcaatgggtagagatttgctaagtatgatgtgcttccacctcttctcttcatactctctaccttccttaccatgattcagccacactggcctttctgttccttggacatgcctggagacctgtccctgctcttccttctctctggggtgctcttcccctccttataaatgttcaggtcagcggaaatgttccttcctctgag

SEQ ID NO: 728673 - DNA, 888 bp, Homo sapiens
atcactggattggtgtaaggcttacataaacttaaaccacttttacacttaagcactttatatgtggttgagctttacaccaacattagcttcctgttgtttatcttgcctacaaagtatctgtaatataatagttcatcacaatagtctatatgacaaaaacaggaggttagaacatcccctcacctaaaagaggttacaatcttggtcaaaaagtattaactttgacatgttacatgtttaaccttttttcttaaaataactttgataagaaaattatagttgtatgctataagggtacacacagttagagtggccagttttgcacattggattatacttctctacctaaaatctaatattttaaaactatgatcattaaattgctgactttgagggagacgaacagtatatacttttaagtactaatcagacaagatcataaataatgtgcctttataggggaagaaagattaataattaaaaaattccataaataaagattgctagtctgtattaatccaaattttttctgttcttaaatctctttgcctgaattctgtatctctcctcccctacccccaaagcataacctttattctctggagacaaattgtgactgcacaggttggctctgcacacatatgccagctggcaaatgttacttaatgacttattatctaactattggaagccaaagactagaaaacctacaatcccttctgctaaatatgtgctggcaaggtcccagttaagaaaagtctagttttatgccagttacttttatcttactttcatataagaatttgtgacaaaaacaaagcactactatcatttgctatgggttgctctgatcatgtcaatagtctcatattcccagtcttaaca

SEQ ID NO: 728674 - DNA, 413 bp, Homo sapiens
acagacagcgaggctctcaggtcaccggcaccagtggcaccacccacagggactgcagggaagggcgggcaggctcccgttcgttctcccagcacccagtttccagacgaagcctccctgggatcctggcttcccacggctctgcactgtccctttctcagaacttaacgtgggcatttcctgagtcctcttcctccggatgagctggtttcggcctgggatcccagcgtccccacaccctctggtgaccaccacatggcccagcagccacacagcacccggcacccacctgggcgtctgaggctggaggaagctctgccctttctttcgagtcatgggggtggggcggtgtgcgtcactttgggcccatggatggtgggtgccatgcggccacgtcagagcagggcatggtg

SEQ ID NO: 728675 - DNA, 565 bp, Homo sapiens
ttctctgatgactggtgatgctgagcttttcttcatatacgtgtaggccatgtgtatgtcttcttttaaaaaaagtctattcatgtctttgcccaccttttaatgggatcttcttgtttttgctgttgttgaagtgtctgaattccttgtatattctggatatcagttccctatcagataaatagtttgcaaacattttctctcattctacaggctgtctcttcaatctcctgctgatttcttttgctctgctgaagctttttggtttcgataaggcccatttgtctatttctgttttagttgcctgtgtttttgaggtcttagtcactgattctttgcctatatcaatgtccagaagagttttccctaggttttattctagtatttttatagtttcaggtcttaacgtttaagtctttaatccatcttgagttgattttttgtatatggtgagagactggggtccaatttcattcttatgcacagggcaatccaatttttccagcaccatttctttaagagggtatcctttctctgatgtatgttgttggtagcgttgtcaaag

SEQ ID NO: 728676 - DNA, 642 bp, Homo sapiens
tttttgagaaaatgacaagctgattataatatttatatgaaattgtaagcaatggaaactagcaaaacaattttgaaaaagaacaaagttggaggacttcgtatcttaggtcaagacttattacaaagctacagtaatcaaggctatggtcatgacaaaatatatgcaatgacagaatgcatagatcagtggactgggatagatagagcaaaaatagatccacacatatctagtcaattcagcagcaaatactggaactggatattcatatgcaaaaaaaatgaagttcaacccatatgtctcatcacacacaaaaattaactcaaagtggatcattgacctaaacgtagacctaaagctataaaacttctgaaggaaacctaggagaaaatctttgtgactgtgacataggcaaagatttcttagataagatgattcataggataaaaagttgatgaactgggcttcatcaaaacaaaaacttatttgttcaaaaccttctttgaaaaatactgtggagaaaatgaaatgacagggcacagactgggagaaaatatttgaaaaaattaaaatctgataaaggatttgtttacagaatatataaagaactgtcattagtcactaagaaaaaacccaaacaac

SEQ ID NO: 728677 - DNA, 766 bp, Homo sapiens
tagaggaccccggttcgccatgtagcatggatacatatgcattctagggttagcatcaaaggctggagggagtcaggaggcaaaacatatgctgaaccgataagggatctagaactgtttatcccaaagaaaagaaaatgaggccacataaatatcttctaatatttggggtacttttatatgaacatgggagaaggcatttgtgtttctcaaggcagcagaacagaattgaatatataaattcatagaatttttaagctgggcaagaccttaggagctcattcggcccaaggagtacatataacttttcatctgtatgccagctccaaccaattggcatgttaagaaggattctgaggatgaatctaagctcagaggggaggggaaaatgtggtcactgatagtgatatctgttgtggaagagaagggccatatctactcaagtaccatgttttagtcttcattaatgtggtctgtaggtttttaacctctgggtggtggatccctgggaggccacaaagtcattgcaagaggtaaacaaatctgtatatgcagcaagtgcttttggcaagctactctgagtaaataatatatcttacatcatatgtgctactatttttctaattctatacatacattataatgataaaatgctaatttatttaaaagagttattgaattcatagtagcttttaagtttgtgtttttgtgttttattaatgagtggacttaaaacatataattatattatgtgtgggaaggttgg

SEQ ID NO: 728678 - DNA, 515 bp, Homo sapiens
taaatccatactaacataggtacagtgacctaaagccctgggagctgcaccccacgtcccgtgtgacaaagtgtgtgcaggcatcactgaagggggaaaaggctgtgtgtgtgtgtgtgtgtgtgtgtgtttgtgtgtgtgcgcgcgcaccagcgccatgtggcttcccgggtggtgcagattctgtctctctctcaaacctcagcttcatgattcagcagcgctgacgtcaatttacaagaatgaaaagtgagaggagggtttgtgtgtgcaagagactgagttgggggcccaggtgcagtggaggtgtcctccccactgagcgggtgagccagggcagtgtggggcgggcaccatgggaaaggaggcactctttggaatgacaaggactgtgtgtgggtgtggggacagcctgtgaccagcctccaagccacccttgagctgaaaactctggcccccgttttccagatgaggaaatggaggctcagacaagtgcaaccacctactcaaggtca

SEQ ID NO: 728679 - DNA, 315 bp, Homo sapiens
ggaagatcttccaatgagctgtgaactggtcttccgggaggacttacaggaggctggaaacggggcctggcgcgcgcttccctctcagtgcgaggctgactggttggactcgccgggctctactgtgggccccacgctatgtttagacgcccgacgtgtcccattttattgaactcgtcctgccccccaagtagggacgatttacctccattttctagataaggcactgggggctccgcgaggggatgtggcggactggagcccagctgcactcctgacgggactgaatgcggggctgagggaggcaacaggaag

SEQ ID NO: 728680 - DNA, 339 bp, Homo sapiens
tcatcgcaggcatacatgacttggcagatactcatggtgatacggtgaaccgtgcgtgagagaggacttacaggaggctggaaacggggcctggcgcgcgcttccctctcagtgcgaggctgactggttggactcgccgggctctactgtgggccccacgctatgtttagacgcccgacgtgtcccattttattgaactcgtcctgccccccaagtagggacgatttacctccattttctagataaggcactgggggctccgcgaggggatgtggcggactggagcccagctgcactcctgacgggactgaatgcggggctgagggaggcaacaggaag

SEQ ID NO: 728681 - DNA, 383 bp, Homo sapiens; identical to SEQ ID NO: 428525
  misc_feature (375)..(375): n is a, c, g, or t

SEQ ID NO: 728682 - DNA, 412 bp, Homo sapiens
ataagaaggcgagaggagcaggttctcatggggcagccaatgcaagggctggggccacctggagcctggtgtgtccttcgggcagctggtgtggctggagcaggggatgccaagcctgctgagggcttcatgggccgcagggaggagtttggtttttctcctgagggcactggggagccacagcagagtttagagcagaagaaggacacaatttgtgccctgtgttcgtggtgagcggcgagcagggagggctgcctggaggcgggtaaggacctcagagcggaattctgccacagtgaagctttggaggaaatctttcttccttttctcttcttttcccatcacgggttgagaaattggagggaggggcattgctggggcttcctgtgcccgcgtgtgcggggggtcctgg

SEQ ID NO: 728683 - DNA, 295 bp, Homo sapiens
taacgcgctgatagcctcctaacgcgctgatagcctcctaacgcgctgatagcctcctaacgcgctgatagcctcccaaagtgctgggattacgggcgtgagccaccacgcccggtaattttgccatcttttatcaggctttctgtgtcgaggacgctacccacatagagtagaagctgaagggaagggatgtgaagtgacctcaccctcagcttctagctcatggtgtcaaggcttgtgtgatcttagacacgtctgcctcttctgagcctgtttcttcatctgtaaaacaggg

SEQ ID NO: 728684 - DNA, 616 bp, Homo sapiens
tcctgggttcaagcgatcctccctcctcagcctcttgagtaactgggactacaggtgcacacctggatgattttaaaatatttttttagagatggcctctccctgtgttgcccaagctggtctcaaactcctgggctcaagagatcctcccacctcagcttcccaaagcattaggattacaggtgtgagccaccgtgcctggtctgaatttcttgctttacatgttagctgggaagtagatgccctcaagaatggtggagcatatgagctgtccctctaggtcagtcccatggccacccagctccagccctgtctctaggtgtgtgaatcccttttgcacaacagagagcctggggaggtggaaggtcttggtgacaccttgtgagttattcacactggctgtgggtgacagagccagaggtgggagcacagagctctcacagcacagaggagtaaggagttgaagctgcagaaacaatgctgaggcctgaggtggaggaaaaggggtacaaggggaagactaggaagaaacctgtggtacagaagcaggcaccaggcaaggcctcagtcagtaggacgcaggccagggaagacagtgaggagagcgacgcagaac

SEQ ID NO: 728685 - DNA, 217 bp, Homo sapiens
agatggagagagaatgaatgcagccagtgtgcaatgtgtcatgtcctctaaatgttcaagtccctcaagtcatagatccacctattttttctcaagttaatatctctacacctagttttaattccctgtcatgtatacaggactcacacattttatcttcaacttaggccttctctctccactcccccttctctctccaatcccggaccgagctgat

SEQ ID NO: 728686 - DNA, 550 bp, Homo sapiens
aatgaccccactaacaagctccttttataaaaccattttaatttagaaagcttattctatatttagcttaggctgaattcttcttttcacctccccttcctcaaaagaatgcacagaaaaaaatcattcaggttaataagagcagtgagctgagactccagcctggctctgcttagtaaaccgtgggtgtggatttagaaggcatactttctcctaaacccttctatgaacatgtacttccccgtccccttagttcagtaagtttaccactcaattactctctcaaactacctctttcaagcttaaaagagcactaatgcggttaaactgatgaataaagctcactttctaccggctttccatttgaccaagtctgtattacttaaaacaaaacaccctaactcctaaaagccatttcttcctttaaaccattttatcccacttgcgacgtccccgcagacacagacttggaattgcttacgtgtagtccgtgttattctttcctacatggatgggttgttttcagtttgcttgcagtatttctgacatt

SEQ ID NO: 728687 - DNA, 655 bp, Homo sapiens
ccacgggacagcacacagccccccacggaacggcacacacacccatggaacagcacacacactcccacgaacagcacacacactcccacgaacagcacacacactcccacggaacagcacacacacccacggaacggcacacacacccacggaacagcacacacactcccacggaacagcacacacacccacggaacggcacacactcccacggaacggcacactctcccacggaacagcacactctcccacggaacagcacacaacaatcccacggaacagcacacacacccacggtaatggcacacatctcccacgcggggccgctgggtttcctgcagtttctcctcctccaggcctttccctggaccctggtccagtccgtcatttgagcacaggtgcctgttagaacgagaccttcttgttaggacgatgagtgtcccagccaccacctcttttggactccgggaggcctggaacgttctgaacgctccgtggggctccagtcttctccgcagccagggcagcagggtttgctgtctgtcctgcaggcagatgaggagtcagggctggggcctgtgtgggggctctcctgagcgcacagccgccgaggtggagcgtgttctgcctgagcgccgacctggtcgggggaatc

SEQ ID NO: 728688 - DNA, 737 bp, Homo sapiens
ccacgggacagcacacagccccccacggaacggcacacacacccatggaacagcacacacactcccacgaacagcacacacactcccacgaacagcacacacactcccacggaacagcacacacacccacggaacggcacacacacccacggaacagcacacacactcccacggaacagcacacacacccacggaacggcacacactcccacggaacggcacactctcccacggaacagcacactctcccacggaacagcacacaacaatcccacggaacagcacacacacccacggtaatggcacacactcccacggaacagcagactctcccacggaacagcacacacactcccacagacagcacacacacacccacggaacagcacactctcccacgcggggccgctgggtttcctgcagtttctcctcctccaggcctttccctggaccctggtccagtccgtcatttgagcacaggtgcctgttagaacgagaccttcttgttaggacgatgagtgtcccagccaccacctcttttggactccgggaggcctggaacgttctgaacgctccgtggggctccagtcttctccgcagccagggcagcagggtttgctgtctgtcctgcaggcagatgaggagtcagggctggggcctgtgtgggggctctcctgagcgcacagccgccgaggtggagcgtgttctgcctgagcgccgacctggtcgggggaatc

SEQ ID NO: 728689 - DNA, 171 bp, Homo sapiens; identical to SEQ ID NO: 187408

SEQ ID NO: 728690 - DNA, 342 bp, Homo sapiens; identical to SEQ ID NO: 611333

SEQ ID NO: 728691 - DNA, 529 bp, Homo sapiens
atttgctgtatttgtacctggtcctttgctcaaatgcctgttttaaaaaaagtcctagacctataatcacacattagattttaaaatatgccctttcagctgtctaacctacatctacacagaattagtacgtgtattttttttttaagacagggtttgctctgttgcccaggatggagtacagtggcacaatcacagctcacttcagtctcaaccgcccaggctcaagcaatccccctgcctcagcctcccaaatagctgagactataagctacgcaagcattttgacaagatacaggagggttggcacagagatttaaagaagccaagttctaacacaggacagcacagagacaccaatacacgggacaaaatatacccaggctgggaggatgagctgccactgattggggatgtggtgtgtaacaaactgagtactaggggccgggcacagtggctcacgcctgtaatcccagcactttgagaggccaaggcaggggaatcacaaggtcaggagtttgtgaccatc

SEQ ID NO: 728692 - DNA, 375 bp, Homo sapiens
taatttttttatatttttagtagagacagggtttcaccatgttggccaggctggtgttgaactcctgacctcagatgatccacctgcctcagcctcccaaagtgctgggattataagctacgcaagcattttgacaagatacaggagggttggcacagagatttaaagaagccaagttctaacacaggacagcacagagacaccaatacacgggacaaaatatacccaggctgggaggatgagctgccactgattggggatgtggtgtgtaacaaactgagtactaggggccgggcacagtggctcacgcctgtaatcccagcactttgagaggccaaggcaggggaatcacaaggtcaggagtttgtgaccatc

SEQ ID NO: 728693 - DNA, 306 bp, Homo sapiens; identical to SEQ ID NO: 138542

SEQ ID NO: 728694 - DNA, 552 bp, Homo sapiens
ttgagattaagtaaataatgctgttggtcacgaatggaataatatattacctgttcttatgttgaaaagttatcaaaaataaactttcagcagcaaccacaatttacataaattcgaatacaaattaagacaaaaaattggggtaggctcatcctccattctcactttgtttatagtgagacctgtgatagtcacatttgaaattaatcttaaagtctttagttagagatagtttcctacctttaatcattgttactaaactgtttaaaaactgggagggaaaattgaaaagtctgccacactggacatttctttgtttcaaaaattgagtgttttataggcgtctgggtactctgggaggattccaagctgcttgtcatgttgatactctcaaacctgtacttgagtcagggagacagccataactacatacaataaaagcataaagggggaattagaactaggggagagtattgacaggtgggactcacctaattcaaggctaccagtaggtatttgtatgctgtgtacctttctagtctttttagtaac

SEQ ID NO: 728695 - DNA, 460 bp, Homo sapiens
tcgccgaataactacatcgaggctgcaggcgcttgggatggggcgacggtataacggggtccaacccccgaaagcggctgcctttccgccaggctatagcatttcggagatcaaaaccaagtgagctatgactgaaaggtaatttacagcaagtctatttaaaaaaaaaacaaacaaacagccaatgcattatcaattagagtcctgctgggccatattaacacagattccacttaaaagagacaatcaaaggctcagcaacgcataggaatacatttatgctcttcaaggagccaaagaaaatgcaagaacatcttccctagaaaggcttcctaccctcgcataatactttaccactgctcttaatcaaaccaggctgacagaatttcagacattagcagggtcttcccacaattcacagggatggggaaagccatgttacctgtcttaaacaaagcag

SEQ ID NO: 728696 - DNA, 658 bp, Homo sapiens
ggcgctcagaggaccccgcattactccatggctagattataatttcatatgggaaagaactactccttttatttctttggatctctgtcctctaagagtttagaacaaaacctctaaaatagtcaacaaatatgtgttgaggagagaaagaagctgggagaaacgctgaaaagatactgacagtgggttataaaatagcagaaggtctctgcaaggaacacagcaggacagaaatgtagaagtattgctctaaaaactcaacagaaaaaaaaaagctacctaaaaaatgagctattaaaagcaggagatcaaaaccaagtgagctatgactgaaaggtaatttacagcaagtctatttaaaaaaaaaacaaacaaacagccaatgcattatcaattagagtcctgctgggccatattaacacagattccacttaaaagagacaatcaaaggctcagcaacgcataggaatacatttatgctcttcaaggagccaaagaaaatgcaagaacatcttccctagaaaggcttcctaccctcgcataatactttaccactgctcttaatcaaaccaggctgacagaatttcagacattagcagggtcttcccacaattcacagggatggggaaagccatgttacctgtcttaaacaaagcag

SEQ ID NO: 728697 - DNA, 451 bp, Homo sapiens
tattttaaagttccagttcttttttccccctattaaactctagactccttaaggataagatccatatctgatttccaacatgtattgaaatctccacctctagagacatctgagatcagtccagccacagaatcagggacataagataactcagttggactctccaactctgactcttatttctttttcttgtcttattgcactggctaggacatccaatacaatgttagatgcaagtggtgataacagacatccttattttgtccctggctctaataggaacgcttccaatgctccacaggaaagtgtgatgtatgctataaatttctggtccctaccctttatcaaattagaaaactgcccctaccttctcctctacaacttaagctggaataaggcacaagggtgattggatcaaagtggaataaaccagggacttgagactgaggta

SEQ ID NO: 728698 - DNA, 438 bp, Homo sapiens
  misc_feature (72)..(72): n is a, c, g, or t
cctagggggaggtggtgatgttgggagtgggatctcctgagtccttgttgggcagaattggtgaggccaggnatggcagggaaaagtggtaacaagcctctctgcccatctacttccaatccctctctcccttactgattttttgatgccctgtcttctgggcccctaggagggatgagagaggagtagccccctttttcagagagtttggggtctacctcagagctctccctgtcaaaaagcagctgcaagcctcgcaagggtggagtggggggagactgaggaccagtagtacctgcagggtgcccgtggctgtggccagtgtcccttagccaacctgctgggctcaccagttccccgtctgatctgcctgtgcgcctcccattcttctctacccagaacctgtcatgggctggggctcagattttcctggctttg

SEQ ID NO: 728699 - DNA, 726 bp, Homo sapiens
ttactcggaacacagaaagaaggcaatggtgttttatgaaactaacaatgaaggaaccctattatatcctttatttctcctattacttgcctatattaatcaaccacttatgctggatataataacataaaagtaaaggtagagatagggccacccataattccttttcttctcagtccttccctactcatcagtaagcagaaggtagaatgttggtagaatatgtattcatcaagaagtgaaatacaaaccactgagttcgtttgtacagagtttctactgttctagcaaaaacaaactacacatgcaagtgcaactacaaaatgactgtataatttcagtttccacaaatgaggtaaatattcttatatttgcattttaaatggacactacacaacatatagggatgaacagtaaaatacaggctaatgatttaaaattctaatttttctttgcttagactgacattagatgataaatttttttaaaatatgacaagttgaaggagacactacaaagaaagaaaaaaggtatatattttagtacctttagcagcacattttccctgcttttttttttttttttttttttttgaggcggagtctcgctctgttgctcaggctggagtgcaatggcttgatcttggctcactgcaagttccgcctcccaagttcatgcccttctcctgcctcagcctcctgagtagctgggactatgggtgcccgc

SEQ ID NO: 728700 - DNA, 739 bp, Homo sapiens
tgtttgtgtgtaggggatgtggtagatcctggtggagtgaggatcggggttagttcctatggccctgaccaatagcctatactaaagatcaaagtcctccataagagttttgggctacagatagtgggagaaaaacagagagaagagatgggaagtcaatgcccaaccctgtcccatcataattgggttcagacccctcacatcaggaaatggcctcctacacagagagagaaatcttggactgcttaacctcctataactcacccctttccacacttaactctcttctcccccaaggcaaagctcctgtcctatttttcctgatctcactccaccatcagatgaaaatgtggagaggccagccagggaaagcactggggggaccaggcctcagactttcccaggaattagggggttagatgtggaaataggaactctgagcaccacttctggtggtgaagtgccatgaggccatgagcctgtgtcccgaggtggggtagggtcggggggaagcagccctgtatctaggatcatttgggagaggagctgggggtagggcattgtggttgaagccagataacattcccaaggtcacacaattcgaaagcagtcaattctagagttgggatagttcagatgggctgagcaaggctcaaaggcagtgccttcgaggacttgctctcaccccagctgggccaggaggagatgttcaaaaagcctcatgtaaggttgtgacatg

SEQ ID NO: 728701 - DNA, 458 bp, Homo sapiens
  misc_feature (32)..(32): n is a, c, g, or t
  misc_feature (47)..(47): n is a, c, g, or t
  misc_feature (53)..(53): n is a, c, g, or t
tacgtccacagagacattcactcattctctgnaagctgaatggaatnctttgncctcttcaaaaaattaaaactcttggtgacaatcaatctgttggagatgtttcactttctccactggagaaaattaaaattacctggattatcaaaacagttatgtttctctaaagtctgagactgatagtcctaaatttggtgtctttgattatagactggacttataaaatatagactggacttacagactttgattatagactggtcttattatgacctataaaaaacgctgtcttcagatgacaaatcccaactaagcatcattgaaaacaagcaaaaaaagggaactatattgtggttttggctattcctaatcctatctgactcaggctagcgtaaggtagcattgtgtcttcttttatacaactgtgctattagcagtaatgagtactgattccagac

SEQ ID NO: 728702 - DNA, 736 bp, Homo sapiens
ccacccatgccccagctggggttggcatttcagagtttgcagaatctttgtgtggcttgataggttggtccctcgtcctctaatgagtcacctgcctttcactcaacacacagaaaacaaggcaaatgctgtaaatcccatccctcctcctcgcctcctgtgcagctcggggggcacgcaagaggaagtgttaaaaagatttcattcaatgactgaattccatgctgagcaaaagcctaggatgcaagttgaaatgtggcttcaaaagccaccatcaacgaagaattacaggaaaagggcagtcaagtggtaaaagattccactcactcaacatctatcacttatacaacagctgggccacatccaatttagagtggcggaagaaagtaaaatcaatcagaaatccaatctagcactgtcatatactttctaatagtctagcccattaaatttgccaatggttaaggtagtcatgaaaatccattacaaataccggtaaaaagccctaccaaatatcaataaacgaatgtactctgaaggcagtctccatagaaattttacttaataataataatacaaaactctatttgtgatgccaatgacatctgtccaaaaaggtgtcatgaaatcagctcttttacaaatcatctcaactttgaactagatgttagcaggttgtgcaatcccgagatggtctccacagtatgaccactattcctgaaattaagccaggaat

SEQ ID NO: 728703 - DNA, 480 bp, Homo sapiens; identical to SEQ ID NO: 393738

SEQ ID NO: 728704 - DNA, 1017 bp, Homo sapiens; identical to SEQ ID NO: 338967

SEQ ID NO: 728705 - DNA, 877 bp, Homo sapiens
ggcgcctgtgcacacagacaacaatgggtcacagttacagaacctgggctcaggtgtgccctctctcgtttctcagctgggggccaacacatttgtaactgtgtttccatgaaaaaacgcatcctaggttccaaacaactaatatactgatgaacctttagaatgaactggacatttttccttgagagaacagctttgaaatgaggaccctgtggtccaacccttctcaatcatggctcccccaaaataactccaatgtgaactgttcaggggtagggggagggggagagcaacagaataacctaatcttaagaattcctctctaatccccagctcagaaagcgtcttttacagtcatcccctctgcagtgtcccagactaagcaaacaaacaaaaaaacatagagccatccccaaagaccaatatgcttgcaatccaagatgggcaagcgacccatctccagtccacatttcagggagacaacagaaaatttttctgattcttcacaaatgggaagaatcaaaagtgaactgttaccagaagcagaaggctgactgcacagccactgtgatgagtttccaagccttgcacaaatacgccgagaacgctgtggctgtacgaactgccttcaatcagacccgacctggccatgtgttatcaaggtcactccttcaggtatgactactccaagcctcaaatctctgtaaaacccaaggagatccacaagatcatctgctccagcgactcccttccccatttcacagattcctcagagaggggcagggatcaacgctaggcatttagttggagggctggatccagcccccaaatctttatccttgcgatcctctagagaggatcctctagatcttgcgtc

SEQ ID NO: 728706 - DNA, 535 bp, Homo sapiens; identical to SEQ ID NO: 153147

SEQ ID NO: 728707 - DNA, 748 bp, Homo sapiens
ctgcacatgctacctacatcagcccagccatgacagagccacaccaggaccgtgggctctattcgaaggagggatgggtgagagggggcatcccacccaagacctctgattccgggccaatctagcttaatgccggcattgggagttttgccccagtcggcacctgctggatgtgtggaccctggattgaaaggaggcgcttcggctgctggatgtgtggaccctggattgaaaggaggcgcttcggctgctggatgtgtggaccctggagtgaaaggaggcgcttcggctgctggatgtgtggaccctggattgaaaggaggcgcttcggctgctggatgtgtggaccctggagtgaaaagaggcgcttcggctgctggatgtgtggaccctggagtgaaaggaggcgcttcggctgctggatgtgtggaccctggagtgaaaggaggcgcttcggctgctggatgcctggaccctggagtgaaaggaggcactttggctgtgcagacctgctccattctcctccgcgtccacagcgcagaagaacaccagcttccatttctaaaaccattatttaaaagtcaagttcttttggtataatgtgcctaatgtgtttggctttctctaggtcaccatttaacatcttactctgcaacactacggtcctagttaagaccaaattcacagccaccaggtatctttacaaattaaccaagattggccaggcgcagtggctcatgcctgtaat

SEQ ID NO: 728708 - DNA, 343 bp, Homo sapiens; identical to SEQ ID NO: 118740

SEQ ID NO: 728709 - DNA, 1039 bp, Homo sapiens
tgtttatcgatgccaccctcagccaccgaagtatttgtggtggctgagagtggcttgtttaaaaaaaatgcagagtgcagggctgagagggagtggtagttcatgctggggcaaaagccagatgttcagtgtgatcttctgggctttgcttgctgagcttgtcatggggacactatgtgggcagcacggaggttggggtaccagatgtgcttcctgtcctcagtaaagaacttggagtatgttgttcctcaaatatcttttgatgaatgggtgctccaggagtttctactgacaggctacattttatccatatgcagaggggcagcccttctcttttgttcttgaagtattctttcgctgtgacagtgtctcatccagcagctgcaatgccacagctagggggttgtctttcagctggtgggatgaattacgcacaggcatctaccttgctgttctttggccctgtagcttgcatttgtgagttcacagggaaaggtgcgagatgctacccgtgactgtggcattcactctgggaagaactgcttggactggctctaactaacaccttatgcacactttcagggagtagaggccttacatttgctttgatattaacagcccagtttttctgtcattgtgataaagcaggaatgtgtgattatttttcttttatttctatttttaaaaaatgcttattatgtcctccacttaggtacatgtctgttgtgaacagctcattcctgtaaaatgctgctcatcattgctgcaagtcagtgcaacaaactgtgcatatgaattactgttgaaagaggtattggtttagcagcacaaatgattgggttatatttctctcaaactaagggacgtttgggagaggtggggagataattttcccatctgtttcctgaactctgttagatatccaggggcagagctgtttgttactctagctgaatctttatgtagaaaaaggatggcctgattattcattcagtcagagagatatttgttctttcgattaatatttgtggaatatata

SEQ ID NO: 728710 - DNA, 245 bp, Homo sapiens
ctcattcctcctggtatggaaaacctcagagacttgaagatggggatatgatgaacattctgtttgccagttgtttgtgtgatgaacacaggaatataccggatgcgccagtctcaacacgatttctcctccaccctaaactccctctttcagagcagcccttggagatgctcttcctaagccctcattaagtccatctgtgaatttagctaagcctgccttgaacttgtctactatttcagctt

SEQ ID NO: 728711 - DNA, 565 bp, Homo sapiens
  misc_feature (283)..(283): n is a, c, g, or t
  misc_feature (495)..(495): n is a, c, g, or t
cgcgaggtcatcaacgtttatccattttgaatgcttctatgcttcgtatatcgctctgtctatatttttgatcttcgttgaatttggaaaagccctgcggagagttcttgtgattccctttgtacttccctgacactaacacatgccctgcacacccatcatgttgcatcagtgtccatggtggtggtataaaattctcgagcttatctcctcttttaaatactgagtaaatacataagctttttctaagcttatgtatttactattaccactatgatctcanctttatttaagagcaatttaaaatgcagttcccataggtgtctttttttacctctcctaagaatatacaggcttgcctggattaagaccctatgatctctatgtagactgacttaaaatccaatggaatgaacaaaaatatttaggatgcttattggtagttgccccttttacacacttgctcccccaacttcaagcatttagcgatgagancagaccaatgtgagtgtgtaaaggaatatagtagatttcacttgcagtctaggtagtgtcagacactgca

SEQ ID NO: 728712 - DNA, 648 bp, Homo sapiens
actcctgcctcagcctcccaaagtgctgaatttacaggcgtgagccaccgcgccagccattttgtgtgattctaaattttttaaacttcccttgaatgttgccttttcagcctcccgtctctcttccatccccctcctttgtccatccctctcccacctacatcccatagctctgtccgtctctgaccacgtctttttccttttcgctgactttctcactcactgtctgtctctcattttctccacagctggcccccaagaggaccctttccaagtccccagctgggggccctgtgtagacctggagtggacacgcccctccttcccttcatgattcgtttgtagcgcaggtaaccagcgaagcatccctgttcattcctggaggggcaaccgtccctcattccacctccccagcaccaccttggcccctggatgaggaaggagcattccttcctggaagagcctggctaagcaatatctctggttctttcttctcccacctgggcctcctgggtcatctgggccatcaccctgcctctgcattagctgcaagcaaaatctttctctctgcccctttccccttttctccagattctttgcagaccatgcctttgcatgccttctgtgagcgggttggggagggaaggg

SEQ ID NO: 728713 - DNA, 380 bp, Homo sapiens
tttacagcatggcaataaaggctctctatgttcagggggtgagagaagagactagatgcattgtctcagatgtctcctgacttcctgagaaatgccactttgcagatatggggctgcttttcacactggctaagtcagttcatggcaaaatatgagggaattcagtgtgtttcagacactaaccaaagtccatccttcctttctccttccgtccctcccttcctccctttctcactcactctctctttctttttaatgccatggagtaccatatttttcaaagttccaacaaagatgcactacatttagacaatgtggaaatggccctcagccttctctccctgaagtctgtggccagcaaaaatctggactttacttca

SEQ ID NO: 728714 - DNA, 399 bp, Homo sapiens
atagaggctaggagggaggataacactggcccgcaggagggtcgctgggatagtaaatgtgattctttttgtgggagagctgttgcaaacctgtaatgaaagacagcacagaaaagcctttttgtgctgggcagcacttctcagatggtgatttatacataaagataaggtctccctaaatgcaagagcaggactcagtgtcgtggtcttttgcaaattgcaatacaaaggtaaaaacctgtgggtctgaggggaggctcgtgtctgggccctgggttggtggagaggcagggtccctgggagatgtgtagctggggggacttgctcaccgcagcagagctgggcctcctggaggctgcctagggcctgagcatgcagggcactggggtaagcacagag

SEQ ID NO: 728715 - DNA, 1143 bp, Homo sapiens
ccagagatactaagaaaaatgttatatagcttgaattaataatagcttgaagtctacttaattttgtattcatttcctggtcataatatgagatctctgagtaaatgtccgagtttggaaagaatgaatagaaaagtcctcattagttaataaataatactaggcggctcacacacaaggtttgccatggggactagtgaaatatgtgaaagcatgtagtcctcagagactaattccacaataacaacatcccgcttccagactctgagttgagtgcccagatttagacaagctcgacagtgctctaatagaaatgaaatcatttgattggcgtcattgaaaagaatagtggtttctcctctcttccattaagtttaaagagaacaggaaaaattccctattttcatattcagcttcttccttcattcatttagttctataaatttgcatcagcatatttttctataatactatcaacccatgttaaagtaattgaagaattggggcaatgttttggctgaaacaggtaaatatgaagaagtgatttggttcataatcttacttccaattaagttctctccaaaagagggcagaataatcactgtggcaaaagcaacttagttaagaatgcattatattatttaaaaaaccgttaagtcctttccttgtatacagaaagacttatttagtaataatatgctgggaggagtctacattgacagtgtctaagtctcattttcattcagtcataaattattagaaaaataaggtaagagagagtaacatttgattttattcttggacagggtaatacctgattctataatgatacaatttttgttgttatgaatatatgacacacacacacacacacacacacacacacacacatgcagacaaaaaaaaggagatggataattggtaaattgtgatcatttcaagctttgtagacagtcaaatttgataggactgggacacatattaaagccagattcattgtaacaatgtgggagataaggaaattttcaactttgccttggatagctaggtcccctgagcttactaagtctggttacatgtatgagactgagccagaacctgagttgtgtatgagtgtagtgaaacagaaaatggccagtccac

SEQ ID NO: 728716 - DNA, 1013 bp, Homo sapiens
cgattttgtcaaccttgccttcagtttgtcactaccttcacttttcttttaattccatattttaaaagtcatttttaagttaaagttattaatgcatgtgggaaaatgttcaaatagttcaaaagaacatgaaaataacaaaaatctccttttctctccctcacacgatttcctacccctagatttttctctctagaaatctaagcacttcttgtatatatagaaatgttttatgcataaacaaatatatgtatgttattttaaataatggaatcatgctaatacacattgttcatcagattacttttttatttttaaatttctactttaactaggtaaattatcataagatgtagaaagaaaagaaaggttaagactaatccccaaccattatttcccatctcttcaatgtatccagtgttaacactccacatatatgtttccatggtaccttatcttagttataacacccgtttgatcatattgtctgtattgtctgttttttgtttttgttttttttttaatcacctaagccatgaactctttgcaaagttggatggtggcttggcttggtcattacaatgtccctggtacctgacacactgactggcacacagcaagcattcagtataaaattaaggcaatcacccagatggaagaacacatagatgaagaaattaatgccattttctttgtaggaaacattccattaaaaagctaaaattgatcctgagtgttgcactatgatgcaaaatcaagaaaacagattattttatactaaagagaggagaaaattcaaatggaatacaaacgtggaaatgtgcctggagtgagtgtatgctttctgttgccactataacagcaagggacatggatccttaagtgactgtggaatataaatgaaaattctctacatgtttacatggctggctgagaaatgtactcagcacaacgttcaacagatatctattgagcggcctgtatgtaggggctctgggttgagctctatgggc

SEQ ID NO: 728717 - DNA, 918 bp, Homo sapiens
ggattggacaagcttggtctgggggagtgaagaccattcaacatcagctgcaggagagcatgtttaaagctatgagaagagatgcagcaatagtggtggcatttattggagtcaaggaagtcttcccaggaaggggactgaagcctgaaggatgagcaggaatcaatgtagtgaagtgggtgggaggaaccaagtgtggccccaggcagaacttcaggaacaaaggccagaggcaagcggccacatggtggactgcaggagctgaggagttcagcctggctggagtggagagtgcaagtgggtgggtcagaaagatgatgctagaggtggcccaccctggaagagtttgtttcagatacgtcaccctgactccactccagaccgttaatgagacgggggagaaatcagtgaccagatagaaggctctttcagcaaacgggcaagagatcaagtgcctgacctagaggaatggtagtgggaacggcaagaaattgctagctttgcacaatgattaggactagagtggagagattttttggaagaggtaatgattgactgaatgctttagaacatggctcagttcttcctcagctttgctggtctttctgtacaacttggaaagaatgtggtcattgttctggttatatataaatgcttttgtgtaggtgtaagtaggtatatttgttagttttaggagataaggtcttgctctgttgcccaggctggagtgcagtggcaccatatcggttcactgctgcctcgaactccggggtcaagtgatcctccaactcagtgtctgaagagtagggactacacaggtgcatgccaccacacctagataatgtctgtcttatctttttttgcgacaggatctcactttgttgcccaggctggtcacaaactcctggcttcaagcaa

SEQ ID NO: 728718 - DNA, 651 bp, Homo sapiens
catctcaaaaaaaaaaagctttacagtgaaaaatctgccttccaccttccccacatcctctcattctttgaataataggtagccatcattattagttacttatatgtaattccagagtgtattcacttcctaggacttccttaagaaattccacaaaccagttggcttataacaacagaaatttgttctctcacagttttggaagctagaagtccagaaatcaaggtgtcagtagagccatgccttcctctgaaggcttgaggggagaatccttccttgtttcttcgggcttctgggggttgctggcaatcttcagcgttcttggcttggctcactgaaatctctgtctccatctttccctcgtgtccctatctccctgtttcttctgctcttgtaaagacagcagtcatataggatttagggcccaccttaacatccagtgtgacctcatcttaatataactattttttttttttcagtcttgctctgtcatccaggctggagtgcactggcaggatctcagctcactgcaacctccacctcccaggttcaagcaattctcctgcctcagtctcctgagtagctgggaatacaggtgcctgccaccacacctggctaatttttgtatttttagtggagatggggtttcac

SEQ ID NO: 728719 - DNA, 1125 bp, Homo sapiens
attattgcattaaataggttttctaagccttctgatctttttgtccttgcggataccaataattcaaatattcagctgctttatgttgtcccaaatgtcttaaaggctttgtttattcttttttatttttgtcttactggattgtttcagacctgtattcaagttctaaaatttttttgttccacttagtctagtctattgttaaatcttttgaatgtattttatatttccttcaataaattcttcaattccagaatttatgttagggtttttttaaaaataaaaatctatcaccttgtaaaatttttcatttatatcctgaattgtttcactgagttctttgtattggttttcagatttctcttgcacctcactgaccatatttaaaaatcagtattttgagttccttatctgagactttaagaatttcattctggttatgatctattagtggagaactgttgtgttcattctggggtgtcatacttccttgtttttcatgtttcctgtgagactctgaatttctatcaagtttccagttgatgccaataatgctgattccacacagcctttctcaaccagcattcattatctgaaccatggaacacagagaatgttttgagaagctcttttctcaattctcccaaggatggtacctaaccagaaccattctagatacaaatcaggacactgattccttacatgcaattagtgcctttggtttagggcttaatttttttgaggaaacttggttgagaaagctgtctttgtaaagctgctaaagagaaaggctcagactctgaaaaagctagctttatagagaaaactacaccattaccacctttaattctaaccggtcttttgtatcaataatatcatatcgatgataatgaaataattggactaatagtgttttggtctacgaaatatcatctattaattcagtaattatttgtggagtacctgctattgcttagcactgtgatgctgaaaacatttgaagaataaatgatgaaataattattcataacttttaagcaccttcttcctgttgttcatcattaaacttaagtgaaatatctgtacatgactcagatactttagaaaaatattctcagcaaaaaa

SEQ ID NO: 728720 - DNA, 479 bp, Homo sapiens
taaagcattgatcctctaagaatttgttttgtgtagctcaaatatttctcatctgcttttaaaaaaaagttgattttacaaaatttgctgggagtggtaggggcggctcatgcctgtaatcttagcacttttggaggccgaggcaggaggattgcttgagcccaggagttcaaaaccagcctgggcgatagtgagaccctgtctcttagaaactacatatatattttacaaatttatttttctttgaggcagagtctcgttctgtcacccaggctggagtccagtagcatgatctcgacttgttgcaacctctgcctctgtggttcgaggtatttcggggtgcctcagccacttaagtagctaggattacaggtgtgtttcacttcacttagcaaatttttgtatttttggtagtttcaccatgttggccaggctggtctcgaactcctagcctcaagtgatctgcccgcctggacttc

SEQ ID NO: 728721 - DNA, 811 bp, Homo sapiens
ggcgccgcgggtcaggcagctgcgtgcgcgtctcctccaggcagcaaggggaacccgaggccgccggcgcccggaccatgtcgtctccggggccgtcgcagccgccggccgaggacccgccctggcccgcgcgcctcctgcgtgcgcctctggggctgctgcggctggaccccagcgggggcgcgctgctgctatgcggcctcgtagcgctgctgggctggagctggctgcggaggcgccgggcgcggggcatcccgcccgggcccacgccctggcctctggtgggcaacttcggtcacgtgctgctgcctcccttcctccggcggcggagctggctgagcagcaggaccagggccgcagggattgatccctcggtcataggcccgcaggtgctcctggctcacctagcccgcgtgtacggcagcatcttcagcttctttatcggccactacctggtggtggtcctcagcgacttccacagcgtgcgcgaggcgctggtgcagcaggccgaggtcttcagcgaccgcccgcgggtgccgctcatctccatcgtgaccaaggagaaggaactttttcaagagtgaagaataaaaagggaggatgtgaatttatttcaagatgatcatcaaaggatgaaggaacagatgaggtgtgagtggacttcccagatcaagaaatggacagcattatcagcctgaagaaaagaggccactgtgactacagtcaagatgctcagctcagcaagacttgaggacagctcaaaccatctttggctactgtgcccagtagcaaaggagtaaatgtgatactg

SEQ ID NO: 728722 - DNA, 852 bp, Homo sapiens
ttgggctctcatgccctgtgctaggttgtgcctttacatgatgcatgccctcttcaccctactcaggctctaatgtcctgagccagatctcccacccatttggtacagtacttttaactaaactacagagctcatttgaattttccctctaatgctccttttctgttccaggattcaatccaggatgccacattgcttttagttgtaatagttctttatttgttttttatctttcatgaccttgacattttttatgagtattggtcagttattttgtagaatgtctctcattttggatttatctgatatgttctcatgattcgattgcaattatgtatttttggcaagaataccacaaacatgatgctgttgtttccttgtctcagtggattgtattcagaggtataggatgtcaattaatcttattaactggtgatgttaaccttgatcacttgattaagatagtgtaccagatttttccattgtaaaattattatttattcatttgggggagatactttattctcttgtgggagatactttgaatctatgccaatttcctgtttcttctcacttttgcccattgattttagccattagtggatcttgcctgatgtaattattgctgtggtgttggtctaatggtgatttttaacttttgtcagtccttctacacttattcattgtaattttttttttttgagatggagtctccctgttgtcacctggactggagtgcaatggcacaatctcggctcactgcaacctctgcctccccagttccagcaattcttctgcctcagcctcccaagtagctgagattacaggcacccaccaccacgcctgactaat

SEQ ID NO: 728723 - DNA, 1054 bp, Homo sapiens
gaagtgagccttgaaaatctgcaaaatgacgaggttgcattgtgcaaattgaagctattatgagaatgttcaggtcaaaaaaattacctgacaaattcatgcacaggatctcacaaggaacacaaatgtgttcgttggctttaaaaaaatcacattaacattcatgttgatatacaaaaactcttctccatctgttttgtgtgagttttaccaagaaaccaaacaactggaaggtacccacgttgaagatggcaaaactaccaactgccatttgcatgaattgttgagcatgactagtattaaaaaaacttaaaaattgatataacttttgttcctacaaattggcaaaggattttataaactagtaagtcagcattagcaaaagtgcgaaaatggcactatcagatactagtggtaagagcataaactgaatattttgaataccctacaaaactaggacagtgtcctagaatttgtaatggcataaaccagaaacaacataaataaaggaacagaatttacagtacttccatgtgatgggacaccatgaactcattaatattcaaaaaacatttaagtttaaaaatgctcagaactaaagtaacatttaaaaaacaggctagctcatctacacacaacatagtaacatggtaacaatctcataaaaaatactatatgtatagagaaagaaccagaaggaaatgctctcaaatataagaaatgtaaataaggtggttagtttttagttttcttcaccctgttcagtacttctgagtatctcctatgagctcattaatctttaattttaatcatcttatttttaaaaaacaaggaccatcttgatatatgtttacttttattaaggaaaaagaatctatgaacacaggaacagaaatcaggagatcttagctctcgccctttcagtgccacaaagctgttttgtgaacctgtaaataatccatttggagtctccatgtttctcaattgtaaaatgacgatgtgctgcttctacacatttcacagggtcattgcaagaataaaatgagacaatgag

SEQ ID NO: 728724 - DNA, 723 bp, Homo sapiens
ttaaccagatctaaaaaaaaccctctcaaatatgtaatctattattttcagaagccctaagagaaaggcaaataatctcttctctatagtaactgaggggaaaacagtttaccatatttgttctgaaataacaaaacccaaggaggaacaactctctctgaggtaagagggcatcacaggagggatttcaatccttcctagtactgggaggagaaagtgcccttttctccaagaggaaagaatctatttatcatcaaacaaacaatgtgggagagttcatagctgcacaagtgttttctgggcgaagtaaaatgaatcatggattaagctatttggaaaaaagtgtgaaaacagaggagttgataccaaattaaaacgacttttggaaatatcatgtacgtatggaacaagtgcaaagggaaccactgactcagcgtcagaaatgccttgtggggctttgccgggagggacttacagtatatctttgacatcactgcgccggctcttccctccctacccggagagaggaagacttttctaagaggaagccaggccacatcagatgcccccagatggcaggacacacaagggacacatatctccggaaagaggaggcacatggttgggcaatctcgacccatgaagggggaaaagaaaagggctaaactgaagctagtgcagcttttgttctgcctggagcagttcaggctgagcatggcttct

SEQ ID NO: 728725 - DNA, 493 bp, Homo sapiens
cactatagctctgggactaggcagacctggggtcaagtcctttttccttggcccagaaatttcatcttgagcctcagtttctttctctttaaaatggggctagtgggacctacccctaggttctatatggagattatatgatgtaatgatccaacctgtacttgggaagcacttagtcaattgccactactgtttctcagcagatcttccagtaacaactaccaccacctgttgagtacccagtggtttatacacacaagcttattggatacccagggcaagctaaaggagttgttcttgttctattgtgattctcattttataaaaaagaaaactgagatttcaagaagtgccgtgtaccttgctccctgggggtctcagagctggggttagagtccacatcacagccctggggcttgcccttcatcctgccctaccatggcatggagctggctctcctccttctcagcccacaaacaatgtccactaggca

SEQ ID NO: 728726 - DNA, 585 bp, Homo sapiens
caattctggaattcgggaaaagaattctaaattcacgtcttctgacgtcacagcactttccctgttcatggaggcccgttcactccttgtacagtcagttttctaagggcagggcgtggaggtgaacttcctcccaggactgggagctggatgaacagtgaagagtaaagccacgggaagccccagtcaccacactcacagtgtaacacagagaaaagacacaagaaaaggaggaaatggagatcaaaatgtcactgccgctgtttgaatctgtagctcaagccccattcaaggggagcctcatttttgacacaggcttgctggtttttccaaatccctgttgactcttaagctgcctaagcggtttacaaggatgagcctccattcacaacaatttctatttaaggaaaaaccattggggatgggcgcggtggctcatgcctgtaattgcagcaccctgggagggtgaggtgggcagactgcctgagcccagcagttcaagaccagcctgggcaacatagtgaaaccctcccgcttctacaaaaagtacaaaaatggccaggcgtgatggctcaagcctgtaat

SEQ ID NO: 728727 - DNA, 723 bp, Homo sapiens
ggctctgaggaggtcctggtgaggtccccaagctcaggctgcggaggcttcttgggaaagtcactcagcggaggctgggaggcctttttgggaaaggcgctggagtcgcgcttcggctcgctggactgaggcttccagaggggagtctgagcggcctcgctgaactcaggctgcggcacggacttcttagggaggccaccgacctgaggctgcggaggctttttggggtacacgttgaactcaggctgcgcaggcttcttgggaaaggtactcaactcaggctgcggggacctcggggtagcctcaccgggctcgggttgccagagcttcctggggaatgcgccggatttgggttcggaggggggtctggcggggtgactgagttcgtcgggctgcaggggtttccgggccggcgcaccaggctccggcagcgaggccttcaaaggggcctcaccgacctcaggctgcaggggcttccttggaaacggagtggcccccagctgtgggaacttcttggagaggtcactcaactccagtttggacggcttcttggggaggtcagtgacctcaggcggcgggggcttcttggggaggtcagtgacctcaggcggcgggggcttcttggggaggtcagtgacctcaggcggcgggggcttcttggggaggtcagtgacctcaggcggcgggggcttcaaggacactgcaccaaactcaggcagcggg

SEQ ID NO: 728728 - DNA, 618 bp, Homo sapiens
catccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggagctctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccg

SEQ ID NO: 728729 - DNA, 530 bp, Homo sapiens
taaagcaatgtgagtccactgaggaggaagagaccctgggatttcaccctctgggttagtctctgtctcaccctgttagaatgtcacgagggactgtactgtcccctctgtcaccagggaagccacaatgagagcttgaaagggtgctgtcaagataaatgtcatccttcttaaaatacatatgattgcctttttgggtgcctcacagagccccagagtgtgagacctgaaagaatgttcagcatctagctccatgtccctgcaaccactctctgtttgccttctgcattctgcactctgcggggcctttgcagccagactgctgtgtcaatgttactttcttgtcactttcctaccctgatggtcacactagcccaccccaagctccgacattgaggttttcatctctgcagggagaggttccaatgtccaccccacccccaggtacccgcctcttcccacagaagcaattttagaattttgcaaaattcttttccccttattgagattaatatttaagattaaaaaaa

SEQ ID NO: 728730 - DNA, 742 bp, Homo sapiens
gagaagagggaccatctgttccttatgtcccttttccctttcagctttttattttgaaaagtttcatacctactgatactctggaaaaattgtgcaattgaacatatacccttcatgtagattttctcattattaccattttattacatttgctcactcacattctttatgtgattttttttttgctagaccatttgaaaatttgaaaagtaagctacagatgttttgacacttcatctctaaatactttagcatgtacctcttcaaaacaagaacattgtcttacataagcacagtatcattacatgcaagaagtttaatattagtaaataacatatactttataatctttattcaagcttcctcaacttttttgcattttggcaagtggtggttctggtaagatgtctagagttcaattcaggatcatgcattgaatttaattgccttgtctctttatattccttaatctagaacagatccagtcgttacattgacatttttcgatgagtcttaatagaatgtttcacaatttgttttctcaccattttttttggagagacaagagtctcactctgtcgcccaggctggagtgcagtggcgtgacctcagctcgctgcaacctctgcctcccgggttcaaatgagtctcctgcttcagctgcccaagcagctgggactacaggtgtgtgccattatgcctagctaatttttgtaatttttagtagataatgggatttcac

SEQ ID NO: 728731 - DNA, 708 bp, Homo sapiens; identical to SEQ ID NO: 93101

SEQ ID NO: 728732 - DNA, 281 bp, Homo sapiens
gttgcttccaaatcttggctgttgtgaatagtgctgcagtaaacatgagagtgcagatatctcttccacatactgattccatttcctttggatatattcccagtagtgagattgctggatcatatggtagttccattaattactgctaaaagctaaacatcagatttttatacatatagatggcatacattcatcagaaatatatcgtgcttcataaatacttgtacttttggctgcacattataatgtagtatggcatagtatcgagtaatagcatatca

SEQ ID NO: 728733 - DNA, 236 bp, Homo sapiens
cgcctgggcaacaagagcgaaactccgtctcaaaaaaaaaaaaaaaaaaaaaagttaagatggtaaatttaatgttacatattgtaccacaataaaataaaatcctgccaatacaacaatattgcaggactaatacagcaaccaccttccttctcagaggttctaaggggaagtaagagctacaaaacatttttattctattaatttaaaaatatcctgtcccataaatcatattt

SEQ ID NO: 728734 - DNA, 326 bp, Homo sapiens
cgcctgggcaacaagagcgaaactccgtctcaaaaaaaaaaaaaaaaaaaaaagttaagatggtaaatttaatgttacatattgtaccacaataaaataaaatcctgccaatacaacaatattgcaggactaatacagcaaccaccttccttctcagaggttctaaggggaagtaagagctacaaaacactattttgagcttctctttctccctttcctagatacataaagctagataaccgaaagtgattaacaaagaaacatttatgaccaaatagctgcattaactggtgagtcaacctaacatttaaagaagaattaatacc

SEQ ID NO: 728735 - DNA, 5613 bp, Homo sapiens; identical to SEQ ID NO: 87626
  misc_feature (1)..(2): n is a, c, g, or t
  misc_feature (36)..(36): n is a, c, g, or t
  misc_feature (889)..(889): n is a, c, g, or t
  misc_feature (3773)..(3774): n is a, c, g, or t

SEQ ID NO: 728736 - DNA, 902 bp, Homo sapiens
atatcttaaaatccacattttctaaatgaacacctccaggaattcctcccatttagtcaactatgtgttgaatatttaggcttcagtttcttgacttttaaaataattaaacatataaacaagttagaaaaactagtttattatgcccagagaaagtagtactgcttatgaatttctcgatctaactttctgcaaaggaaggctgtaaaaacaccaaatctggactctccgtagggtagttctgatctaggaacacatcacaattaaattgtataacactacgcttgaagatttatacaaacacacactgtttttaaaacttcacttagatctggttagagtattcacttcttcttcttaaggaatggtcaaaatgtaatgaatcaagaaaaggctttgtatttcaagaatttttttaaaacaatttgtatatactgtaaatgtcaagcaataggaggttggttaaataaattatggttaacaatagattgcaaaccatatagtgattaaaataattattaggtaacttgaaaaatgcttaatggaaaaagttttaaaattagattccaggataccatgctctaaataagccaaattttggggtaaaaaaaataaaaaaccatgaaaccagacatagaagcagaacctaaagcatatttatcaaaatatctttgtttaaaaaaaatgtcttcagtggtcgtcttggctggtgggattttaggtcattttaattatctttataaaactttattctctcgaattttaaaattaacatctatttctcttataattaaaaattaaatgttatattttttaaaaagtatagtttatttattccagtagtaaaacattattgaaaaaccaagagaaaagcaagaagaacacgagagagagagaaaaat

SEQ ID NO: 728737 - DNA, 541 bp, Homo sapiens
actcacttcacctcttagtcttccagagaggatctttcatcctgccatcctgaggcttctatttttgaccaatagctctaaagaccacgggttcccataacaacctgatatccctttctcatccctgccatccctgaataaggcttctaatttattatgctttaacaagttttcaaatagcaagcgagacacgctggaatagttgagagagccccatgctctaaataagccaaattttggggtaaaaaaaataaaaaaccatgaaaccagacatagaagcagaacctaaagcatatttatcaaaatatctttgtttaaaaaaaatgtcttcagtggtcgtcttggctggtgggattttaggtcattttaattatctttataaaactttattctctcgaattttaaaattaacatctatttctcttataattaaaaattaaatgttatattttttaaaaagtatagtttatttattccagtagtaaaacattattgaaaaaccaagagaaaagcaagaagaacacgagagagagagaaaaat

SEQ ID NO: 728738 - DNA, 619 bp, Homo sapiens
catgggcaatgagaaatcctacttataattcaggcaaatatatggggctcgtatctaatgtttaattaatgggagagaaataaaatcctctggatacttgggagttctccatgaccatatctagcctgatcactgtaatgaaacctacgtttgtaagcagaaatagaaagaaatttggaacaactcttggtaaataaactcagtgatgatacaacctcttccacgtggtgttcacactcacaccggcagttgaatacagcagccacggggtttcttctggagactgacttcagcaacacctttccccttttagttaataatttttttaattgtaagtctttctaaattttaaatttttaaaattttttcacctcttaatcagttctgttcatctttatttctattacttacctcttccttctactgcctttctcttggattctcttaggtaacaaaaataaaaaactcttgtatcgtactaaagaggcctcataagtaattcccaccaccccaccattgcacgtgaatttctttgttttttattttagagaaagagtctcactccttcacaaacacaatgccactcacaggctggagtgcagtggcataattattgctc

SEQ ID NO: 728739 - DNA, 839 bp, Homo sapiens
aagtcaaagtaatatcaaatcctaaattcagttgatctgggccgagcatggtggctcatgcctgtaatcccaccactttgggtggccgaggggggcagattacttgggctcaggagtcggagaccagcctgggcaacatggcgagatcctgtctctgcaaaatatacaaaaattagctgggtgtggtgtcagatgcctgtagtcccagctacttgtgaggctgaggtgggaggatcgtttgagcctgcaaggtggaggttgcagtgagctcagatggtgccactgcactccagcctgggtgacagagtcagaccctatctcaaaaaaataaaaaataaataaaaaatcagttgaactatatggaaacttctgtacctgtgtcaacggtgcatcttatctaatactatatgatactgtaatctaatattatctctgataattcaaaaatgctaataaactctgctcaaatgtgttagtttttcatacttcatcctatgccaggaaatgttttgaacttcaccaaagctttgctaatgtctccctaccataaggctgtcagctgaaaatagcaaattactgcccgactcccattgaccataatatccattccgcatgatcctagttctttaatttactggaagtctttactgttttgtggtacctactaatcagagactcaaagcctatagatacagaaatgtaacagtaaatctcaacctaaggctaatttgcaaataaaattacaaaatcaacttagaacccaaagactcactaagtgatatgcttttgatgttttgaaggttttaaaaggttataaattccattaaattttagcatac

SEQ ID NO: 728740 - DNA, 516 bp, Homo sapiens
tggagttttgccatgttgcccaggtcggtctcaaactcctggactcaagcaatccacctgtctcagcctcccaaagggctagggtacaggcatgcgacaccgcacttggctaggaataataatattttaaaacaacaacaacaacaatgtaaagttttcattctctggaaatccaattataaattccaagcatgggaaaaaaatgactcataacaaggagaaaagtcacttagtaaaaacagatccagacatgacagaagtaataaaataagccaacaaaaacattaaacagctattacagatatgctgtaaatgtatatgaagatagaggaaagcatgaacctgatcaagagtgacataaaaagacccaatttgaaattatagagatggaaaatacaatattttacatgaaaaatgtactgggtggtattgacagcagattagatactgccaaaaaaagtatctgtgaacttgaagacatagcaaaagaaactaactatccaaagtgaagcacag

SEQ ID NO: 728741 - DNA, 439 bp, Homo sapiens
ggctttgaacacaatctggccttcagatgcagttgagacattacagtaatcatcaaaataatcccatctccaccatgcttattttgcaaaagcagtatagggccttcctctcatccctccatagtggttggaaacagcaatcaaattatagcagcgaggccctgcgcttggattaatcagaaattccaatacagccaagtcattgataggaaaatcaactaagttatctaacttgtttctcaaggatctactgtaagaaaaatcacttgagatgcaacagctactggaggcagggatcatacatccaatttcttagtggtggcttcttgacgatttggataccaggaatctttatcacttagttttcttttgttgaaaagggtctgaggcagtcttttaatttcgcaaaagttttttttttttcaaggaagtttatatt

SEQ ID NO: 728742 - DNA, 309 bp, Homo sapiens
gttcctaaaagattatttcagagtccactgttgtgggctgacttgaatgctctcaaaattcgtaagttgaagccctgacccccaggacctcagaacgtgactgtgcttggacacagggactttccagaggtgattaaggtgaagtgaggtcactggatggccctcctcctatctgactggtgtcctgatggggacgcggacacccacacaggaacggacccggggagaacaacacatcgtctctgcgccagggagagaggcgtccggggaacccagccgtgcccacgcatttatctccgccttccggct

SEQ ID NO: 728743 - DNA, 300 bp, Homo sapiens; identical to SEQ ID NO: 1755

SEQ ID NO: 728744 - DNA, 305 bp, Homo sapiens
atcatataccaatgccttcctttatttctttaaacattttaacatactcattttataatttttatttaaaatttctgtatctgaagtccttgtgagtctggtcttgaggtttgaagattttgctaattcttattcgtgctggctcagttccttgcgtgttttggatttttttttttttacttttaaatgtgtttaagttgacatataattgtacatattcatggggtacatactgatgtttcaatatatataatgtatagtcatcagatcagggcaattagtacatcctccatctcaaacattta

SEQ ID NO: 728745 - DNA, 478 bp, Homo sapiens
ggcaaaaaaccaaatagcttaccctctttaaatttcccttttaacttccttacaaaactccctaaacacccatttacgactttgtccatcaaatatggtccaacctaagcttggtttgcatggctcctacttccctttcacccttcccacttaggcagtgtctcccaagtcccactgcagtttctatttgtctcctgactgttactgtatcagttcttacctaaataacataacaactgatctccctactttttgcctatgccctcaaatgtgctcattgttgatctatctccctgttaggtgttctttttctcctctttagaaagcagccaaggaaaccagggttctctcaaagtggaaaatactggaacttatgtactgttatcataatgatagttggtgttttgaattataagaatgattccaggtggtttctaaatcatccaataaagctgtattcactctgtaaaaaaaatta

SEQ ID NO: 728746 - DNA, 521 bp, Homo sapiens
ctatccggggcaattgtagcgtttgggtccttttacccctatgtcccccggctatacttttaaaacagctttagctgttctttatcttgtgcacatgatacaaaatatgttcccgtacaatatggggctgtcacttcttgccaacccagcaccctcttcctcttctaacctgctttctgaggcttctgctcttcacctcctgctcgctgatggaaacctccagggcaaagctgaaggtttcttggggaagccaggaaagccagtatttcctatgtgtcagatctgcttggcttccaagaagggatgcatgggctttttggccagtgtttccaggaggctctgggcttcctgcttcttccccgcttcccccagagttcacagatgttgaagtttctgaaggttgacgtcactggaagtctgaccacaaacaagttggctgttactgtatttgaaacccagtacctttggcagctcacctctaaccagtaaaataagaggattccatggtttcagcagttgtc

SEQ ID NO: 728747 - DNA, 495 bp, Homo sapiens; identical to SEQ ID NO: 114429

SEQ ID NO: 728748 - DNA, 1175 bp, Homo sapiens
aaaagagccaaaaatgtgctcccaggtgcaaaaccccagccccatcagaattgcttctcagcactttgggtaactgttttgcactaacagcttcctccttgtcttttccctgggaacatgggagcactgacacagaactcaactggtccagccctttgggaggcccaggtgggcagatcacctgaagtcaggagtttgagaccagcctgggcaacatggtgaaaccctgtctctactaaaaatacaaaaattatccagtcgtggtggtgcatgcctgtagtcccagctactctggaggctgaggcaggagaatcacttgaacctgagaggtgaaggttgtagtgagccaagatcgtaccactgcactccggcctgggcaacaagagcgagactttgtctcaaacagaaacaaaacaagaaaaacaaaaagaacttaaccagttctccccagatctcagcgtgcatgcatatatagagtttagtaaaatgtgtttcaaaaaaagaaggataaaagaaagtttgaagtaagatttgtaaaagaatgaacactttaggttttgtgtgtgagtgcaaaatgtaaacacggcatttgaaattttttggtattgaaatccttaatgcctgttagtttctttatggttttatacaattgagataggttctgaagtttttttgttgtttgcttttagaaatttttaaaaatacaaaaaaaaagcgcagaaacattttcatctgggttactgtgtttatagactattctatgactcaagacaactaggacaccatcattttccagataagaaataacagttcaagttcattagggaaattatcttcccagtccaagcaagcaataatgttatcaacttacaatattggacaatcttcatattctatgagatgcctttaaaatttctttggatttaatgctgctcttggtcagttgttcaaatgaaacattgtaatttcatgttaacgacaagagtctcacgggagtctctttagatgctgcaggaactgagaggatagaagacctctctatacatctacattgcccattggagtaaagcactttacagagagatggatgccgctttgggatttggggtctatgtaatgctgatttttttcaaacctgtttggaaatattacttctttgggatggctgaaataac

SEQ ID NO: 728749 - DNA, 685 bp, Homo sapiens
ttgaatctcactttaaaaatgaaccacacaaaacttcaagaaacgaaatagaaatcaacatttactgcccgtaatattgctcatggttatagctagtatcacatagtgatttacaaaccatgaaattccagatttaaatctgttgcactacaaaaatgtctaaatgatgtctgctaaatttgtgagttatagaagtacagaaataagtcattttcatttcaaatgcagtgaatttctaatttcatggtatcatatttttttcctttgcagttttggtaagactcccccattactttgctaagacttgctttctcaaccagtgggatgaaacgagtgccagtgtgttgactgagccttcttaggacttaaggggctctgggagaggccaaggcagcagttgaaaactgcagcttcacctggcctttgggctgttttccctggcccacacagtgtggctggttaaaacattctgaatttgatgccaacatttttaaaaattgggagatttgcatgaaaatccagaattcgggtaacttttgaatgatctgaagatctggcaacagtagacctgacccacctttgtgcacgggacttaactgagaggatctgagtagcagacaccctaagagcatgtcattgtcttctcaccagttactctccagttggctagagtcccctccgagca

SEQ ID NO: 728750 - DNA, 645 bp, Homo sapiens
gctactcagaatgatgtgcaactgaaaacttatgagctgtttatttccaaaattttttttttaaaattttcaaactgcccggtaactaaagccatgaaaccccaaccttgaacaagaggggaatgctgtatatatgtttgaatcatattccattgggaataatttacataagatatacagcatagctatatctgtataaacaacacaggtttgaactgtgcgaatcttcttacagatgaaacttaagattgttaactaaaaaaaagatggtagaaaattacatatagttttattttatgtcttaaataataataatcaggaaatttggataaatatataaaaagttattagcagccaggcatggtgactcactcctgtaatctcaacactttgggaggctgagacgggcagatcacctgagggcaggagttcaagaccagttctagccaacgtggtgaaactccgcctctactagaaaaacaaaaattagctggacgtggcagcacatgcctgtagtcccagctactcatgaggctgaggcaggaaaattgctttaacccgggaggcaaaggtttcaatgagtggagattgcgccagtgtactccagctcatcagcctgggtgacaaaaaaagactccgtcccca

SEQ ID NO: 728751 - DNA, 1680 bp, Homo sapiens
gcagcaaagcagaagcagacaactaggcacaaagcaacagagttttaaagttttcttctcctgctactacttagcatgtcttacatgaggagtatttacctttgtttagccaggagcagagatgcatcctgaatgtacacgatggcttctaacttggcagcgtgaattttcagctgagcaggtactgctcggagacttgtaaccaaaccgcctctgatggagcacggctggtctcccaccatgtgtgtgaatagtttgggggcttcttatgccacgctgctctacctgcaggaataaaggctaggacaaaggagaggatgcttgctatggtttgtctggctggggcctgtgcgagcgactcaccgcactgatgctgtgtgactccccagctcacatttaaggctggtcacggggctggcgcagatccccactcctcagttagcgcacggtttaaaggagaaaccagactccctgacctaaatcactcccagtcctctctggatgcgggacagctgtcgactagcagtgacacaaccagccatcaagtggagaatcgttgcgactgcagtctgtgtgcaggtggagcccgggagaatgacagtctaatttcggtcatccaacggcttttccttattttcctaaataatcgtgctcgctaagtatacagttgtctggattagcctgcctgccatgcagtcctcatcaactctggctggaaatcagggtgccaggcaagccgcctttagccctggctcctttctgcgtgatgctatgcagctaggatgggtcatgctgacaacaaagaaggaagcagaaagcatcactttctcttctcttgtgatgttagcggaacataactcttcttcgcagtgatgcccttgtgtgtggtgtatgtgtgtgtgtgtgtgtgtgtgttttaattcatctaatcgaagagcccaacaaatatcatcatggatgtgatttttaataatttggaaaaaacaaaaaaagacagcctgtggagacagcgattcgaaacagcggcacatttaggttattgccaatttgaaatacttggtttgtgaagctgagccctaagggacaagctcggtaactgaggaagagatcgtagataaagaaataaaaatgacaagcgtaatggaggctctgcgaagggactgtcagagcatcagttcatggatggcaatttcaccaggctgagattgaataattcatagattgaaattaccctgctttcacctttcccatttaagccggcatgatctgaatctctcataaattttcaagataaagtaaaatgccaatttgaatctgaagagcttttaaaaccagatgctgcatccctgaatctttcggtatctttcacaattatcctatgagaacagcacttcatcacgaagcaccattaccagggaaaattacggtgattacaatagcaacaatagaataccatcaaatgatctctaatttacctaatttgctaagactgactgtacggttttgatatccattgtatgtcaccatgcccggcacccgtgaagctatctcgcactggaacaaaagtggcatcgtgtgtgtgtgtgtgtatgtgtgtatgtgcacgcacaccctgctaccttaactgtgaatgcctagcaaagaacattctcctaggttacaatatttctttcctttggt

SEQ ID NO: 728752 - DNA, 483 bp, Homo sapiens; identical to SEQ ID NO: 129163

SEQ ID NO: 728753 - DNA, 569 bp, Homo sapiens
caaggatgtggctggagaaaaacagggcaagtggaggtattggagggacccaccaaaatgaaaagcagcctgtccagagctgtaggagttgaaacagttttctgggatgatgatgacaggctatgaaaaggacaggaaggtacctgatgggcgagaagcttaaggcaacaaccgggaaactaggaaaccgttggcccaggttttgtaccaattgtgctgaggtcatccaggcaaaacctcaagaatgaagacatctaatttcaagaagggacaaagggatccccaataattgggaagtcacatcacaccttgttcttggctaatacacaacagaaggtgaagtatgttttccaaatgccccttgtaatgaaacagttattgaatgtcttcccaggacaaactgggaaggagagcacccatctaccgccgttcccgcagtcctgcagtcctgcaggtgggccagtcctgccaacactccagctcccctcacagagcataaactgaatcaggtggccgaaccaccggaagccagagtccccagtgtccgcgcccacacaggggtgggtagg

SEQ ID NO: 728754 - DNA, 392 bp, Homo sapiens
  misc_feature (278)..(278): n is a, c, g, or t
  misc_feature (333)..(333): n is a, c, g, or t
  misc_feature (380)..(380): n is a, c, g, or t
ggagtattaaaagtgcccgcacttgaaatcttactgcgtgtcctgaagagagccctgtccctttcccatgagatgctgagccgtgatctgtactcgggaagcacacagatctcctgtctccaccctggcgtgttctgacaggtgcagccgctgtgtcaccagcaccccggcaagggagaccgcctccgtcgcccctccctggcccacgccctcccagacccggccctcgtcgccgctgtgtcgctggtgagggcgaagtgttgctcaggcccgggctngacgcagagccagagctgtccccagaggagcagagggtcctgggaaaggaagctnaaaaaggaacggaagaaagaggagaggcagcgtcttcggggaggcanggcttttttgcc

SEQ ID NO: 728755 - DNA, 315 bp, Homo sapiens; identical to SEQ ID NO: 71793

SEQ ID NO: 728756 - DNA, 1087 bp, Homo sapiens
aggttacacttgtgaagaaatttgctggaaattaatggaattgctgactttttacagtcaggctgcctacctgaaattttggacttagttcttaaaggtaaaaaggtgcaattttgaagtgctcaaaatctgttcttgtatttcataatcgagaacttctgtgtcaagtaagaaatactcttcacacactatattttttttgagggaaacagatagtgctattcagaaatagtcattctgaaatttcttattaattggtcaccaaagggtggacatatagaggagaacatttacatgcatggtgttttaattataaaattaatttttatctagaaatattaaagtaatttattaaatacagactgattatggatttttagcagacaaaaccaattactgtttactctgtgccttgaggccttgctcttttcacatactattctttttttttttcctgagtttcgctcttgctgcccaggctggagtgcaatggtacaatcttggctcactgcagcctttgcctcctgggttcaagtgattctcttgcctcagcctcctgagtagctgggactacaggcatgtgccaccacacccggctaatttttgtatttttgggtagagacaggtttcatcgtcttggtcaggctggcctcgaactcctgactgcaggtggtccacctgcttcggcctcccaaagtgctgggatcacaggcatgagccaccgcacctggccttcacacactatcgtttaatcctcaatatctgtaaactttggtgacacatccatttaaaattcaaaaaaccatcttggcttagcacatgactgaaaatgaaaaaatatcaaggcaaccacaacatgtcatgctttttcttcttttgaaacatcatcacagttgataattggtttactgtttatgacttttctgctagactgtagtctccatgaaagcaggatacttactaggtttttcttattcaccatggtatccccacctagcacagtttccagcaacattgagtagtcagtatgtattaatcaaataaataaaataataaataaataaatgtgttcataatatttattgct

SEQ ID NO: 728757 - DNA, 788 bp, Homo sapiens
ctcacccgccttcagagacttcttggcccatcttagctggaagggatctgttccagcgctgagcttttattttgcttagcatctactcagatgccttgactgtgtgtgtctcacagtcctactgactgacaaactccctgggggccgagatggcatggattcaggtctcagatgctctatggcacctgggagcatcttacacaggtgaagtgctcagtgatgatctggggtcactattctctgcagatcagcatgtctgagaggtaggggctcacagactgtggaactggtgtaagacctttgtcttttcccagctactaacaggtcctgcttgtcacagcccttccatgatacaaagttaagtcattttgtgtctgacacaggcaaaggaaaatgacaggcccttgccttcccggtcctcaagggtcagctgtaagatgatgtcataaagccggatcaggtcctggggccgggggaagcacttgctgtcatcctctggctgctgctgcagcagagccctctgcagacctttggccatgctctcattacgcttgattgccattgacagcttgatgtaagtcaggtaggtggaatgcaccacacgtcagctcaagttatactcagagaagcagaggaactgggaggactgcactacgagttggggctgacccagaggaagtcgggggtgagttggggcaaggccacagcaggccatttggcctgggcttcaagggaccctgtaatcccaactacttggcaggctgaggcaggagaatcacttgaatccg

SEQ ID NO: 728758 - DNA, 560 bp, Homo sapiens
tttttctcttaatctgccttactattttctaatgtagttactgatcaaacttagcagtaacccactcattttgtgtgtaggcaaaagcaactatgaataaacagaagaagtctcccacagtgggtaaatgtgtggacctgggtttgaaacctgatgaaacttgctggctgtgaccccttgggccagggattaactgctgtcactcttagttccctcaaccctcaggtgcatgtgattatattcactgcctgatatggtttggctctgtgtccccacccaactctcatcttgtagctcccataattcccacgtgttgtgggagggacccggtgggaggtgatggaatcatgggggtgggtctttcctgtgctgttcttgtgatagtgaatgtgtctcatgagatctgatggttttaaaaacgggagtcctcctgcacaagttctctctttgcctgctgccatccacataagatgtaacttcctcctcctttccttctgctgtgattgtgtatcctccccagccacatggaactgtaagttcaataaacttctttcttttgt

SEQ ID NO: 728759 - DNA, 499 bp, Homo sapiens; identical to SEQ ID NO: 84064

SEQ ID NO: 728760 - DNA, 1303 bp, Homo sapiens
cggctggccgagctcaatcagttccatctccgtgggcatgtaacccatagtcctcatgagattccccagatccttacaagagatgaacccatctcggtccttatcgaactcaagaaatgcttcccgcagctcttcaatctcatcttgtcccagtggtctttcccgctgtttctcagcaatgcctttcctcaagaagatgcaggcggggcccatggggaactgcatggaggggtggggtggagctcgcagggcaccagtctcaagatggcccctcctccctgctccctgtcggagctcagcctccttatcttctccagcactcctttgccacctcttcctgcctctcttggcttctccttcggtcccggtgtcttagagctgtgacagctgggctggaaatccgcatgaacttgggtggccgtgtagactttgatgactttgtggagctgatgacccccaaattgcttgcagaaacagctgggatgatcggtgtccaggagatgcgggatgccttcaaggagtttgacacgaatggagatggggagatcaccctggtggagctacagcaggccatgcagagactcctgggggagcggctcaccccccgggagatctctgaggttgtccgggaggctgatgttaatggagacggcacagttgactttgaagagtttgtgaagatgatgtctcgctgaggaggtcctggaagctccagaccctctccacctggtcaacatggagcaagcgcttgtggagaaccaaagcccaaaagccccagatccccttaaagcagagagggagggcaggcgggagggagggcattggcatgcggcgctgtgcatggggtgagacccagagcggtatctttgccaggatgggggcgtctgcagaactaggttaagaaggaagagtctgtggatggaaataggaagcgtgggagggtccagttgccacccccaaaaattccaatgattcttgacatcttttcacttcacgtagtcctaagtccctgtgacctgccagagtctcttccccagcttccccttgggtgaaaatagtctcttctcctgttgggtatcaaaaggttcagaacgtagtctctactcttcccctgcctgcatcaactgttgcaaatcccgtttctctctcccggtaaggggacaaattatactttattcaggtgatggttacatgaacagcccagacttcaccactacgcaatatatccatgtaacaaaaccgcacttgtactccctaaatctatagaaatacaaaatgaaataaaacggatgcaaatcagtca

SEQ ID NO: 728761 - DNA, 1262 bp, Homo sapiens
ggagaagccaagagaggcaggaagaggtggcaaaggagtgctggagaagataaggaggctgagctccgacagggagcagggaggaggggccatcttgagactggtgccctgcgagctccaccccacccctccatgcagttccccatgggccccgcctgcatcttcttgaggaaaggcattgctgagaaacagcgggaaagaccactgggacaagatgagattgaagagctgcgggaagcatttcttgagttcgataaggaccgagatgggttcatctcttgtaaggatctggggaatctcatgaggacgatgggttacatgcccacggagatggaactgattgagctcggccagcaaatccgcatgaacttgggtggccgtgtagactttgatgactttgtggagctgatgacccccaaattgcttgcagaaacagctgggatgatcggtgtccaggagatgcgggatgccttcaaggagtttgacacgaatggagatggggagatcaccctggtggagctacagcaggccatgcagagactcctgggggagcggctcaccccccgggagatctctgaggttgtccgggaggctgatgttaatggagacggcacagttgactttgaagagtttgtgaagatgatgtctcgctgaggaggtcctggaagctccagaccctctccacctggtcaacatggagcaagcgcttgtggagaaccaaagcccaaaagccccagatccccttaaagcagagagggagggcaggcgggagggagggcattggcatgcggcgctgtgcatggggtgagacccagagcggtatctttgccaggatgggggcgtctgcagaactaggttaagaaggaagagtctgtggatggaaataggaagcgtgggagggtccagttgccacccccaaaaattccaatgattcttgacatcttttcacttcacgtagtcctaagtccctgtgacctgccagagtctcttccccagcttccccttgggtgaaaatagtctcttctcctgttgggtatcaaaaggttcagaacgtagtctctactcttcccctgcctgcatcaactgttgcaaatcccgtttctctctcccggtaaggggacaaattatactttattcaggtgatggttacatgaacagcccagacttcaccactacgcaatatatccatgtaacaaaaccgcacttgtactccctaaatctatagaaatacaaaatgaaataaaacggatgcaaatcagtca

SEQ ID NO: 728762 - DNA, 869 bp, Homo sapiens
gaggtagctctattaaacatgccaacttgacagatgagaaactgaggcacagggttaagtaacttgccacagagatctgattcccatttcatagatggagaaatggaagcatagagggattaagtaatttcccagggatcaccagcagtgcctgccacataggaagggctcaaaaaataatgttgggggcttttacaacgagatgccttactggggattttttttttctttgcagagtttgtgaagatgatgtctcgctgaggaggtcctggaagctccagaccctctccacctggtcaacatggagcaagcgcttgtggagaaccaaagcccaaaagccccagatccccttaaagcagagagggagggcaggcgggagggagggcattggcatgcggcgctgtgcatggggtgagacccagagcggtatctttgccaggatgggggcgtctgcagaactaggttaagaaggaagagtctgtggatggaaataggaagcgtgggagggtccagttgccacccccaaaaattccaatgattcttgacatcttttcacttcacgtagtcctaagtccctgtgacctgccagagtctcttccccagcttccccttgggtgaaaatagtctcttctcctgttgggtatcaaaaggttcagaacgtagtctctactcttcccctgcctgcatcaactgttgcaaatcccgtttctctctcccggtaaggggacaaattatactttattcaggtgatggttacatgaacagcccagacttcaccactacgcaatatatccatgtaacaaaaccgcacttgtactccctaaatctatagaaatacaaaatgaaataaaacggatgcaaatcagtca

SEQ ID NO: 728763 - DNA, 1065 bp, Homo sapiens
cccgcagcgccctcgcccagccccggctgcgtttccctgcccatgacccgctcgtggggacccccggcccggcccggaacttttctccccaacccccaaacccacgactcacttccacaccgtcttccccagcgtcccccgacccacttcatcctttccggccatccctcggaccttgacccccctgtccgcgccttcaaggctcccaactcaggcaccaggtccgcacctctcccgcgccccagagccggaaatttctccctcccagaccccgcgctgctcttctaacttctagatcttttctctcgcttctcagctgaatctctctgaccattcctctactggagcccccaatgaaagccgcaaacctatacccttgacgcccatacctgcctcagtttccccatccacacctggacgcaggccctgccgccctgagaccacagtccaaccccagaccatccctctggcctctgctgaatctcccagagtgtgtccatctggggatctaatcttcacccttcttgaagtctccgatctgtccctgatcccatccatgctcaggccttaggtctggccattcacacacacacacacccccacaccccactcccacacacagttcctactgtcttcagtccatggggatctcatcacccactcccagccccagctccagctgccctcacctctctagcagctctcacccctctgagtctacctaacctggagggggcttgaggggcacttcagggccctgccccctaatgtaacccctctctcaccccggcacaacctgggcttccacagtctggagctgccctacccccagattctctgagcactttcccccatccccagggccacagatccccttccttacttgttggggggaggtctggagcacctcgccaatgcccttcccccatccggctgggtccttccagttatttatttgtgtatttatttatttatctatttattattctatttaatctcttggcctcacccagggaccgtctggcttccccagctggactgggaggtcaggaagccaggcaagga

SEQ ID NO: 728764 - DNA, 430 bp, Homo sapiens
aggggttgcagtcagccgagatcgcaccactgcacttcagccacctgggtgacagagcgagactctgtttcaaaaataaataaataaataaaatagaattctgaattttatttttaataattattttgtaaaaagaatgtcttgttttttggagttgttgaatttattgaattgacaaaaattatgtacaagagggtacaacatgatgtgattgaagtatgtatacgttacaaaatggctaaatcaagctaaataacatcacctcccagacttatttttttatggtgagaacacttaaaaaatctgctctcttagtgatttccaagtgtatgttatgttattaactataggtaccatgttgtcccatgggatatcctgaacttattcttcctctctaaaaatgacattctctgtcctttggcatctgccc

SEQ ID NO: 728765 - DNA, 679 bp, Homo sapiens
aaccactcatggcaagacgggggcccaccggctggctggctcctcaccaaactctactccgcattgactgtgggctcttgttctagaggcacccgcatcctcaggatgaaatgtgagtacaagagcagagactgccggtgctggtgtgtgcagcctctgattcaacagaaatctggaagtgttcacagcttggcccggagaagatcgttttaaatctacagctttaaaatgtggttgaaaaggagcccaggttggattctgccagcaggtccgctggccgctgttacctccccactgtcaacgcctaggtctctgcctccagccctgtttcagcctgtccttgaggatttgcttcacctcatttactgagcttgccacagattcattacctggcatcagagctcccctctcactgagcctgcccagaagggtgccagtatactagccagatgccgctggagggactccacaataaagcctggctattaaagacttcaacagtctcataaagtcactttgccagctgtagagcacacaagtgcccacagatccaagcctccttccttccccaaagaaacaccttggataaagtcttggaatatcatccattagcacatggctccagccaacacatgaattcccttacaccagcacatggtctctctttcctgttcattca

SEQ ID NO: 728766 - DNA, 3124 bp, Homo sapiens; identical to SEQ ID NO: 381387

SEQ ID NO: 728767 - DNA, 2004 bp, Homo sapiens; identical to SEQ ID NO: 381388

SEQ ID NO: 728768 - DNA, 596 bp, Homo sapiens; identical to SEQ ID NO: 58830
  misc_feature (47)..(47): n is a, c, g, or t

SEQ ID NO: 728769 - DNA, 1319 bp, Homo sapiens; identical to SEQ ID NO: 81283
  misc_feature (494)..(494): n is a, c, g, or t

SEQ ID NO: 728770 - DNA, 1964 bp, Homo sapiens; identical to SEQ ID NO: 81284
  misc_feature (494)..(494): n is a, c, g, or t

SEQ ID NO: 728771 - DNA, 2110 bp, Homo sapiens
atggacgcggcactgctccacagcctgctggaggccaactgcagcctggcgctggctgaagagctgctcttggacggctgggggccacccctggaccccgagggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagcctctctggccagggccttactgggcccagagcagagaaggacctgtccaacacacacagctatttatagtagcagacacagggctcccctgccctactcatggagccagcagccaggcaatggtgtggccctgcactggcccttggactccacactcagtggtgccctgcagttgggtgggttaacgccaagcaaaggatcagtttggctgccttatcccagggctgtcacctagagaggctcacttgtaccccaccctgttcctgtgtcccctccccagccatcctccccgccttgggggctccatgaaggatgcaggcttccaggcctggcttcctctcttgggagaccccttctctgcctagtccacagattaggcaatcaaggaagacgccatcagggaagccacatccttagtcaaccagttgcatcgtgcggggcaaaatgaggagcagaggcatggaggagggaggcgtgggatgggaatagcagaaccaccatgtcttcagtgattgaaactcataccccattgccctttgccctccagtctccccttcagaaacatctctgctctctgtgaaataaaccatgcctcttgg

SEQ ID NO: 728772 - DNA, 480 bp, Homo sapiens; identical to SEQ ID NO: 83598

SEQ ID NO: 728773 - DNA, 2261 bp, Homo sapiens
ggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgcagccgggcagagccagatgcccaaagaccagcccctgtgggcacttctggagcagtactgccacaccatcatgaccctcaccaacctctcaggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagcctctctggccagggccttactgggcccagagcagagaaggacctgtccaacacacacagctatttatagtagcagacacagggctcccctgccctactcatggagccagcagccaggcaatggtgtggccctgcactggcccttggactccacactcagtggtgccctgcagttgggtgggttaacgccaagcaaaggatcagtttggctgccttatcccagggctgtcacctagagaggctcacttgtaccccaccctgttcctgtgtcccctccccagccatcctccccgccttgggggctccatgaaggatgcaggcttccaggcctggcttcctctcttgggagaccccttctctgcctagtccacagattaggcaatcaaggaagacgccatcagggaagccacatccttagtcaaccagttgcatcgtgcggggcaaaatgaggagcagaggcatggaggagggaggcgtgggatgggaatagcagaaccaccatgtcttcagtgattgaaactcataccccattgccctttgccctccagtctccccttcagaaacatctctgctctctgtgaaataaaccatgcctcttgg

SEQ ID NO: 728774 - DNA, 1811 bp, Homo sapiens
ggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgcagccgggcagagccagatgcccaaagaccagcccctgtgggcacttctggagcagtactgccacaccatcatgaccctcaccaacctctcaggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagttaactgattgaaagacatttttagtatgatatatatttttagtgccttttatgggatcctgctatatttaggggccttctagaattctgcttgcttggtgctgaatcttgctggttgatttttcctagttccttttctttgtttttctc

SEQ ID NO: 728775 - DNA, 870 bp, Homo sapiens
ggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgcagccgggcagagccagatgcccaaagaccagcccctgtgggcacttctggagcagtactgccacaccatcatgaccctcaccaacctctcaggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggcagccccacctcttgagagcccccagtgccggagcagaaaggaccctggacccagaggcagatactgcggggtggtagaaaaggtagagtaggctgtggcaatggaataaaacacgattaaaaacgttaaaaa

SEQ ID NO: 728776 - DNA, 581 bp, Homo sapiens
ggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgcagccgggcagagccagatgcccaaagaccagcccctgtgggcacttctggagcagtactgccacaccatcatgaccctcaccaacctctcaggctggtcttgaattcctgtgctcaagcaatctgcctaccttggcttccccaagtgctgagattatgggtgtgagccactgcacctggccaagaatccgaatggattcaaagataccttgaaataattcctcaatgcaacacacacacatatgccagggttggtcaaatgggaagagagccttggcctgaagacagggacctgggctttcctcagctcttctgccaaggtatctgtcctttcttagtgactcactgggctgaagtctagagcattccaatgggtgctggggatgggttagtgaaccaggaccagccctgcccttgggg

SEQ ID NO: 728777 - DNA, 2488 bp, Homo sapiens
ggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgcagccgggcagagccagatgcccaaagaccagcccctgtgggcacttctggagcagtactgccacaccatcatgaccctcaccaacctctcaggctggtcttgaattcctgtgctcaagcaatctgcctaccttggcttccccaagtgctgagattatgggtgtgagccactgcacctggccaagaatccgaatggattcaaagataccttgaaataattcctcaatgcaacacacacacatatgccagggttggtcaaatgggaagagagccttggcctgaagacagggacctgggctttcctcagctcttctgccaaggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagcctctctggccagggccttactgggcccagagcagagaaggacctgtccaacacacacagctatttatagtagcagacacagggctcccctgccctactcatggagccagcagccaggcaatggtgtggccctgcactggcccttggactccacactcagtggtgccctgcagttgggtgggttaacgccaagcaaaggatcagtttggctgccttatcccagggctgtcacctagagaggctcacttgtaccccaccctgttcctgtgtcccctccccagccatcctccccgccttgggggctccatgaaggatgcaggcttccaggcctggcttcctctcttgggagaccccttctctgcctagtccacagattaggcaatcaaggaagacgccatcagggaagccacatccttagtcaaccagttgcatcgtgcggggcaaaatgaggagcagaggcatggaggagggaggcgtgggatgggaatagcagaaccaccatgtcttcagtgattgaaactcataccccattgccctttgccctccagtctccccttcagaaacatctctgctctctgtgaaataaaccatgcctcttgg

SEQ ID NO: 728778 - DNA, 2038 bp, Homo sapiens
ggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgcagccgggcagagccagatgcccaaagaccagcccctgtgggcacttctggagcagtactgccacaccatcatgaccctcaccaacctctcaggctggtcttgaattcctgtgctcaagcaatctgcctaccttggcttccccaagtgctgagattatgggtgtgagccactgcacctggccaagaatccgaatggattcaaagataccttgaaataattcctcaatgcaacacacacacatatgccagggttggtcaaatgggaagagagccttggcctgaagacagggacctgggctttcctcagctcttctgccaaggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagttaactgattgaaagacatttttagtatgatatatatttttagtgccttttatgggatcctgctatatttaggggccttctagaattctgcttgcttggtgctgaatcttgctggttgatttttcctagttccttttctttgtttttctc

SEQ ID NO: 728779 - DNA, 1097 bp, Homo sapiens
ggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgcagccgggcagagccagatgcccaaagaccagcccctgtgggcacttctggagcagtactgccacaccatcatgaccctcaccaacctctcaggctggtcttgaattcctgtgctcaagcaatctgcctaccttggcttccccaagtgctgagattatgggtgtgagccactgcacctggccaagaatccgaatggattcaaagataccttgaaataattcctcaatgcaacacacacacatatgccagggttggtcaaatgggaagagagccttggcctgaagacagggacctgggctttcctcagctcttctgccaaggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggcagccccacctcttgagagcccccagtgccggagcagaaaggaccctggacccagaggcagatactgcggggtggtagaaaaggtagagtaggctgtggcaatggaataaaacacgattaaaaacgttaaaaa

SEQ ID NO: 728780 - DNA, 2167 bp, Homo sapiens
ggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagcctctctggccagggccttactgggcccagagcagagaaggacctgtccaacacacacagctatttatagtagcagacacagggctcccctgccctactcatggagccagcagccaggcaatggtgtggccctgcactggcccttggactccacactcagtggtgccctgcagttgggtgggttaacgccaagcaaaggatcagtttggctgccttatcccagggctgtcacctagagaggctcacttgtaccccaccctgttcctgtgtcccctccccagccatcctccccgccttgggggctccatgaaggatgcaggcttccaggcctggcttcctctcttgggagaccccttctctgcctagtccacagattaggcaatcaaggaagacgccatcagggaagccacatccttagtcaaccagttgcatcgtgcggggcaaaatgaggagcagaggcatggaggagggaggcgtgggatgggaatagcagaaccaccatgtcttcagtgattgaaactcataccccattgccctttgccctccagtctccccttcagaaacatctctgctctctgtgaaataaaccatgcctcttgg

SEQ ID NO: 728781 - DNA, 1717 bp, Homo sapiens
ggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagttaactgattgaaagacatttttagtatgatatatatttttagtgccttttatgggatcctgctatatttaggggccttctagaattctgcttgcttggtgctgaatcttgctggttgatttttcctagttccttttctttgtttttctc

SEQ ID NO: 728782 - DNA, 776 bp, Homo sapiens
ggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggcagccccacctcttgagagcccccagtgccggagcagaaaggaccctggacccagaggcagatactgcggggtggtagaaaaggtagagtaggctgtggcaatggaataaaacacgattaaaaacgttaaaaa

SEQ ID NO: 728783 - DNA, 2387 bp, Homo sapiens
aaatagattatttctattttattcatcacagaggcagctacatatatttgaaaaatattagggcatatattatgaggcatattatttatcctatccatagatgatataaaaatccaaatggactatttatttattttttattattttttgtaggctggtcttgaattcctgtgctcaagcaatctgcctaccttggcttccccaagtgctgagattatgggtgtgagccactgcacctggccaagaatccgaatggattcaaagataccttgaaataattcctcaatgcaacacacacacatatgccagggttggtcaaatgggaagagagccttggcctgaagacagggacctgggctttcctcagctcttctgccaaggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagcctctctggccagggccttactgggcccagagcagagaaggacctgtccaacacacacagctatttatagtagcagacacagggctcccctgccctactcatggagccagcagccaggcaatggtgtggccctgcactggcccttggactccacactcagtggtgccctgcagttgggtgggttaacgccaagcaaaggatcagtttggctgccttatcccagggctgtcacctagagaggctcacttgtaccccaccctgttcctgtgtcccctccccagccatcctccccgccttgggggctccatgaaggatgcaggcttccaggcctggcttcctctcttgggagaccccttctctgcctagtccacagattaggcaatcaaggaagacgccatcagggaagccacatccttagtcaaccagttgcatcgtgcggggcaaaatgaggagcagaggcatggaggagggaggcgtgggatgggaatagcagaaccaccatgtcttcagtgattgaaactcataccccattgccctttgccctccagtctccccttcagaaacatctctgctctctgtgaaataaaccatgcctcttgg

SEQ ID NO: 728784 - DNA, 1937 bp, Homo sapiens
aaatagattatttctattttattcatcacagaggcagctacatatatttgaaaaatattagggcatatattatgaggcatattatttatcctatccatagatgatataaaaatccaaatggactatttatttattttttattattttttgtaggctggtcttgaattcctgtgctcaagcaatctgcctaccttggcttccccaagtgctgagattatgggtgtgagccactgcacctggccaagaatccgaatggattcaaagataccttgaaataattcctcaatgcaacacacacacatatgccagggttggtcaaatgggaagagagccttggcctgaagacagggacctgggctttcctcagctcttctgccaaggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagttaactgattgaaagacatttttagtatgatatatatttttagtgccttttatgggatcctgctatatttaggggccttctagaattctgcttgcttggtgctgaatcttgctggttgatttttcctagttccttttctttgtttttctc

SEQ ID NO: 728785 - DNA, 996 bp, Homo sapiens
aaatagattatttctattttattcatcacagaggcagctacatatatttgaaaaatattagggcatatattatgaggcatattatttatcctatccatagatgatataaaaatccaaatggactatttatttattttttattattttttgtaggctggtcttgaattcctgtgctcaagcaatctgcctaccttggcttccccaagtgctgagattatgggtgtgagccactgcacctggccaagaatccgaatggattcaaagataccttgaaataattcctcaatgcaacacacacacatatgccagggttggtcaaatgggaagagagccttggcctgaagacagggacctgggctttcctcagctcttctgccaaggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggcagccccacctcttgagagcccccagtgccggagcagaaaggaccctggacccagaggcagatactgcggggtggtagaaaaggtagagtaggctgtggcaatggaataaaacacgattaaaaacgttaaaaa

SEQ ID NO: 728786 - DNA, 1660 bp, Homo sapiens
atggacgcggcactgctccacagcctgctggaggccaactgcagcctggcgctggctgaagagctgctcttggacggctgggggccacccctggaccccgagggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagttaactgattgaaagacatttttagtatgatatatatttttagtgccttttatgggatcctgctatatttaggggccttctagaattctgcttgcttggtgctgaatcttgctggttgatttttcctagttccttttctttgtttttctc

SEQ ID NO: 728787 - DNA, 719 bp, Homo sapiens
atggacgcggcactgctccacagcctgctggaggccaactgcagcctggcgctggctgaagagctgctcttggacggctgggggccacccctggaccccgagggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggcagccccacctcttgagagcccccagtgccggagcagaaaggaccctggacccagaggcagatactgcggggtggtagaaaaggtagagtaggctgtggcaatggaataaaacacgattaaaaacgttaaaaa

SEQ ID NO: 728788 - DNA, 1202 bp, Homo sapiens
gaaaaggataaggaagaggcccctggagagaggcaacagcatcagggaaggacctgttttggaagcagacagttccttgtcatgagggtggcagtcgacccatgagagcagaaagcagaggaggggatggtcccagaagcccagggttggtccctgggagccagctgagcctctgccttccccacaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagcctctctggccagggccttactgggcccagagcagagaaggacctgtccaacacacacagctatttatagtagcagacacagggctcccctgccctactcatggagccagcagccaggcaatggtgtggccctgcactggcccttggactccacactcagtggtgccctgcagttgggtgggttaacgccaagcaaaggatcagtttggctgccttatcccagggctgtcacctagagaggctcacttgtaccccaccctgttcctgtgtcccctccccagccatcctccccgccttgggggctccatgaaggatgcaggcttccaggcctggcttcctctcttgggagaccccttctctgcctagtccacagattaggcaatcaaggaagacgccatcagggaagccacatccttagtcaaccagttgcatcgtgcggggcaaaatgaggagcagaggcatggaggagggaggcgtgggatgggaatagcagaaccaccatgtcttcagtgattgaaactcataccccattgccctttgccctccagtctccccttcagaaacatctctgctctctgtgaaataaaccatgcctcttgg

SEQ ID NO: 728789 - DNA, 752 bp, Homo sapiens
gaaaaggataaggaagaggcccctggagagaggcaacagcatcagggaaggacctgttttggaagcagacagttccttgtcatgagggtggcagtcgacccatgagagcagaaagcagaggaggggatggtcccagaagcccagggttggtccctgggagccagctgagcctctgccttccccacaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagttaactgattgaaagacatttttagtatgatatatatttttagtgccttttatgggatcctgctatatttaggggccttctagaattctgcttgcttggtgctgaatcttgctggttgatttttcctagttccttttctttgtttttctc

SEQ ID NO: 728790 - DNA, 482 bp, Homo sapiens
gatctgggatgcagtggattaacaagggatgacgtatgactcttctgtgtttgtcagcatctaggctaggccctgatcccagggaacctgtgctgcaaatgtccactcattcattcattcgttcatttgttcatccatcaacctcctttcttcacaggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctg

SEQ ID NO: 728791 - DNA, 586 bp, Homo sapiens
  misc_feature (3)..(4): n is a, c, g, or t
  misc_feature (6)..(6): n is a, c, g, or t
  misc_feature (15)..(15): n is a, c, g, or t
tcnntntttgccagnaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctg

SEQ ID NO: 728792 - DNA, 897 bp, Homo sapiens
gcctttcacagagacacgtgcatgctgtaaaaatgagtctcggagacctgtgttaactcttgtggtcgtctttgaacccagatctgcctgctgtcatggtcttgttttaatcactgctgaggaggggagggggcacaactggatgaagtgatgacatgatgtttaggagacacagaactaggaagcatcgcaaaggccttctttttccactctcctcttccttcccgaatccattccccatgttaaaaaaggaaatttgaaggccagcacaggtgaaccactcagcgagtaagagactacaccagaggtggagttcaggccaggctgcctcagggcgcagagggaaatccaaatgggtaccttgttgtgagctgggggccaagtcctgactgtgttttcttgagcagggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctg

SEQ ID NO: 728793 - DNA, 1517 bp, Homo sapiens; identical to SEQ ID NO: 87905
  misc_feature (1284)..(1284): n is a, c, g, or t
  misc_feature (1299)..(1299): n is a, c, g, or t
  misc_feature (1436)..(1436): n is a, c, g, or t
  misc_feature (1512)..(1513): n is a, c, g, or t

SEQ ID NO: 728794 - DNA, 657 bp, Homo sapiens
  misc_feature (504)..(504): n is a, c, g, or t
  misc_feature (506)..(506): n is a, c, g, or t
cttcccatgggtgttggtcatccttctcttctctaagacagattgggactggccaggacccgactgttctcttcccctcaagctccctggcgagtggcctgttgcacagggttagggccacctgggaggggcaggagaggaaggaagccttgccttcctggaagtggtcatgggctgtggtccaggattctggctcagagttgcaccactgggttttatattcacttggatctttagttgttttggcgcctactgaggtctgaagtttgaatcctgcagtcaattgggatggtggcttgtaccccaaagtgccattgcaacccttgtccttcctgaggaaagggtggcagttgccctgtggaattcctgccctgctccccgtgggtgtccaggctgacagaagttgggtgagtggggccagctggatctaagccgtgtgagcattgggtggaggagtctgtctgcttagccctggagccatgggctgggaggcactcatgaggntncccatcagtctgagcagtctgcttgggccctatcatgagctgtgtgggtaggtggggagagtaactcctgtcctggcccctgccttggaggccagcgcactgcatgtctgcccagaatgtgtgttttggccagtgtccagccaggtccagt

SEQ ID NO: 728795 - DNA, 2804 bp, Homo sapiens; identical to SEQ ID NO: 53679

SEQ ID NO: 728796 - DNA, 2750 bp, Homo sapiens; identical to SEQ ID NO: 53680

SEQ ID NO: 728797 - DNA, 2745 bp, Homo sapiens
accactttcacaatctgctagcaaaggttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccatagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctaaaaataataataataatgctaacagaaagaagagaaccgttcgtttgcaatctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 728798 - DNA, 2691 bp, Homo sapiens
accactttcacaatctgctagcaaaggttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccatagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 728799 - DNA, 2748 bp, Homo sapiens
accactttcacaatctgctagcaaaggttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcattcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccatagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctaaaaataataataataatgctaacagaaagaagagaaccgttcgtttgcaatctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 728800 - DNA, 2694 bp, Homo sapiens
accactttcacaatctgctagcaaaggttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcattcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccatagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 728801 - DNA, 2779 bp, Homo sapiens
accactttcacaatctgctagcaaaggttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccatagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctaaaaataataataataatgctaacagaaagaagagaaccgttcgtttgcaatctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 728802 - DNA, 2725 bp, Homo sapiens; identical to SEQ ID NO: 53683

SEQ ID NO: 728803 - DNA, 2720 bp, Homo sapiens
accactttcacaatctgctagcaaaggttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccatagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctaaaaataataataataatgctaacagaaagaagagaaccgttcgtttgcaatctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 728804 - DNA, 2666 bp, Homo sapiens
accactttcacaatctgctagcaaaggttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccatagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 728805 - DNA, 2723 bp, Homo sapiens
accactttcacaatctgctagcaaaggttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcattcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccatagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctaaaaataataataataatgctaacagaaagaagagaaccgttcgtttgcaatctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 728806 - DNA, 2669 bp, Homo sapiens
accactttcacaatctgctagcaaaggttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcattcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccatagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 728807 - DNA, 2877 bp, Homo sapiens; identical to SEQ ID NO: 413943

SEQ ID NO: 728808 - DNA, 2823 bp, Homo sapiens
gtggcatccttccctttctaatcagagattttcttcctcagagattttggcctagatttgcaaaatgatgaccacatctttgatttgggggattgctatagcagcatgctgttgtctatggcttattcttggaattaggagaaggcaaacgggtgaaccacctctagagaatggattaattccatacctgggctgtgctctgcaatttggtgccaatcctcttgagttcctcagagcaaatcaaaggaaacatggtcatgtttttacctgcaaactaatgggaaaatatgtccatttcatcacaaatcccttgtcataccataaggtgttgtgccacggaaaatattttgattggaaaaaatttcactttgctacttctgcgaaggcatttgggcacagaagcattgacccgatggatggaaataccactgaaaacataaacgacactttcatcaaaaccctgcagggccatgccttgaattccctcacggaaagcatgatggaaaacctccaacgtatcatgagacctccagtctcctctaactcaaagaccgctgcctgggtgacagaagggatgtattctttctgctaccgagtgatgtttgaagctgggtatttaactatctttggcagagatcttacaaggcgggacacacagaaagcacatattctaaacaatcttgacaacttcaagcaattcgacaaagtctttccagccctggtagcaggcctccccattcacatgttcaggactgcgcacaatgcccgggagaaactggcagagagcttgaggcacgagaacctccaaaagagggaaagcatctcagaactgatcagcctgcgcatgtttctcaatgacactttgtccacctttgatgatctggagaaggccaagacacacctcgtggtcctctgggcatcgcaagcaaacaccattccagcgactttctggagtttatttcaaatgattaggaacccagaagcaatgaaagcagctactgaagaagtgaaaagaacattagagaatgctggtcaaaaagtcagcttggaaggcaatcctatttgtttgagtcaagcagaactgaatgacctgccagtattagatagtataatcaaggaatcgctgaggctttccagtgcctccctcaacatccggacagctaaggaggatttcactttgcaccttgaggacggttcctacaacatccgaaaagatgacatcatagctctttacccacagttaatgcacttagatccagaaatctacccagaccctttgacttttaaatatgataggtatcttgatgaatacatgccctttggatcgggagctacaatatgtcctggaagattgttcgctatccacgaaatcaagcaatttttgattctgatgctttcttattttgaattggagcttatagagggccaagctaaatgtccacctttggaccagtcccgggcaggcttgggcattttgccgccattgaatgatattgaatttaaatataaattcaagcatttgtgaatacatggctggaataagaggacactagatgatattacaggactgcagaacaccctcaccacacagtccctttggacaaatgcatttagtggtggtagaaatgattcaccaggtccaatgttgttcaccagtgcttgcttgtgaatcttaacattttggtgacagtttccagatgctatcacagactctgctagtgaaaagaactagtttctaggagcacaataatttgttttcatttgtataagtccatgaatgttcatatagccagggattgaagtttattattttcaaaggaaaacacctttattttattttttttcaaaatgaagatacacattacagccaggtgtggtagcaggcacctgtagtcttagctactcgagaggccaaagaaggaggatggcttgagcccaggagttcaagaccagcctggacagcttagtgagatcccgtctccgaagaaaagatatgtattctaattggcagattgttttttcctaaggaaactgctttatttttataaaactgcctgacaattatgaaaaaatgttcaaattcacgttctagtgaaactgcattatttgttgactagatggtggggttcttcgggtgtgatcatatatcataaaggatatttcaaatgattatgattagttatgtcttttaataaaaaggaaatatttttcaacttcttctatatccaaaattcagggctttaaacatgattatcttgatttcccaaaaacactaaaggtggttttattttcccttcatgttttaacttattgttgctgaaaactctatgtccggctttaactatcttctctatatttttatttcattcacattaatgagaagagttttctcagagattaaaaaaggtagtttttctgtcattgttaaatacacattatcactgaaaaaatgtagcttttatgatgtatgttttaaagttaaaactggatggaaatagccatttggaagctttggttatgaaacatgtggagtgtattaagtgcagcttgacattatgttttatttaaatgctttttatcgctaaatgacttgcagatgaaaaaaactaaggtgactcgagtgtttaaatgcctgtgtacaacaatgctttgataaaatattttaaggtatgagttatcagctctatgtcaattgatatttctgtgtagtatttatatttaaattatatttacctttttgcttattttacaaatattaagaaaatattctaacatttgataattttgaaatgattcatctttcagaaataaaagtatgaatct

SEQ ID NO: 728809 - DNA, 2822 bp, Homo sapiens
gtggcatccttccctttctaatcagagattttcttcctcagagattttggcctagatttgcaaaatgatgaccacatctttgatttgggggattgctatagcagcatgctgttgtctatggcttattcttggaattaggagaaggcaaacgggtgaaccacctctagagaatggattaattccatacctgggctgtgctctgcaatttggtgccaatcctcttgagttcctcagagcaaatcaaaggaaacatggtcatgtttttacctgcaaactaatgggaaaatatgtccatttcatcacaaatcccttgtcataccataaggtgttgtgccacggaaaatattttgattggaaaaaatttcactttgctacttctgcgaaggcatttgggcacagaagcattgacccgatggatggaaataccactgaaaacataaacgacactttcatcaaaaccctgcagggccatgccttgaattccctcacggaaagcatgatggaaaacctccaacgtatcatgagacctccagtctcctctaactctttgaagctgggtatttaactatctttggcagagatcttacaaggcgggacacacagaaagcacatattctaaacaatcttgacaacttcaagcaattcgacaaagtctttccagccctggtagcaggcctccccattcacatgttcaggactgcgcacaatgcccgggagaaactggcagagagcttgaggcacgagaacctccaaaagagggaaagcatctcagaactgatcagcctgcgcatgtttctcaatgacactttgtccacctttgatgatctggagaaggccaagacacacctcgtggtcctctgggcatcgcaagcaaacaccattccagcgactttctggagtttatttcaaatgattaggaacccagaagcaatgaaagcagctactgaagaagtgaaaagaacattagagaatgctggtcaaaaagtcagcttggaaggcaatcctatttgtttgagtcaagcagaactgaatgacctgccagtattagatagtataatcaaggaatcgctgaggctttccagtgcctccctcaacatccggacagctaaggaggatttcactttgcaccttgaggacggttcctacaacatccgaaaagatgacatcatagctctttacccacagttaatgcacttagatccagaaatctacccagaccctttgacttttaaatatgataggtatcttgatgaaaacgggaagacaaagactaccttctattgtaatggactcaagttaaagtattactacatgccctttggatcgggagctacaatatgtcctggaagattgttcgctatccacgaaatcaagcaatttttgattctgatgctttcttattttgaattggagcttatagagggccaagctaaatgtccacctttggaccagtcccgggcaggcttgggcattttgccgccattgaatgatattgaatttaaatataaattcaagcatttgtgaatacatggctggaataagaggacactagatgatattacaggactgcagaacaccctcaccacacagtccctttggacaaatgcatttagtggtggtagaaatgattcaccaggtccaatgttgttcaccagtgcttgcttgtgaatcttaacattttggtgacagtttccagatgctatcacagactctgctagtgaaaagaactagtttctaggagcacaataatttgttttcatttgtataagtccatgaatgttcatatagccagggattgaagtttattattttcaaaggaaaacacctttattttattttttttcaaaatgaagatacacattacagccaggtgtggtagcaggcacctgtagtcttagctactcgagaggccaaagaaggaggatggcttgagcccaggagttcaagaccagcctggacagcttagtgagatcccgtctccgaagaaaagatatgtattctaattggcagattgttttttcctaaggaaactgctttatttttataaaactgcctgacaattatgaaaaaatgttcaaattcacgttctagtgaaactgcattatttgttgactagatggtggggttcttcgggtgtgatcatatatcataaaggatatttcaaatgattatgattagttatgtcttttaataaaaaggaaatatttttcaacttcttctatatccaaaattcagggctttaaacatgattatcttgatttcccaaaaacactaaaggtggttttattttcccttcatgttttaacttattgttgctgaaaactctatgtccggctttaactatcttctctatatttttatttcattcacattaatgagaagagttttctcagagattaaaaaaggtagtttttctgtcattgttaaatacacattatcactgaaaaaatgtagcttttatgatgtatgttttaaagttaaaactggatggaaatagccatttggaagctttggttatgaaacatgtggagtgtattaagtgcagcttgacattatgttttatttaaatgctttttatcgctaaatgacttgcagatgaaaaaaactaaggtgactcgagtgtttaaatgcctgtgtacaacaatgctttgataaaatattttaaggtatgagttatcagctctatgtcaattgatatttctgtgtagtatttatatttaaattatatttacctttttgcttattttacaaatattaagaaaatattctaacatttgataattttgaaatgattcatctttcagaaataaaagtatgaatct

SEQ ID NO: 728810 - DNA, 2768 bp, Homo sapiens; identical to SEQ ID NO: 413944

SEQ ID NO: 728811 - DNA, 2815 bp, Homo sapiens
gtggcatccttccctttctaatcagagattttcttcctcagagattttggcctagatttgcaaaatgatgaccacatctttgatttgggggattgctatagcagcatgctgttgtctatggcttattcttggaattaggagaaggcaaacgggtgaaccacctctagagaatggattaattccatacctgggctgtgctctgcaatttggtgccaatcctcttgagttcctcagagcaaatcaaaggaaacatggtcatgtttttacctgcaaactaatgggaaaatatgtccatttcatcacaaatcccttgtcataccataaggtgttgtgccacggaaaatattttgattggaaaaaatttcactttgctacttctgcgaaggcatttgggcacagaagcattgacccgatggatggaaataccactgaaaacataaacgacactccaacgtatcatgagacctccagtctcctctaactcaaagaccgctgcctgggtgacagaagggatgtattctttctgctaccgagtgatgtttgaagctgggtatttaactatctttggcagagatcttacaaggcgggacacacagaaagcacatattctaaacaatcttgacaacttcaagcaattcgacaaagtctttccagccctggtagcaggcctccccattcacatgttcaggactgcgcacaatgcccgggagaaactggcagagagcttgaggcacgagaacctccaaaagagggaaagcatctcagaactgatcagcctgcgcatgtttctcaatgacactttgtccacctttgatgatctggagaaggccaagacacacctcgtggtcctctgggcatcgcaagcaaacaccattccagcgactttctggagtttatttcaaatgattaggaacccagaagcaatgaaagcagctactgaagaagtgaaaagaacattagagaatgctggtcaaaaagtcagcttggaaggcaatcctatttgtttgagtcaagcagaactgaatgacctgccagtattagatagtataatcaaggaatcgctgaggctttccagtgcctccctcaacatccggacagctaaggaggatttcactttgcaccttgaggacggttcctacaacatccgaaaagatgacatcatagctctttacccacagttaatgcacttagatccagaaatctacccagaccctttgacttttaaatatgataggtatcttgatgaaaacgggaagacaaagactaccttctattgtaatggactcaagttaaagtattactacatgccctttggatcgggagctacaatatgtcctggaagattgttcgctatccacgaaatcaagcaatttttgattctgatgctttcttattttgaattggagcttatagagggccaagctaaatgtccacctttggaccagtcccgggcaggcttgggcattttgccgccattgaatgatattgaatttaaatataaattcaagcatttgtgaatacatggctggaataagaggacactagatgatattacaggactgcagaacaccctcaccacacagtccctttggacaaatgcatttagtggtggtagaaatgattcaccaggtccaatgttgttcaccagtgcttgcttgtgaatcttaacattttggtgacagtttccagatgctatcacagactctgctagtgaaaagaactagtttctaggagcacaataatttgttttcatttgtataagtccatgaatgttcatatagccagggattgaagtttattattttcaaaggaaaacacctttattttattttttttcaaaatgaagatacacattacagccaggtgtggtagcaggcacctgtagtcttagctactcgagaggccaaagaaggaggatggcttgagcccaggagttcaagaccagcctggacagcttagtgagatcccgtctccgaagaaaagatatgtattctaattggcagattgttttttcctaaggaaactgctttatttttataaaactgcctgacaattatgaaaaaatgttcaaattcacgttctagtgaaactgcattatttgttgactagatggtggggttcttcgggtgtgatcatatatcataaaggatatttcaaatgattatgattagttatgtcttttaataaaaaggaaatatttttcaacttcttctatatccaaaattcagggctttaaacatgattatcttgatttcccaaaaacactaaaggtggttttattttcccttcatgttttaacttattgttgctgaaaactctatgtccggctttaactatcttctctatatttttatttcattcacattaatgagaagagttttctcagagattaaaaaaggtagtttttctgtcattgttaaatacacattatcactgaaaaaatgtagcttttatgatgtatgttttaaagttaaaactggatggaaatagccatttggaagctttggttatgaaacatgtggagtgtattaagtgcagcttgacattatgttttatttaaatgctttttatcgctaaatgacttgcagatgaaaaaaactaaggtgactcgagtgtttaaatgcctgtgtacaacaatgctttgataaaatattttaaggtatgagttatcagctctatgtcaattgatatttctgtgtagtatttatatttaaattatatttacctttttgcttattttacaaatattaagaaaatattctaacatttgataattttgaaatgattcatctttcagaaataaaagtatgaatct

SEQ ID NO: 728812 - DNA, 2761 bp, Homo sapiens; identical to SEQ ID NO: 413945

SEQ ID NO: 728813 - DNA, 2760 bp, Homo sapiens
gtggcatccttccctttctaatcagagattttcttcctcagagattttggcctagatttgcaaaatgatgaccacatctttgatttgggggattgctatagcagcatgctgttgtctatggcttattcttggaattaggagaaggcaaacgggtgaaccacctctagagaatggattaattccatacctgggctgtgctctgcaatttggtgccaatcctcttgagttcctcagagcaaatcaaaggaaacatggtcatgtttttacctgcaaactaatgggaaaatatgtccatttcatcacaaatcccttgtcataccataaggtgttgtgccacggaaaatattttgattggaaaaaatttcactttgctacttctgcgaaggcatttgggcacagaagcattgacccgatggatggaaataccactgaaaacataaacgacactccaacgtatcatgagacctccagtctcctctaactctttgaagctgggtatttaactatctttggcagagatcttacaaggcgggacacacagaaagcacatattctaaacaatcttgacaacttcaagcaattcgacaaagtctttccagccctggtagcaggcctccccattcacatgttcaggactgcgcacaatgcccgggagaaactggcagagagcttgaggcacgagaacctccaaaagagggaaagcatctcagaactgatcagcctgcgcatgtttctcaatgacactttgtccacctttgatgatctggagaaggccaagacacacctcgtggtcctctgggcatcgcaagcaaacaccattccagcgactttctggagtttatttcaaatgattaggaacccagaagcaatgaaagcagctactgaagaagtgaaaagaacattagagaatgctggtcaaaaagtcagcttggaaggcaatcctatttgtttgagtcaagcagaactgaatgacctgccagtattagatagtataatcaaggaatcgctgaggctttccagtgcctccctcaacatccggacagctaaggaggatttcactttgcaccttgaggacggttcctacaacatccgaaaagatgacatcatagctctttacccacagttaatgcacttagatccagaaatctacccagaccctttgacttttaaatatgataggtatcttgatgaaaacgggaagacaaagactaccttctattgtaatggactcaagttaaagtattactacatgccctttggatcgggagctacaatatgtcctggaagattgttcgctatccacgaaatcaagcaatttttgattctgatgctttcttattttgaattggagcttatagagggccaagctaaatgtccacctttggaccagtcccgggcaggcttgggcattttgccgccattgaatgatattgaatttaaatataaattcaagcatttgtgaatacatggctggaataagaggacactagatgatattacaggactgcagaacaccctcaccacacagtccctttggacaaatgcatttagtggtggtagaaatgattcaccaggtccaatgttgttcaccagtgcttgcttgtgaatcttaacattttggtgacagtttccagatgctatcacagactctgctagtgaaaagaactagtttctaggagcacaataatttgttttcatttgtataagtccatgaatgttcatatagccagggattgaagtttattattttcaaaggaaaacacctttattttattttttttcaaaatgaagatacacattacagccaggtgtggtagcaggcacctgtagtcttagctactcgagaggccaaagaaggaggatggcttgagcccaggagttcaagaccagcctggacagcttagtgagatcccgtctccgaagaaaagatatgtattctaattggcagattgttttttcctaaggaaactgctttatttttataaaactgcctgacaattatgaaaaaatgttcaaattcacgttctagtgaaactgcattatttgttgactagatggtggggttcttcgggtgtgatcatatatcataaaggatatttcaaatgattatgattagttatgtcttttaataaaaaggaaatatttttcaacttcttctatatccaaaattcagggctttaaacatgattatcttgatttcccaaaaacactaaaggtggttttattttcccttcatgttttaacttattgttgctgaaaactctatgtccggctttaactatcttctctatatttttatttcattcacattaatgagaagagttttctcagagattaaaaaaggtagtttttctgtcattgttaaatacacattatcactgaaaaaatgtagcttttatgatgtatgttttaaagttaaaactggatggaaatagccatttggaagctttggttatgaaacatgtggagtgtattaagtgcagcttgacattatgttttatttaaatgctttttatcgctaaatgacttgcagatgaaaaaaactaaggtgactcgagtgtttaaatgcctgtgtacaacaatgctttgataaaatattttaaggtatgagttatcagctctatgtcaattgatatttctgtgtagtatttatatttaaattatatttacctttttgcttattttacaaatattaagaaaatattctaacatttgataattttgaaatgattcatctttcagaaataaaagtatgaatct

SEQ ID NO: 728814 - DNA, 2706 bp, Homo sapiens
gtggcatccttccctttctaatcagagattttcttcctcagagattttggcctagatttgcaaaatgatgaccacatctttgatttgggggattgctatagcagcatgctgttgtctatggcttattcttggaattaggagaaggcaaacgggtgaaccacctctagagaatggattaattccatacctgggctgtgctctgcaatttggtgccaatcctcttgagttcctcagagcaaatcaaaggaaacatggtcatgtttttacctgcaaactaatgggaaaatatgtccatttcatcacaaatcccttgtcataccataaggtgttgtgccacggaaaatattttgattggaaaaaatttcactttgctacttctgcgaaggcatttgggcacagaagcattgacccgatggatggaaataccactgaaaacataaacgacactccaacgtatcatgagacctccagtctcctctaactctttgaagctgggtatttaactatctttggcagagatcttacaaggcgggacacacagaaagcacatattctaaacaatcttgacaacttcaagcaattcgacaaagtctttccagccctggtagcaggcctccccattcacatgttcaggactgcgcacaatgcccgggagaaactggcagagagcttgaggcacgagaacctccaaaagagggaaagcatctcagaactgatcagcctgcgcatgtttctcaatgacactttgtccacctttgatgatctggagaaggccaagacacacctcgtggtcctctgggcatcgcaagcaaacaccattccagcgactttctggagtttatttcaaatgattaggaacccagaagcaatgaaagcagctactgaagaagtgaaaagaacattagagaatgctggtcaaaaagtcagcttggaaggcaatcctatttgtttgagtcaagcagaactgaatgacctgccagtattagatagtataatcaaggaatcgctgaggctttccagtgcctccctcaacatccggacagctaaggaggatttcactttgcaccttgaggacggttcctacaacatccgaaaagatgacatcatagctctttacccacagttaatgcacttagatccagaaatctacccagaccctttgacttttaaatatgataggtatcttgatgaatacatgccctttggatcgggagctacaatatgtcctggaagattgttcgctatccacgaaatcaagcaatttttgattctgatgctttcttattttgaattggagcttatagagggccaagctaaatgtccacctttggaccagtcccgggcaggcttgggcattttgccgccattgaatgatattgaatttaaatataaattcaagcatttgtgaatacatggctggaataagaggacactagatgatattacaggactgcagaacaccctcaccacacagtccctttggacaaatgcatttagtggtggtagaaatgattcaccaggtccaatgttgttcaccagtgcttgcttgtgaatcttaacattttggtgacagtttccagatgctatcacagactctgctagtgaaaagaactagtttctaggagcacaataatttgttttcatttgtataagtccatgaatgttcatatagccagggattgaagtttattattttcaaaggaaaacacctttattttattttttttcaaaatgaagatacacattacagccaggtgtggtagcaggcacctgtagtcttagctactcgagaggccaaagaaggaggatggcttgagcccaggagttcaagaccagcctggacagcttagtgagatcccgtctccgaagaaaagatatgtattctaattggcagattgttttttcctaaggaaactgctttatttttataaaactgcctgacaattatgaaaaaatgttcaaattcacgttctagtgaaactgcattatttgttgactagatggtggggttcttcgggtgtgatcatatatcataaaggatatttcaaatgattatgattagttatgtcttttaataaaaaggaaatatttttcaacttcttctatatccaaaattcagggctttaaacatgattatcttgatttcccaaaaacactaaaggtggttttattttcccttcatgttttaacttattgttgctgaaaactctatgtccggctttaactatcttctctatatttttatttcattcacattaatgagaagagttttctcagagattaaaaaaggtagtttttctgtcattgttaaatacacattatcactgaaaaaatgtagcttttatgatgtatgttttaaagttaaaactggatggaaatagccatttggaagctttggttatgaaacatgtggagtgtattaagtgcagcttgacattatgttttatttaaatgctttttatcgctaaatgacttgcagatgaaaaaaactaaggtgactcgagtgtttaaatgcctgtgtacaacaatgctttgataaaatattttaaggtatgagttatcagctctatgtcaattgatatttctgtgtagtatttatatttaaattatatttacctttttgcttattttacaaatattaagaaaatattctaacatttgataattttgaaatgattcatctttcagaaataaaagtatgaatct

SEQ ID NO: 728815 - DNA, 1496 bp, Homo sapiens
agtctgggcgtagagggtgcagggagcagacgggaggatctcaggccagggacgatggcggctctgcaggagaagaagacgtgtggccagcgcatggaggagttccagcgttactgctggaacccggacacggggcagatgctgggccgcaccctgtcccggtgggtgtggatcagcctgtactacgtggccttctacgtggtgatgactgggctcttcgccctgtgcctctatgtgctgatgcagacagtggacccgtacacaccggactaccaagaccagctacggtcaccaggggtaaccttaaggccggatgtttacggggagaaaggcctggaaattgtctacaacgtctctgataacagaacctgggcagacctcacacagactctccacgccttcctagcaggctactctccagcagcccaggaggacagcatcaactgcacctccgagcagtacttcttccaggagagtttccgcgctcccaaccacaccaagttctcctgcaagttcacggcagatatgctgcagaactgctcaggcctggcggatcccaacttcggctttgaagaaggaaagccatgttttattattaaaatgaacaggatcgtcaagttcctccccagcaacggctcggcccccagagtggactgcgccttcctggaccagccccgcgagctcggccagccgctgcaggtcaagtactaccctcccaacggcaccttcagtctgcactacttcccttattacgggaagaaagcccagccccactacagcaaccccctggtggcagcgaagctcctcaacatccccaggaacgctgaggtcgccatcgtgtgcaaggtcatggcagagcacgtgaccttcaacaatccccacgacccgtatgaagggaaagtggagttcaaactcaagattgagaagtgaaacgtttgcgcaggggtcctgggcacgcctgcggggtcgctcaaggacaccctcctggttgggcttaccttgcccgtcagttccctgccaaatcatccccaaagtggtttggagcaacggtgttgtcagtgtgcgaactccagagaagcgcccacatctgaaggacctgctcgcgagtatcagttcttccttgttgaattcttacagtttttagatggaatttgctgctataagaatgtccagctaccatgggaacgcaaggcagcaactctctaattaaccaggtcataaaaacgattcgtcttctatgtagacatcactttcttactataatttatttttctacacttcaatatgaactgccccccccacattaatataaaaactactaatgcactgatatgaaacacggcttacactaatgacattctgaattcttgcttttaaaattgcaattcctaagttgtaaacataaaatatattaaagttactcttattgtatgtaaaaaaagaaatcgtgtttcctgatatgggagaaattaaataaaaaccaaacgcttccttaa

SEQ ID NO: 728816 - DNA, 1288 bp, Homo sapiens; identical to SEQ ID NO: 63371

SEQ ID NO: 728817 - DNA, 1283 bp, Homo sapiens
agcgggcgcgggggcgcccctgcccaccgctcccggcagggcttttggtggccatgggggataaggggcgttgactcacccgggcggggctccgggagttgcacagaccaaggccctgtgcctccctctacagccctcagggagctcattgaggagctggtcaacatcacccagaaccagaaggctccgctctgcaatggcagcatggtatggagcatcaacctgacagctggcatgtactgtgcagccctggaatccctgatcaacgtgtcaggctgcagtgccatcgagaagacccagaggatgctgagcggattctgcccgcacaaggtctcagctgggcagttttccagcttgcatgtccgagacaccaaaatcgaggtggcccagtttgtaaaggacctgctcttacatttaaagaaactttttcgcgagggacggttcaactgaaacttcgaaagcatcattatttgcagagacaggacctgactattgaagttgcagattcatttttctttctgatgtcaaaaatgtcttgggtaggcgggaaggagggttagggaggggtaaaattccttagcttagacctcagcctgtgctgcccgtcttcagcctagccgacctcagccttccccttgcccagggctcagcctggtgggcctcctctgtccagggccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctggcacttggagccaagggttcagagactcagggccccagcactaaagcagtggaccccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttcctcgtatttaaatattaaatatgttagcaaagagttaatatatagaagggtaccttgaacactgggggaggggacattgaacaagttgtttcattgactatcaaactgaagccagaaataaagttggtgacagataggcct

SEQ ID NO: 728818 - DNA, 4090 bp, Homo sapiens; identical to SEQ ID NO: 414265

SEQ ID NO: 728819 - DNA, 1917 bp, Homo sapiens
  misc_feature (420)..(420): n is a, c, g, or t
  misc_feature (516)..(516): n is a, c, g, or t
cgctgaggctctggcacctgaaggagccctgggaggatggcgatgttgcctatggatgcagctgcctccgtaagtatcctcttgcagctggtccagcgatgctctcttctccccttccaggctctccttccttctcagacaagatgtcttatcagaaaaagcagcccacccctcagcccccagtggactgcgtgaagacctctggcggcggtggcggtggcggcggcaggcggcggtggtggctgcggcttcttcggcggcggcggctcagggggcggtagcagcggttctggctgcggctactccggcggcggtggctactctggcggcggctgcggcgggggctcctccggcggcgggggcgggggcggcattggaggctgcggagggggctccggtgggagcgtcaagtactccggnggcggcggctcctccggcgggggctctggctgtttctccagcggtgggggcggctccggctgcttctcctccggtggcggcggctcctccgggggnggctccggctgcttctccagcggtgggggcggctcctccgggggcggctccggctgcttctcctccggcggcggcggcttctcgggccaggcggtccagtgccagagctacggaggcgtctctagcggcggctcctccgggggcggctccggctgcttctccagcggcgggggcggcggctctgtctgcggctactctggcggcggctctggcggcggctctggctgcggcggaggctcctctggcggcagcggctccggctacgtctcctcgcagcaggtcactcagacctcgtgcgcgccccagccgagttacggaggggggtcgtccggcggcggcggcagcggcggaagcggctgcttctccagcggcgggggcggcgggagctccggctgcggcggcggctcctccgggattggcagcggctgcatcatcagtggcgggggctccgtctgcggaggtggttcctctggaggcggcggcggcggctcctccgtgggtggctccgggagtggcaagggcgtcccgatctgccaccagacccagcagaagcaggcgcctacctggccgtccaaatagatcccccagggtaccacggaggcgaaggagttggaggtgttttccaggggcaccgatgggcttagagctctcatgatgctacccgaggtttgcaaatccttcatgtcttaacctacctggaagaagccattgagctctccggctgcatctagttctgctgtttagcctctttggtttctgtacaactacctcccaaccccagtgcctcagtcaataaatttgcaaattcatgagaaaaaacaaaaaaaaaaaaaaaaaaaaaaaaaaaaaaaaaaaaaaaaaaaaaaaaaaaaaaaaaagaaacaaaaaaaagaaagaaaaaaacacaaaacgaacaaacagacaacaaaaacaataacaacaccacagaagaacaccagggaaagcggacggtgggcgcgcgccatgcatcactcactccaccacgaggccgcaccggcacaactgaccacagccacaccaccgagcttatcgttatcgccaagccacgccgagacccactagtagagtgagaaacaattaatacagacccgacgcgacgcggacgcccatctctattcaatacactccgaagaaaaaccaaccctaccacccacgacaccatcgccacgacatcacatatacactaacacactacaccaacagacacaacccccactgactacgacccttgcacaaacaccaatcagacaagcccgcgccactacccccacacatccacgaacaacgcgtcttgtttcaccacggatatcatcaccaacaaaccaatccaactcgtcacccccgtccatccgcacgccacacactcagaagagcccaaac

SEQ ID NO: 728820 - DNA, 1828 bp, Homo sapiens
  misc_feature (331)..(331): n is a, c, g, or t
  misc_feature (427)..(427): n is a, c, g, or t
ctctcctcactcacccttcctggtgctttgggctctccttccttctcagacaagatgtcttatcagaaaaagcagcccacccctcagcccccagtggactgcgtgaagacctctggcggcggtggcggtggcggcggcaggcggcggtggtggctgcggcttcttcggcggcggcggctcagggggcggtagcagcggttctggctgcggctactccggcggcggtggctactctggcggcggctgcggcgggggctcctccggcggcgggggcgggggcggcattggaggctgcggagggggctccggtgggagcgtcaagtactccggnggcggcggctcctccggcgggggctctggctgtttctccagcggtgggggcggctccggctgcttctcctccggtggcggcggctcctccgggggnggctccggctgcttctccagcggtgggggcggctcctccgggggcggctccggctgcttctcctccggcggcggcggcttctcgggccaggcggtccagtgccagagctacggaggcgtctctagcggcggctcctccgggggcggctccggctgcttctccagcggcgggggcggcggctctgtctgcggctactctggcggcggctctggcggcggctctggctgcggcggaggctcctctggcggcagcggctccggctacgtctcctcgcagcaggtcactcagacctcgtgcgcgccccagccgagttacggaggggggtcgtccggcggcggcggcagcggcggaagcggctgcttctccagcggcgggggcggcgggagctccggctgcggcggcggctcctccgggattggcagcggctgcatcatcagtggcgggggctccgtctgcggaggtggttcctctggaggcggcggcggcggctcctccgtgggtggctccgggagtggcaagggcgtcccgatctgccaccagacccagcagaagcaggcgcctacctggccgtccaaatagatcccccagggtaccacggaggcgaaggagttggaggtgttttccaggggcaccgatgggcttagagctctcatgatgctacccgaggtttgcaaatccttcatgtcttaacctacctggaagaagccattgagctctccggctgcatctagttctgctgtttagcctctttggtttctgtacaactacctcccaaccccagtgcctcagtcaataaatttgcaaattcatgagaaaaaacaaaaaaaaaaaaaaaaaaaaaaaaaaaaaaaaaaaaaaaaaaaaaaaaaaaaaaaaaagaaacaaaaaaaagaaagaaaaaaacacaaaacgaacaaacagacaacaaaaacaataacaacaccacagaagaacaccagggaaagcggacggtgggcgcgcgccatgcatcactcactccaccacgaggccgcaccggcacaactgaccacagccacaccaccgagcttatcgttatcgccaagccacgccgagacccactagtagagtgagaaacaattaatacagacccgacgcgacgcggacgcccatctctattcaatacactccgaagaaaaaccaaccctaccacccacgacaccatcgccacgacatcacatatacactaacacactacaccaacagacacaacccccactgactacgacccttgcacaaacaccaatcagacaagcccgcgccactacccccacacatccacgaacaacgcgtcttgtttcaccacggatatcatcaccaacaaaccaatccaactcgtcacccccgtccatccgcacgccacacactcagaagagcccaaac

SEQ ID NO: 728821 - DNA, 527 bp, Homo sapiens
atggcgtttgatcttacggtaccacctagtggacaagatagtgcactgcatgagaccattgctacagccagaaaacagggagatcttgaggcatggcaatatccggtaatgttacaaccgatgccggccgggaaaggcagtcaagcaggagttaaacaatatggacctaactctccttatatgagaacattattaaattccattgctcatggaaatagacttatttcttatgattgggaaattctggctaaatcttccctttcaccctctcagtatctccagtttaaaacctggtggattgatggggtacaagaacaggtacgaaaaaatcaggctactaatcctgttgcttatatagatgaagaccaattgctaggaagaggtccaaactgggacactattaaccaacaatcagtaatgaaaatgaggctattgaacaactataagggctatttgcctcagggcctgggaaaacattcaggacccaggaacctcatgcccttcttttagttcaatcagacaaggct

SEQ ID NO: 728822 - DNA, 470 bp, Homo sapiens
tactgtacattccaacttttttgaaataattaagtagaagtcggccagtgcggtggctcacgcctgtagtcccagctacttgggaggctgaggcacaattgcttgaacccgggaggcggaggttgcggtgagtcgagatcacaccactgcactccagccttggcgatagagggagactccatctcaaaaaaataaaataaaataaaaataaataagatttaaaaaataaaaaaaagagggttgctgcatctgagactgcaggttctactctgggttctggaaagaggacagaccagaactaggctctccttggtaccagcagagagccaagggactgcagcacaggagggaaggaagcccctggaggccagttagggcagccactagcagtgccttcatgagaaaagtaccctccagattcaatgcagccctggggacacttgtcctggcaagaaaagagtgtcctcgtg

SEQ ID NO: 728823 - DNA, 672 bp, Homo sapiens; identical to SEQ ID NO: 30557

SEQ ID NO: 728824 - DNA, 726 bp, Homo sapiens; identical to SEQ ID NO: 30556

SEQ ID NO: 728825 - DNA, 672 bp, Homo sapiens; identical to SEQ ID NO: 30558

SEQ ID NO: 728826 - DNA, 618 bp, Homo sapiens
attattttgctcagaggtttgtggactttgcatactgattctttcctgtttccaagtacatttgcttttaggctatttttattcactttaaaggaattttaataactttctgttgacagcatggacagctggtcttgagaattaaagaaaattcacttgctgactgaggaaggaagtgacatcaatgagcttctaaagtcagcccagcgggggaaattggctggtgagagagtagcctttcattgcactgtatttatcgagcgatgccttgagatgcaaattgctgtatcaatcaaacctgtggtgcctacctccaaccaacccagtgcaaactgaaggaacaatgccctgaaacactgagaatatgctctctcaccaagcctatacttcattctctgtcaaacctcagtttctttgtctagaaaatgaaggaccaggtactaatatagatagtgtagacatgctatctcagtacgtttgtcccaaagagagctatcaattgctttttatcccctactgagagctatttagaaataggaatttttagctgtcatacttagctactaccttgatcctttgttttaaaaccctgtattcattgtttataactacactgca

SEQ ID NO: 728827 - DNA, 743 bp, Homo sapiens
gatcttccgggcttcacgaattcggctcgaggaacaccatgctacatattgttacacctctgttaaacatgtattttaccccatatgctcatccattctctctctatatctatctagatctcgatatctatctatagatatatctatatctatatgtatagatagatatctagatatatctagctattgagatctagatctagatatagatgtctatagatatagatataactagctattgagatctagatagatagttgtctagataagtatctagacagattgatatagatatatacagagaatattaggtccatactctctctctctctatatatatacacacacatatctattaggtatatagtatatacctaatacttttggatcacttgagaataatgtatatacgtcattgccctttagtcctaaatacttcaatgtgtatttcctaggaataagaatatccatttaaaagaatcatgttatacttcttatcttcagttcatttacttagtcactatttcttgaattgaaccaaactattagaacacccattatcctggtctgatctgacccactgctaacggaattacaggagtgaaaaattcaaagtttcatttgcatttcaggttttggtctttgagagtaccatagaatcaagttttgcaaatcagctttgaatttgactcaccatgggtttgtttgattcagttcaactgttctaaaaacctctttgtcaa

SEQ ID NO: 728828 - DNA, 1128 bp, Homo sapiens
attctatcagcagcctgccaaatggattgaagttgggaaaaatctgaggccgggggatcagcaataagtggcacgtactaaaatctcaagaataaaaccctgacctgttttaagcacctggagacaagcagagcctcttgtggagacagatgtatcagatcttcacctgacttcatttgatatctgaatcatagaactatttcatacccccttcttccaagtccaagctctcctggcatcttgtggttaggactgtatctcgttacttctgcttatcctgcagtggctctgggcttgtttgataatcaaactgagccggcccttatttttaatttttaacccatcctaatggggcttttttatttggaaatgattttaaacttatagaaatgctgcaagaataagaatggtacatagaacaccatgctacatattgttacacctctgttaaacatgtattttaccccatatgctcatccattctctctctatatctatctagatctcgatatctatctatagatatatctatatctatatgtatagatagatatctagatatatctagctattgagatctagatctagatatagatgtctatagatatagatataactagctattgagatctagatagatagttgtctagataagtatctagacagattgatatagatatatacagagaatattaggtccatactctctctctctctatatatatacacacacatatctattaggtatatagtatatacctaatacttttggatcacttgagaataatgtatatacgtcattgccctttagtcctaaatacttcaatgtgtatttcctaggaataagaatatccatttaaaagaatcatgttatacttcttatcttcagttcatttacttagtcactatttcttgaattgaaccaaactattagaacacccattatcctggtctgatctgacccactgctaacggaattacaggagtgaaaaattcaaagtttcatttgcatttcaggttttggtctttgagagtaccatagaatcaagttttgcaaatcagctttgaatttgactcaccatgggtttgtttgattcagttcaactgttctaaaaacctctttgtcaa

SEQ ID NO: 728829 - DNA, 482 bp, Homo sapiens
gcgcttcatatataagacgatgaaagtggaaagggttatacattatgaaagctctttttcaaaaacaaactgtgtggaaataaattaaccggttattttaaaacgccagtttgcaagttcttcaagtctctggtgttttgactttaggattcctctaaaacacagaaacaaagggtaaaaatcaggtggccgtccaaaatgacttcgggcgccccacttagagagacgccttggttcaggtagcccgctggggtcgaaggccccattttcccccgatctatcgggcttcgcggcggaagtcttcgttcaggcaggggatgccctaggagggaaggaggcgacggtgcccaaggacgtcggaagccggggatctccgcttccctcgggccccggctaggttaccagtgctggcccgcggcgcgggtgcccagttgcgcctgggacactgcgggcacggctgtggcggcaacggcagcggccgc

SEQ ID NO: 728830 - DNA, 632 bp, Homo sapiens
cttgtgtcttaatgtgggaaacagaactttctaagtaatctctggagtttgtagcttagaccaggccttcaaaagtcttttctgttttcctttgctacaatttgcttgttatttctctgccggtcacagatgacctggactgactgaatgcttttgtggtaaggaactgatctggccattttcatataacaaaaatcaaagtcaacaattttgtatcaggctgcctaaatgaaccctattgtttccagttcttaaaaatttaagggctatctaagaaaagtttaagcaaaaccctcattccaaacatgcgaccttataataagaacttcctttaaagatgagcagcaaggttgggtatctgatttcactaagtaatattctattgtggtcagaaatgggtaatttgcatcatttggtcactatcaatatttgtgttggagtctgcaagatatttcaacaaagtaagccaaaccactatcttaggggattgttgctggactttggaatataaggctgaacagtgatgtgaagtcatgtttgggggctggaagaagtgataaatgcaaaggttggtgctaaattaggaaccccttgaaggagcaagctgattaaaaaaaaaagctggcagacaa

SEQ ID NO: 728831 - DNA, 558 bp, Homo sapiens
aaaaaaatgctttatatgtagtaaaatgtgtagatcttatgatacatgtatatagtcattgtaactgattgcagtcaaggtgtagaacacatccatcactccagcaattttttcgcagtattccattcagttaatatcatctcccatgagaggcaccattgttataatttctgccactatatattagttatattagttttactttttttgaatattgtaagtagaattctgattccatttattaatgattcttttttgtgtatacctggcatctttcatgaaataatgttgtgaaattcatttgtattagtagttcctttttattgcagcagagtaatgcattttatgactatactacaacttgtttacaataggatttatttattatatcataaagatatatgcagccagatcatagaccccctaatatataaagagaatgcatcttcaggtatcttcagcacacatttattcatcttttacccaaatgggaataattaataatgatcaattttgagttatttggttcagatgattttgactattagtaatattaac

SEQ ID NO: 728832 - DNA, 4224 bp, Homo sapiens; identical to SEQ ID NO: 32178

SEQ ID NO: 728833 - DNA, 4187 bp, Homo sapiens
atgcaaaagtccaggacagtgggccactttcagtcttcaaagagaaagataagaaattctggattttcaaaatccttttgaagccttttaagccattgattattattattcctaaagaaaatgaagataattacatatttttgcatttgggcagtagcatgggccattccagttcctcaaagcaaaccactggagagacatgtcgaaaaatccatgaatttgcatctcctagcaagatcaaatgtgtcagtacaggatgagttaaatgccagtggaaccatcaaagaaagtggtgtcctggtgcatgaaggtgatagaggaaggcaagagaatacccaagatggtcacaagggagaagggaatggctctaagtgggcagaagtaggagggaagagtttttctacatattccacattagcaaacgaagaggggaatattgagggctggaatggggacacaggaaaagcagaaacatatggtcatgatggaatacatgggaaagaagaaaacatcacagcaaatggcatccagggacaagtaagcatcattgacaatgctggagccacaaacagaagcaacactaatggaaatactgataagaatacccaaaatggggatgttggcgatgcaggtcacaatgaggatgtcgctgttgtccaagaagatggacctcaagtagctggaagcaataacagtacagacaatgaggatgaaataattgagaattcctgtagaaacgagggtaatacaagtgaaataacacctcagatcaacagcaagagaaatgggactaaggaagctgaggtaacaccaggcactggagaagatgctggcctggataattccgatgggagtcctagtgggaatggagcagatgaggatgaagacgagggttctggtgatgatgaagatgaagaagcagggaatggaaaagacagtagtaataacagcaagggccaggagggccaggaccatgggaaagaagatgatcatgatagtagcataggtcaaaattcggatagtaaagaatattatgaccctgaaggcaaagaagatccccataatgaagttgatggagacaagacctccaagagtgaggagaattctgctggtattccagaagacaatggcagccaaagaatagaggacacccagaagctcaaccatagagaaagcaaacgcgtagaaaatagaatcaccaaagaatcagagacacatgctgttgggaagagccaagataagggaatagaaatcaagggtcccagcagtggcaacagaaatattaccaaagaagttgggaaaggcaacgaaggtaaagaggataaaggacaacatggaatgatcttgggcaaaggcaatgtcaagacacaaggagaggttgtcaacatagaaggacctggccaaaaatcagaaccaggaaataaagttggacacagcaatacaggtagtgacagcaatagtgatggatatgacagttatgattttgatgataagtccatgcaaggagatgatcccaatagcagtgatgaatctaatggcaatgatgatgctaattcagaaagtgacaataacagcagtagccgaggagatgcttcttataactctgatgaatcaaaagataatggcaatggcagtgactcaaaaggagcagaagatgatgacagtgatagcacatcagacactaataatagtgacagtaatggcaatggtaacaatgggaatgatgacaatgacaaatcagacagtggcaaaggtaaatcagatagcagtgacagtgatagtagtgatagcagcaatagcagtgatagtagtgacagcagtgacagtgacagcagtgatagcaacagtagcagtgatagtgacagcagtgacagtgacagcagtgatagcagtgacagtgatagtagtgatagcagcaatagcagtgacagtagtgacagcagtgatagcagtgacagtagtgatagtagtgacagcagtgacagcaagtcagacagcagcaaatcagagagcgacagcagtgatagtgacagtaagtcagacagcagtgacagcaacagcagtgacagtagtgacaacagtgatagcagcgacagcagcaatagcagtaacagcagtgatagtagtgacagcagtgatagcagtgacagcagcagtagcagtgacagcagcagtagcagtgacagcagcaacagcagtgatagtagtgacagtagtgacagcagcaatagcagtgagagcagtgatagtagtgacagcagtgatagtgacagcagtgatagtagtgacagcagtaatagtaacagcagcgatagtgacagcagcaacagcagcgatagcagtgacagcagtgatagcagtgacagcagcaacagcagtgacagtagcgatagcagtgacagcagcaacagcagtgacagcagtgatagcagtgacagcagtgatagtagtgacagcagcaacagcagtgatagcaacgacagcagcaatagcagtgacagcagtgatagcagcaacagcagtgatagcagcaacagcagtgatagcagtgatagcagtgacagcagtgatagcgacagcagcaatagcagtgacagcagtaatagtagtgacagcagcgatagcagcaacagcagtgatagcagcgacagcagcgatagcagtgacagcagtgatagcgacagcagcaatagaagtgacagtagtaatagtagtgacagcagcgatagcagtgacagcagcaacagcagtgacagcagtgatagtagtgacagcagtgacagcaacgaaagcagcaatagcagtgacagcagtgatagcagcaacagcagtgatagtgacagcagtgatagcagcaacagcagtgacagcagtgatagcagcaacagcagtgatagcagtgaaagcagtaatagtagtgacaacagcaatagcagtgacagcagcaacagcagtgacagcagtgatagcagtgacagcagtaatagtagtgacagcagcaatagcggtgacagcagcaacagcagtgacagcagtgatagcaatagcagcgacagcagtgacagcagcaacagcagcgatagcagtgacagcagtgatagcagtgacagcagtgacagcagtgatagcagcaacagcagtgatagcagtgacagcagtgacagcagtgatagcagtaatagtagtgacagcagcaacagcagtgacagcagcgatagcagtgacagcagcgatagcagtgacagcagtgacagcagcaatagcagtgacagcagtgacagcagcgacagcagtgatagcagtgacagcagtggcagcagcgacagcagtgatagcagtgacagcagtgatagcagcgatagcagtgacagcagcgacagcagtgacagcagtgacagcagtgaaagcagcgacagcagcgatagcagcgacagcagtgacagcagcgacagcagtgacagcagcgatagcagcgacagcagcgacagcagcgatagcagtgacagcagcaatagcagtgatagcagcgacagcagtgatagcagtgacagcagcgacagcagcgatagcagcgacagcagtgatagtagtgatagcagtgacagcagtgacagcagcgacagcagtgacagcagcgacagcagtgacagcagcgacagcagtgacagcaatgaaagcagcgacagcagtgacagcagcgatagcagtgacagcagcaacagcagtgacagcagcgacagcagtgatagcagtgacagcacatctgacagcaatgatgagagtgacagccagagcaagtctggtaacggtaacaacaatggaagtgacagtgacagtgacagtgaaggcagtgacagtaaccactcaaccagtgatgattagaacaaaagaaaaacccataagattccttttgtgaaaagtttggtaatgggataggaaaaaaagatttccaagaaagtaaagaaaggggagaaataaacataagacgtatgtaaacaaaaacaactgggggaatcaaatcaaacagttggattcagaaccaagacctaactcctgcagagacagactctgaatgcatgacctttggtacatgcctgttaatattcatgttctgaaaatattttgttaaaagtgtaaatctaaacataaaagaacaattaaaatattctttaatacttcacacagaa

SEQ ID NO: 728834 - DNA, 4224 bp, Homo sapiens; identical to SEQ ID NO: 32178

SEQ ID NO: 728835 - DNA, 4187 bp, Homo sapiens; identical to SEQ ID NO: 728833

SEQ ID NO: 728836 - DNA, 1320 bp, Homo sapiens
ggctcgggctccggctccggctccgggcgccgaccaggtccccttggcccccgccgcgcgccctccaacctgctgctgccgccgccgcgccccccaggctctgccagctacccgcgctctgagcccggggccagattcccatggaagcgccgcgatgttcgccccccggctgctggatttccagaagacgaaatacgcgaggttcatgaaccaccgagtccctgcccacaagaggtaccagcccacagagtatgaacatgcggccaactgtgccacccatgctttctggatcatccccagcatcctgggcagctccaacctctacttcctgtcggacgatgactgggagaccatctctgcctggatctacggcctcggcctctgcggcctcttcgtggtgtccactgtgtttcacaccatctcctggaagaagagccacctcaggatggtggaacactgtctacacatgttcgaccggatggtcatctatttcttcatagcggcttcctacgcaccctggctgaaccttcgggagctgggcccctgggcctcccacatgcgctggctggtctggattatggcttccgtgggcaccatctatgtcttcttcttccatgagcggtacaagcttgtggagcttctctgctacgtcgtaatgggcttcttccccgccctggtcatcctctccatgcccaacaccgagggcatctgggagctggtgaccggaggggtcttctactgcctgggcatggtcttcttcaagagtgacgggaggatcccctttgcccacgccatctggcatctctttgtagcatttggtgctggtacccactactatgccatctggaggtacctctatctgcccagcaccctgcagaccaaggtgtccaaatgaggtgacccagacttgagaggtcgtttgggctttaggagtggagcacgtttctgcgaacgttaacccagagcacagcgccaaggcctgtcttccctttattgggtagagttcttgatggctccaaggtgacttctggtgacagccagatcgtccctcgagtccccagcgagaaagaaagcatttagccattcttacagaggagaaattaaccctgtaatgtgtttctattttagatgagtgtttcctaatacaagcaacattaacatcttcagaaaaggaagcaggcatggtcctgggaaaattggggaatgacgggccaatctgtgtttcctaaggtcctgaagaatctggcaaagagtcctgtgggttgttttatacctgggtggccagggcctccctctctgttaccaaagtccaggctggcg

SEQ ID NO: 728837 - DNA, 387 bp, Homo sapiens; identical to SEQ ID NO: 745

SEQ ID NO: 728838 - DNA, 3215 bp, Homo sapiens; identical to SEQ ID NO: 23786

SEQ ID NO: 728839 - DNA, 452 bp, Homo sapiens
cattaatggtacaccataaatggtagatctcaaaagtaatgatttcaatttttaaaataatttttttcaaatgcgcatatctgatatttcagagaatcacttcgtacaaagtgatggaagcccagtatgaagacctgagtttggaagaatcatgaagttgtttgagcttctgctttgtccttttgcctgtctttccctcattcctgccagcaatggatagtgtcttttctcagattgatgcagatttgccagagatgagatgatctttctttaggttttctggctttctgatcttcccttcctagaaattagagaagctaagtatttggcttcaagtactttcctttctaggcctgagaatatacgtatgttcataattaacaaacccaaggcaagaactgtccagagaaagaacatgagtggaatataaatgcttatatgtatgggttccc

SEQ ID NO: 728840 - DNA, 474 bp, Homo sapiens
ttggaacatgtgggggatctccctaagctctggccacagcaaagcaaggaggtgtgtgcaagaggaggcttccggactgggcattcccctgtcgcccttcctgccctggggtggccatagctggtgactcttcctaccttgctggtcccacctcacctgcattgaggggacggggagggagggatctgagggatgaaggtagatttctgagactctctcctaagccagaaagacgttcttaacacccctgcagtgtgaaagctggtccagctctacaactgttggtaccaatgtgcaaacacaccagccctgccatctggacccagcactcagaaacaccatacacccctggccgacgccatcatgcccctggatctgctataggccacactgaccacatgctcctggattcgctaattcactcacacacccattgcatcaccagtgcggtcacatggattgaaagaattaata

SEQ ID NO: 728841 - DNA, 726 bp, Homo sapiens; identical to SEQ ID NO: 558511
  misc_feature (68)..(68): n is a, c, g, or t
  misc_feature (71)..(71): n is a, c, g, or t
  misc_feature (76)..(76): n is a, c, g, or t
  misc_feature (81)..(81): n is a, c, g, or t
  misc_feature (93)..(93): n is a, c, g, or t
  misc_feature (124)..(124): n is a, c, g, or t
  misc_feature (536)..(536): n is a, c, g, or t
  misc_feature (599)..(599): n is a, c, g, or t
  misc_feature (634)..(634): n is a, c, g, or t

SEQ ID NO: 728842 - DNA, 472 bp, Homo sapiens
  misc_feature (68)..(68): n is a, c, g, or t
  misc_feature (71)..(71): n is a, c, g, or t
  misc_feature (76)..(76): n is a, c, g, or t
  misc_feature (81)..(81): n is a, c, g, or t
  misc_feature (93)..(93): n is a, c, g, or t
  misc_feature (124)..(124): n is a, c, g, or t
gtcaagtgatataacctattgtaaactgactatcaaactcctgggaaaacaaatttggaaaatgcttnatnatatnaattngtcaacaatttntaagatatgacattaaaagctcaggcagtanaagcaaaaatatatcaaacctaaaaacttctgtaccacaaaggtcacaaccaacagggtaaaaggcaaactgtagaataaaagaaaataccagttgagtgtcccttatttgaaatgcttgggatgtgtttcagattttgtaatatttgcactattcttactggttgagcatctcgaattcaaacacctgagtctgcgatgctccaataagcatttcctttgagtgtcatgttggcactcaaaaagtttcagactttggagcatttgggatttcagatttttggatcagagacattcaacctatagttgcacatcatactgtgatacgtctaggtcgggatcctctaga

SEQ ID NO: 728843 - DNA, 451 bp, Homo sapiens
ggattatttcaatatttttgtaataaaaaatatagggtatacacataggcatcatcacattttttatagaccctggaatccgtttaaaatactttaagcatcataattacttgggatgtcagaaactggtcccacaaattccatcagcctgcctcagcagattgaaaacatttgtctcttgcaagatcaccctactttgcaagttggtgcccccaggaaccctggcccaggggtgctatcagaatatcaggtgaagagagaatcagcttaaatagaaagggcttgtcaagactggccaatgtttcccaggaaatcaaagatgtaaatgattactttcatccatccattataacaaacctgaccacagtggaagctgtcttaaacttccttccctggttttatattaacccaactgatagattaagtattagtcaaaccactaaaaaaaaaa

SEQ ID NO: 728844 - DNA, 465 bp, Homo sapiens; identical to SEQ ID NO: 21112

SEQ ID NO: 728845 - DNA, 1653 bp, Homo sapiens; identical to SEQ ID NO: 49205

SEQ ID NO: 728846 - DNA, 1467 bp, Homo sapiens; identical to SEQ ID NO: 49206

SEQ ID NO: 728847 - DNA, 550 bp, Homo sapiens
tcagcctcccgagtagctgggactacaggcacctgccaccatgcctggctaattttttgtatttttagtagagacgggatttcaccgtgtgagccaggatggtctggatctcctgacctcgtgatccacccgccttggcctcccaaagtgttgggattataggcacgagccactgcgcccagcaagatttttttttttaaagctcagataaagtattatggaggcgaagaagtaggtaactcactggagtacttgagaaaggcatcatatttcagctgggtcctgaagaatgagattttccatataagaagcagaggaggaacattctaggtaaaaggaagggcatatgcaaaaacacgagggttgtgaaaggacctgattggactgagatacaggaataagcacggaggatatctctggggatctttttccctaatacacagttatagttatatccatattgggtttcttgactgttgacttcaggaggttctcaactcaggcaggcccccaatttccagaggagataaccttaaccaatgttttgggt

SEQ ID NO: 728848 - DNA, 642 bp, Homo sapiens
  misc_feature (547)..(547): n is a, c, g, or t
  misc_feature (550)..(550): n is a, c, g, or t
  misc_feature (583)..(583): n is a, c, g, or t
  misc_feature (623)..(623): n is a, c, g, or t
tgagacacagttttgctctttgcccaggctggagtgcaatgcaatggcatgatcttggctcaccgcaacctccgcctcctggtttcaagtgattctcctgccccagcctcccgggtagctgggattacaggcgcccgccaccacacccagctaatttttgtattttcagtagaatcagggtttcaccatgttggccaggctggtctggaactcctgacctcaggtgatctgcccaactcggtctcctaaagtgctgggattacaggcatgggccaccacgctcggcccagacagctcattttaaagccaatctgaccatatcacatccccacatctaacctcagaaagcttcgcattttccttagggccaacacggaactccttcccaagccccgcaggacctgcctcctccctggtcccagggccgctctcttgcctcatctgcagttgactaagctgcagccagtccagccttctcatcgacccggataactcagcctcaggatctctgctcctgtggttccctgcccccagctagcccagcccntcngtctcaagccttgctcagatctgcctcccccangggaggctccagcagccccgcccggcacatgtggcatcanggccactcacccggggtca

SEQ ID NO: 728849 - DNA, 780 bp, Homo sapiens
  misc_feature (664)..(664): n is a, c, g, or t
  misc_feature (693)..(693): n is a, c, g, or t
  misc_feature (761)..(761): n is a, c, g, or t
aatttctattctgccatcttagaagttatttagttaaaaacagttcaatacattcaaatctacagtaaatgtctgacaatctcttttaagatgaattataggggacaattggtttgccaggagcatgctaaggtcaagaccctaaacataacatagtacaatgaacataattccaattgcttttttctgtttaatattaaaaagaaaagatttttttgtctacgtgcttttttcagattttcttcaagtgttgacatgtaataaacttaagtagaagcatcagaaatagcataatgatttgctgctaccaagacaggattgatctgaatttgatttagccatagaaatacctcctgtgagaggaaggccaggtgtagtttagaggaggcagatttgggcattgccactccctggttttcttatctcaggtaagttacttagtgatatggtttggctgtgtccccacccaaatctcatcttgatttgtaactcccacaattcccatgcgttgtaggaagaatctggtgggaggtgattgaattatgggggtgggtctttcctgtgctgttcttgtgatagtgaatgagtctcatgagacctggtgctttaaaaacaagaatttacctgcacaagctctctctgtgcctgcttctccttcgccttntaacatgattgtaagtttcctgaggcctncctagaagcaaaagctgctgtgcttcctgtaccatctacaggaccgtgagccaattaaacctcttttntttataaattaaaaaaggc

SEQ ID NO: 728850 - DNA, 994 bp, Homo sapiens
ctgcctggctcccttaggaggtggatgacttctttgagcatgagaggaccttcctgttggagtatcacacccgtatccgagatgcctgcctgcgggccgaccgcgtcatgcgcgcccacaagtgtacgcagggcccaaggggtcctggatccccctgcccctctccccagcggttcaactccttgggggagagaagagagcagggcgtgccttgttgtttgtctgtggccacaagcaccaaggcttgacatgcagatgtaggggctctgatgggggctgttccccaacaggcctggcagacgattatatccctatctcagctgcgctgagcagtctgggaacacaggaagtcaaccagctaaggacgtgaggactccccccacccctaccctctccctgtgcctgtaataccatgtcttcccatgaggggtcactctgtagatgtctactgtcagctctaggtgggaggtgtaggctctcctgttgggggatggtgttgggaaggaaaggggagagggagattcccaaggagaggctgagacagagaggctttgagctgttcctcagccccctaccctaactccctccctactgcttcctaggagcttcctcaaattggcagagctctttgaacggctgagggtgagtactgccttctgtgctcaaaggctttcctggtgagctttgcagggaagatgagtcctggcagagggaagagctccaggatcatcttgggttcagtgataacttgggcccagtggcaagttgggcttacactccagactagtttaacaaaaggtggggtgaagacaaggatccagcttcgtgtgtgtgttggggggtgcaggggcatgcacatgtatgcacgtgtgcagcagcggagggttgggaggcacaagggtgtgcccaaacctctggcaggctgcacccagctgccagcacactgcccgggcacacatgttccccactcttccctaagaaagtcactggagtg

SEQ ID NO: 728851 - DNA, 2317 bp, Homo sapiens; identical to SEQ ID NO: 70799

SEQ ID NO: 728852 - DNA, 652 bp, Homo sapiens
ccctggtgctgtatctgccatcttttcacactgggtgtgacccgaagagacagcctgaggtccgtcctcactcactgtgtttcaggaactgagggtcagctggcagtgggatgaggctggcccccttctccgctttcgttccgggaggcctcccgtagagcggtaggggctcgagatggcatttcgtttggggcacgagctggtccgggaggtctgggatctctggttctgacctctgggcacctgctgcagctgtggctgaggcccagaaatgtgaagggcctccatccactccagtagtgaccccaacgtggggttcaatgtggaggggggaggggctgctgcggcagctgcaggagcagaagtgccacaccttgttcttctcatgcccgcatccatgcttgcagctgggaagggggcaggaatcagcgaggtgacctgggctgagtcctgggaatgggaagaggtggcaggaaggggatctgaggaggagaacagggggcctggtggtctgtgcttcttcccagacatgggagctgtagaggggacccctgcagcagatgctaagggggccagtaggcccaggcagtcttgggacttgtgtgtctcctgctgtgcatccatactgggtgctttagaaacggcaggcaga

SEQ ID NO: 728853 - DNA, 1061 bp, Homo sapiens
cagtgaagtatcagaaagcagtgtcagcaacacagaggaagtgccagggtctctgtgtctcagaaagttttcttgcatgttctttggagcagtttcttctgaccagcaagaacacttcaaccaccctttcgacagtctggcaagagcaagtgacagtgaagaggacatgaataatggcagtttctctatattctaatgcttaatgatggctgagctgggccccagcccagtgactggctcatttgcccctcaagcacgagtttgcatgtttagtgtctaaaagaggttgtccaggacttccttttaatggaggatgggcttttaaaccacatcatcttgtacaacaaccatatctagaaatagctgtttgtcaagtgtatgtaacttgctttaaatccattatgctacttgtgaggcagaagagttttctgtgaaggaaaaaagcccattagagttcttcaattcaatgcacgttcaccctagagcttttaacatctttgctagttttataaaggtatttaaactttattcaacagccatttagagtgccatcaagatggcttgaaatggaattttgtgatttgtagtcaggtatcttttgtatttgattgcaaacatttggattttagttttctcatgtaataccatggccttttttgtgcattgttttttatattttaagactttaagtagaataaaccctggaaaaaagatcaagagtaaaaatatatagtcactttcacttggcttttttagacggagtctcactttgtcactcaggctcaagtgcagtggtgcaatctctgctcactgcaacatctgcctcccaggtccaagcgattctcctgcctcagcctcccgtgcagctgggattgcaggtgcgtgccaccatgcctggctaatttctggtattttgtagagacagggtttcgccatgttggccagggtggtcttgaactcctggcctcaagtgatctgcccacctcggcctcccaaagtgctgggattacagacttgagccactgcgcccaacctggagtgtttttacatattgtaaaatt

SEQ ID NO: 728854 - DNA, 296 bp, Homo sapiens
ctccatctcaaaaaaaaaaaaaagcaaaaaaactggaccccaagagccacaaggaaaaagcatgtactacaacagagtgcacctcttcattcagtaaagggaggtcaccaagagaatttgatgaaccttaccttcaaagttcctgggcacagtggctcacacctgtaatcccagagctttgggaggctgaggtaggaggattgcttgaacccaggagttcaagtttgcagtgcgctatgattgtcccactacactctagcctgagcaacagaccaagaccgtattgccaaaatacc

SEQ ID NO: 728855 - DNA, 248 bp, Homo sapiens; identical to SEQ ID NO: 61313

SEQ ID NO: 728856 - DNA, 1507 bp, Homo sapiens; identical to SEQ ID NO: 23249
  misc_feature (1507)..(1507): n is a, c, g, or t

SEQ ID NO: 728857 - DNA, 696 bp, Homo sapiens
tgaggtcagggatttttgcctgccttgtttactgctatatcccagccgctagaacaatccctagtacacagtagacactcaataagtacttactgagtgaatgaaggtccactcctctgtttggaccaagacctgctcagctatttagtcagctgctttgaccagaaaaaaacagtggatccagagacagagttggtcatgtcaaaggcacagctgccctgactgccaagaacttgtggttgtcttgaatccacaatcttttctctggcattgggttccccaacctgatcaattgagttgggagcaatggattcaagtcaacagtcattcttacactggacagaactcgagctgagccgggcactgtaatggggctggttagaaagataagtttggtgactgggcacggtggcgcactcctgtaatcacagcactttgagaggctgaggcaggtagatcccttgaggccaggagtctgagaccagcctggccaacatggcgaaaccctgtctctaccaaaaatacaaaaagttagccagttgtggtggcacacacttataatcccagctacttggaagtctgaggcaggagaatcgcttgaacctgggaggcggaggttgcagtgagccaagatcacgtcattgtcctccagcctgggtgacagagcgagactccatctcaaaaaaaaaaaaaaaa

SEQ ID NO: 728858 - DNA, 416 bp, Homo sapiens; identical to SEQ ID NO: 377946
  misc_feature (302)..(302): n is a, c, g, or t
  misc_feature (371)..(371): n is a, c, g, or t
  misc_feature (395)..(395): n is a, c, g, or t

SEQ ID NO: 728859 - DNA, 574 bp, Homo sapiens
aggagtccccctgaatggatgattgctgtttcaggaccgggattagaggctgtgatagactgtgcagtggcaaaagtattaacaagagtggcgatgaggatggcagttggggcgtccaggctgctgactgagtgcccgcctgtcggtacagccagccaggccttcgacaagcacctgcctggaaaccgggctcgctgtcctgaaggcctggactggatgtcacgatggggagaacgggatcgcgatacccaagctggggcacaggcgagccagggacactggtttactggggtgataacacccagccctgctatcgcgatccgtttgcactgtggtcagctgtctccacgccgtggttggagagggcttgtctccgggcgccactgctggtgtgtatggtctgtcttagtgtcccctgcaagttgcatttggagattgctgggtggcagggagggaaatgggaagagaatctgttggggtcatggtggtgaaggctgctggtttttaatcccttctcaaccagtccaggacacttgtctcccagagataactggggggggactgcctaaccccc

SEQ ID NO: 728860 - DNA, 526 bp, Homo sapiens
atttgattcaaaggtgtgttgtctgttatagataatctcagcaagtgctgctgtatctcacttgctaggcaatacctgtacaatagctaaccattgcatcaagtgtatatgaggctgtggaattagattttgcccagggaatagtaataatagtaactaccatttatggtcatataaagtacttatcatttttacaaccctgagttatttctttcttttcttttttttttttttgagacggagctttgctctgtcgcccaggctggagtgcagtggagcgatctcggctcactgcaggctccgctcctgggttcacgccattctcctgccttatcctcccgagtggctgggactggaggcgcccgccaccacgcctggctgattttttgtatttttggtggagacggggtttcaccgtgttacccagggatggtcttgatctcctgacctcgtgatccacccaccttggcctcccaaagtgctgggattacaggcgtgagccactgcgcccggccaaccctgagtt

SEQ ID NO: 728861 - DNA, 827 bp, Homo sapiens
gagatttttacaaaaagaaatactataggccataaggttgggggaagaccccaattaatggaaatgggcctaagggaccaatgcctaattaaatccgttaaccagtgattttgtccaccataattacatgacttatagcctaaaagagcaatatttaatccagtaagatttagagatgggtgtacttggaatccctttgaaagcagcgtgtttagttttcaagcaaatgctaatgttccttaatccctaatagtatattagacttcgttgtgttgaatatatcaaatgaacgaactatgaaccagagctttaaaatagtgatttgtaagactttgttacaatggtacttaaaaaattgctttgtataatttacacactgtaaaattcacccattgtacatgtacaattaattgtttttagtaaacttaagagttgtgcagtccaattttagaacatgtccatcagcccccaaaatttactcctgctgctctgcggttaatttgctcctgcctccagccccacgcagccacactgatctgctttctgtacagatttaccctttctagaaatttcacagaggtagaatcatgcagttagtcttttatatctgggcatctttcacttaggcatgtttttgaggttcatccatgttgcagcttatacctgcgtgtagttcctttagttgctgacttagtgttcactgtttgggatataccacattttgtttatcccattcaccagttgataggacattgggctgggcctacaattaggtttttttaaatgcggataataatgctatgaacattcataaatgtctttgtgtg

SEQ ID NO: 728862 - DNA, 1398 bp, Homo sapiens
cagtgaactgcctgctagatgccaggcaagtttaaaggaaaggtcaatgagaaataaagtgctcaagggcagattcaaggaaaacatggggagcattgcagagcaaccaggtcttaaaagagaagttaaggagaacagcaagaagcaagcacacaggagcaggcagaggcacactggttgagaaagtaggatgcccagcagcctggtctgattaaatcagaaattccctctgtaggaggacaagcaaagcatattatcataggctgggcagaattccaaaggtcatttcatccaacactcctcagacgctgaaactcaaggtttcgaaggcaaaagtggaagtgtagacaattgctacagaattgaagcccaacattctgtcctttgcctttcataatttgagacaaaattaaaaccatctgaaatatctcccttggctgcttttttcaaactttaatttccctgcaagtatatgataattgagtttctttagagcacaaggctggatatattggaccttaatgtgcacaagttcatcctagaaattgtctttagagtaccaagtctttcctccccaagagttccaaaactaattcaatatttagaatgctcccctggacctcccagttccagtggctgaatgtcagggctcaggcattagaggattctttttgttctttggccctcttggggactaaatgccatgtatgtcaccatgtcagtgactacagccttggtttcatcccctgatgacccacaaccatcatctcccttatgctgaacatctctctgaatcttggaattttcagatgactctaactttgccaaattagaatcatgcctgattctttttttgtttgattgtttgctttatgtttgtttactttgctcagtgccaagcacaggatttagcataagaaaagttccactagaggttgtttattcaagtaagtaattattatagccatccgtatatgaatgctttacaaaattttggctgatggtcctcgcaggtctgttttattagtcaatttataaactcaagtttatgtcttcaacttgaccatctcctttgacttccagattcgcctcttcccacaaaactgactctccacttggacatctaacaggcatcttaaatttaatgcatccactttggggggctgaggtgggcagatcacgagatcaggagatcaagaccatcctggctggcacggtgaaaccccgtctctgctgaaaatacaaaaaattggccaggcgtggtggcaggcgcctgtggtcccggctactcgggaggctgaggcaggaaaatggcatgaacccaggaggcgtagcttgcagtgagctgagatcgtgccactgcactccagcctgggcgacagagcaagactccttctc

SEQ ID NO: 728863 - DNA, 1311 bp, Homo sapiens
cctggctcctcccaggtcaagctgggaacacgaaagaaggaagccagcagagggcaagtacagacaggttcattgcagagcgtagccttggggttcagcccctcaacctgaggctgaggatctcttggagcttggggagcgtccttggggaccacattcagtagatggaaccacagggccgtaagggtgcgtccatgtgcattgcctggaaggtgaagcttgtagaaagcaaaggtttgtagaaggcgaaggtttgtagaaggcgaaggtttatagaaggtgaaggtttatagtagcctacagcgacttcatttccactctctctcttctagccatgtgttgaaatcagttattcgttgggaatgactaggctgtggatggctttcagtgtgcatatctggactccctctccctgagttccaaacctggctctgctcctttggagcttctgctatgtggcagatcgcctccctgtgcctcagtttccccatgtgtcaaacggggatgacggggtttcaagaatcagagtccacatcagatgcttgcctggcacacgggaatgtgtgagctgggcctgccctggcagcgacagagagctggtgaccaccagaaaccctggccctgggacggcttttgtctcttttttgttgggcaaatgggctcccagccgggcttgggcctccaccgccgggaaggcggaactgcgctcgggtactgggctccggcctcccgaagtccttggtaagccttgcctgtagcggctccgctgccgagtgctttgacaccaggcgctcccagagctctgcccccactgccaagcggcagctgctccggagggcacggggggctggatttggctgtggcttctccagctctgcacaagagccccccttccctggccctgctgcagcatgactgcctcctggctcgtgtcacccactctgtctctgtctctcttcatacgtttccagctgagctgggatccatagtctgtttccctctccacgaccaatctatttatcttctctggaacttcttgtaatgccgggagtgcagagcttacaagttggggcaggaagctttagaagcccaggcagccctgagaggctctttccttgtaagtgggtctctccccaggagcctcttggaatatttagcagggacttttacccatgctgggtctagagaccctcccgcccctctgtttcctgccctcctacttagactgggatctggtttccctcagctggttcccttgctagcgtgtgactctgtgtgtctgtctgtgactggtttagatttgtatgaaat

SEQ ID NO: 728864 - DNA, 491 bp, Homo sapiens
tgctggacaccttcgagtacccgggcctcgtgcatcacaccgggggctgccactgcggcgcggtccgctttgcggtctgggcccctgcagatctgcgcgtcgtggattgcagctgcaggctgtgcaggaagaagcagcaccgccacttcctcgtcccggcctcgcgcttcacgctgctccagggcgcagaaagcatcgtcacctatcggtccaacacgcacccggcgctgcacagcttctgcagcaggtgcggggtgcagagtttccacgcagctgtctctgacccccgcgtgtacggcgtcgcccgcactgcctggacgagggcaccgtgcgcacgtggtcatcgaggaggtcggcggtggcgacccgggggaggaggccgccgaggagcacaaggccatccacaagacgtcctcccagtcagcccctgcctgtccccgcgaacaggagcagtgattggggccgcaagcccgcctgaaaccggcccgggc

SEQ ID NO: 728865 - DNA, 413 bp, Homo sapiens
tttgctctgccagggtgtgtgagagagagagagagtgtgtgtgtgcgtgcgcgtgcgcgcgcactataaagcaatccccatatctggtggcttaaagaagaggggagtttgtttctccttcacttctgactgaggtgggtgccccagggcaagtggcttgcggaagatcaggtcatccctccatcttgcccctgtatgcctaagggtgaaggtcaaaaaccttttctctgaaggtgagtgtttcaggttctgtgggccatatggccctgttgtagctactcaactctgtagcgcaaaggtagccagagacagtacagagatgagtgggtgaggctgcattccaataaaactttacttgcacaaacaggctggatttggtccacaggccgtagcttacccatcctgcctggggc

SEQ ID NO: 728866 - DNA, 573 bp, Homo sapiens
gttttgacaggtctagagtggggtaaaagaatggtatttattcaggcctaatattgaggcttggggctgggctgtatatcagagggcatgcatagacaaagctgaacaaaggggcacacctactgggcacctgctgggcacttctctaaaagtggcactgagacatcattaggatgaattagaactagggcaccagttaacccgggcctgcatgctagtgaaaggaaaattgcgcctctccctcaaccctgctccagacaactgaatggtgacttcaagaacaaatattcaggctgggtgcggtggctcacacctgtaatcccaacacttttggaggctgaggtgagtggatcacctgaggtcaggagttcgagactagcctggccaacatggtgaaaccctgtttctactaaagatacaaaaattagctgggcgtggtggtgggtgccagtaatctcagctaggaggctgaggcaggagaatcgcttgagcctgggaggcagaggttgttgagatggtgccattgcacttcagcctggacgacaagagcataactctgtctcaaaaaaaaaa

SEQ ID NO: 728867 - DNA, 292 bp, Homo sapiens
gttttgacaggtctagagtggggtaaaagaatggtatttattcaggcctaatattgaggcttggggctgggctgtatatcagagggcatgcatagacaaagctgaacaaaggggcacacctactgggcacctgctgggcacttctctaaaagtggcactgagacatcattaggatgaattagaactagggcaccagttaacccgggcctgcatgctagtgaaaggaaaattgcgcctctccctcaaccctgctccagacatggtaactcacacctgtaaacctaacactttg

SEQ ID NO: 728868 - DNA, 247 bp, Homo sapiens
ccccaactggaaaatcacaagagaaaatagatctgaaacatggagaaggagaagatttcgtccaaccactgctccaaatggcttagaacctcttttgacaaaggattcaagaaggattcataaaacatccttacatagtaatgcagctattacaatgatctatttggggaaaaatgtgcacctatcttctgataatctgacttccgggatgaaattaaagtttatcagcagcactgtggtggggaaa

SEQ ID NO: 728869 - DNA, 411 bp, Homo sapiens
gaatcgcctgaacccgggaggcagaggttgccagtgagcccgatatccccgcccactgcactcccagccctggggaacagaatgagactctgtctcaaaaataaataataaaatgataaccaatttttatattccatttgcagaacccattaaaaaaaaaacttttagtcttgggttacaggtaccatataatggttgacacatttaaacaaatcaataaatattcacaccatctcagtcatccacagtaggaaagaacatgagatgtttttgaagggggtggcacttgcgaaacatttattattttaagctaaaagatgacaggtaatgaaatgtacacaatgctgtagactatactctgtgttccctaacaaatgtaaaatatacacatctaaagattaaaaaagcagt

SEQ ID NO: 728870 - DNA, 460 bp, Homo sapiens
tagactacgaaaatccaagtaacctagcagccggcaataaatatacggtgataatccaggttactgtgaacatccttgaagaaaatgatgaaaagccaatttgtactccaaactcttatttcctggccctcccagtggatctgaaagttggcacaaatattcagaatttcaagctgacatgtaccgaccttgattccagccccagatctttccgttattccattggcccaggtaacgtcaacaatcatttcaccttctctcccaatgctggttccaatgtcacacgcctgctgcttacatctcgctttgactatgctggtggggtttgataagatctggggactacaagctacttgtctacggtaactggatggacaacttggatgttctgacagggaaggaaagcggaggctcttgttgagacagggaacagtggacactgaggtatttaaagtcattc

SEQ ID NO: 728871 - DNA, 570 bp, Homo sapiens
ctttcttttcaaggggcttgagtccctcgctgaactttggggtacgcctccctatctgagcccccgctcccgatcgtgggctgaaccttgccttcgggcacggcgctgataggctggatccagcgctgggccaccctctccttcccagctggttggtgattttgacaagaggcctgagggctgtccagaactgctcaccctgcctttttctgggggctgagcccccacaacctgtcttttccaagtggataagcccaggccccatggagagaggctcagccctagggaaaggctgctcttgctctccctcccagggcttgaggctccctatacttttctgtcttccaggttctaccctccccacagacctaagctgctcccagtctcccagaaccaagagttcttgggttgggatttttgtttggttggtttttcttttttttaataaaacatctttaaaatgtgcgagttgtatgtcagtcatagaagccggattccccacatttgaggatgaaacggatgcccaggaggagctgtggctggacccatgaggatgggggcctggactca

SEQ ID NO: 728872 - DNA, 4390 bp, Homo sapiens; identical to SEQ ID NO: 262808
  misc_feature (136)..(136): n is a, c, g, or t
  misc_feature (1836)..(1836): n is a, c, g, or t
  misc_feature (2187)..(2187): n is a, c, g, or t

SEQ ID NO: 728873 - DNA, 4430 bp, Homo sapiens
  misc_feature (1866)..(1866): n is a, c, g, or t
  misc_feature (2217)..(2217): n is a, c, g, or t
  misc_feature (4421)..(4421): n is a, c, g, or t
  misc_feature (4425)..(4430): n is a, c, g, or t
gctgctctgctgattgtctccactatcctgttttgctcctacccactaatccagcctgggaggctctgggcattagcggaaggcttcaccacaaggagacaggagcgagtattccataggcatgcgctcctagtggcacgagtggcttgggtcaggatcaaagagtgaaggattcggaagtcagctatcttctcgtttggagcacagggaccgcccagctagaggagcaccagcgcactgcgccccagccctgggcgagggtgcggaggatttgttctcggtgcaatcctgctggcgcttttccggggttctgcgcggatccagctccccatctctgctcctacacacacaaaagaaaacaactctcgattggaagttgtggaattttctcagcccctacgaggcgcggggattctccagccccggccctcctcccgccagcctgaggtctccttcgctcgcctgccttgctagggaccgcagtccctcagccgcagctgggtctgtccgccccgcctttgccctcgccttttcccggggcggatttggtgaagtcggcctcaagtccaggaggtctgtcttcgccgggccagctctcgcggaactggggggtagagagcaaagggagagattcgtggaagggaagggaggtaggggtggcgcaaacgcccagagtatcaaacttgggggtggcacagtaggtgacagcagcagctgcaggtggtggctggggacccgcgagggggcgcccctctgggtagggtctggctgagcgggcttgcaagcccgggaggcggctgagagaccctggacactgttcctgctccctcgccaccaaaacttctcctccagtcccctcccctgcaggaccatcgcccgcagcctctgcacctgttttcttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactgctccggctgcccgcccgcgcggcgcgggctgtcctggaccctaggaggggacggaaccggacttgcctttgggcaccttccagggccctctccaggtcggctggctaatcatcggacagacggactgcacacatcttgtttccgcgtctccgcaaaaacgcgaggtccaggtcagttgtagactcttgtgctggttgcaggccaagtggacctgtactgaaaatgggtccaataggtgcagaggctgatgagaaccagacagtggaagaaatgaaggtggaacaatacgggccacaaacaactcctagaggtgaactggtccctgaccctgagccagagcttatagatagtaccaagctgattgaggtacaagttgttctcatattggcctactgctccatcatcttgcttggggtaattggcaactccttggtgatccatgtggtgatcaaattcaagagcatgcgcacagtaaccaactttttcattgccaatctggctgtggcagatcttttggtgaacactctgtgtctaccgttcactcttacctataccttaatgggggagtggaaaatgggtcctgtcctgtgccacctggtgccctatgcccagggcctggcagtacaagtatccacaatcaccttgacagtaattgccctggaccggcacaggtgcatcgtctaccacctagagagcaagatctccaagcgaatcagcttcctgattattggcttggcctggggcatcagtgccctgctggcaagtcccctggccatcttccgggagtattcgctgattgagatcatnccggactttgagattgtggcctgtactgaaaagtggcctggcgaggagaagagcatctatggcactgtctatagtctttcttccttgttgatcttgtatgttttgcctctgggcattatatcattttcctacactcgcatttggagtaaattgaagaaccatgtcagtcctggagctgcaaatgaccactaccatcagcgaaggcaaaaaaccaccaaaatgctggtgtgtgtggtggtggtgtttgcggtcagctggctgcctctccatgccttccagcttgccgttgacattgacagccaggtcctggacctgaaggagtacaaactcatcttcacagtgttccacatnatcgccatgtgctccacttttgccaatccccttctctatggctggatgaacagcaactacagaaaggctttcctctcggccttccgctgtgagcagcggttggatgccattcactctgaggtgtccgtgacattcaaggctaaaaagaacctggaggtcagaaagaacagtggccccaatgactctttcacagaggctaccaatgtctaaggaagctgtggtgtgaaaatgtatggatgaattctgaccagagctatgaatctggttgatggcggctcacaagtgaaaactgatttcccattttaaagaagaagtggatctaaatggaagcatctgctgtttaattcctggaaaactggctgggcagagcctgtgtgaaaatactggaattcaaagataaggcaacaaaatggtttacttaacagttggttgggtagtaggttgcattatgagtaaaagcagagagaagtacttttgattattttcctggagtgaagaaaacttgaacaagaaattggtattatcaaagcattgctgagagacggtgggaaaataagttgactttcaaatcacgttaggacctggattgaggaggtgtgcagttcgctgctccctgcttggcttatgaaaacaccactgaacagaaatttctccagggagccacaggctctccttcatcgcattttgatttttttgttcattctctagacaaaatccatcagggaatgctgcaggaaacgattgccaactatacgaatggcttcgaggagataaactgaaatttgctatataattaatattttggcagatgataggggaactcctcaacactcagtgggccaattgttcttaaaaccaattgcacgtttggtgaaagtttcttcaactctgaatcaaaagctgaaattctcagaattacaggaaatgcaaaccatcatttaatttctaatttcaagttacatccgctttatggagatactatttagataacaagaatacaacttgatacttttattgttatacctttttgaacatgtatgatttctgttgttattcctattggagctaagtttgtctacactaaaatttaaatcagactagagaataatttttgtggcatgttgtaacatttcacagtatttacaagctatttttgcacaggtacatagctctcatgtatttaaagaacactgcagtgttattttctttgaaattcatcctccacggacccattcatactaaataaaacaatgtaattacattaaaatggacctatctgtaagaggtactaaaaacactggattcatttcatcttgcaaatgttgtatttcaaaccagtttcacataagttatttgtcttcttttcaaaataattagctatatttttatataatatgaatatatacataaaaattgtttctataaattgtagaacatagatgctacagtattttttatttaattatattatgaataaaattgttatttcaatagtacccaaccaaagatgcttaaaaaccttctatgttcataaaaaataacaactgagatgttaaaatagtcatacgtctttagatgctattaaagtttcattagtcatatttttgtaaatatgacagaatttgtgaatatatttttaaagcaaaaaacttcaacatgcatatgatatatagttacaacattaattttatgaactggagagctttactttgtggatatatttaaaattcatattatagctcctattaaattccttccatgatagatataaaggactggtttttaagtgcactgcacttctggaatactgaaaaagaatgaaaacaatatgttagattaggtgtaagactttaagaagcgaacaaaaagtaatgtatatctgtaatatataatcaaatgattcatttttctgttagactaggcaaattgttcaaaaataacctttttgtcttttaagtagcagtcactttgcttaagatgctaatagaaaactgtggttaaagatttaccctccctcttggtgaattattacactgtaagaaatgtatatgctactgtgttacatgttgtattagtaaattattagaatccaattaatgattcaattaacatatatcttatccaattcattatgtcaattcattaataaaataccttttatgtagaggctttatgttgcaattaaaaagttgggaaaatgaganaaannnnnn

SEQ ID NO: 728874 - DNA, 4420 bp, Homo sapiens
  misc_feature (1866)..(1866): n is a, c, g, or t
  misc_feature (2217)..(2217): n is a, c, g, or t
gctgctctgctgattgtctccactatcctgttttgctcctacccactaatccagcctgggaggctctgggcattagcggaaggcttcaccacaaggagacaggagcgagtattccataggcatgcgctcctagtggcacgagtggcttgggtcaggatcaaagagtgaaggattcggaagtcagctatcttctcgtttggagcacagggaccgcccagctagaggagcaccagcgcactgcgccccagccctgggcgagggtgcggaggatttgttctcggtgcaatcctgctggcgcttttccggggttctgcgcggatccagctccccatctctgctcctacacacacaaaagaaaacaactctcgattggaagttgtggaattttctcagcccctacgaggcgcggggattctccagccccggccctcctcccgccagcctgaggtctccttcgctcgcctgccttgctagggaccgcagtccctcagccgcagctgggtctgtccgccccgcctttgccctcgccttttcccggggcggatttggtgaagtcggcctcaagtccaggaggtctgtcttcgccgggccagctctcgcggaactggggggtagagagcaaagggagagattcgtggaagggaagggaggtaggggtggcgcaaacgcccagagtatcaaacttgggggtggcacagtaggtgacagcagcagctgcaggtggtggctggggacccgcgagggggcgcccctctgggtagggtctggctgagcgggcttgcaagcccgggaggcggctgagagaccctggacactgttcctgctccctcgccaccaaaacttctcctccagtcccctcccctgcaggaccatcgcccgcagcctctgcacctgttttcttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactgctccggctgcccgcccgcgcggcgcgggctgtcctggaccctaggaggggacggaaccggacttgcctttgggcaccttccagggccctctccaggtcggctggctaatcatcggacagacggactgcacacatcttgtttccgcgtctccgcaaaaacgcgaggtccaggtcagttgtagactcttgtgctggttgcaggccaagtggacctgtactgaaaatgggtccaataggtgcagaggctgatgagaaccagacagtggaagaaatgaaggtggaacaatacgggccacaaacaactcctagaggtgaactggtccctgaccctgagccagagcttatagatagtaccaagctgattgaggtacaagttgttctcatattggcctactgctccatcatcttgcttggggtaattggcaactccttggtgatccatgtggtgatcaaattcaagagcatgcgcacagtaaccaactttttcattgccaatctggctgtggcagatcttttggtgaacactctgtgtctaccgttcactcttacctataccttaatgggggagtggaaaatgggtcctgtcctgtgccacctggtgccctatgcccagggcctggcagtacaagtatccacaatcaccttgacagtaattgccctggaccggcacaggtgcatcgtctaccacctagagagcaagatctccaagcgaatcagcttcctgattattggcttggcctggggcatcagtgccctgctggcaagtcccctggccatcttccgggagtattcgctgattgagatcatnccggactttgagattgtggcctgtactgaaaagtggcctggcgaggagaagagcatctatggcactgtctatagtctttcttccttgttgatcttgtatgttttgcctctgggcattatatcattttcctacactcgcatttggagtaaattgaagaaccatgtcagtcctggagctgcaaatgaccactaccatcagcgaaggcaaaaaaccaccaaaatgctggtgtgtgtggtggtggtgtttgcggtcagctggctgcctctccatgccttccagcttgccgttgacattgacagccaggtcctggacctgaaggagtacaaactcatcttcacagtgttccacatnatcgccatgtgctccacttttgccaatccccttctctatggctggatgaacagcaactacagaaaggctttcctctcggccttccgctgtgagcagcggttggatgccattcactctgaggtgtccgtgacattcaaggctaaaaagaacctggaggtcagaaagaacagtggccccaatgactctttcacagaggctaccaatgtctaaggaagctgtggtgtgaaaatgtatggatgaattctgaccagagctatgaatctggttgatggcggctcacaagtgaaaactgatttcccattttaaagaagaagtggatctaaatggaagcatctgctgtttaattcctggaaaactggctgggcagagcctgtgtgaaaatactggaattcaaagataaggcaacaaaatggtttacttaacagttggttgggtagtaggttgcattatgagtaaaagcagagagaagtacttttgattattttcctggagtgaagaaaacttgaacaagaaattggtattatcaaagcattgctgagagacggtgggaaaataagttgactttcaaatcacgttaggacctggattgaggaggtgtgcagttcgctgctccctgcttggcttatgaaaacaccactgaacagaaatttctccagggagccacaggctctccttcatcgcattttgatttttttgttcattctctagacaaaatccatcagggaatgctgcaggaaacgattgccaactatacgaatggcttcgaggagataaactgaaatttgctatataattaatattttggcagatgataggggaactcctcaacactcagtgggccaattgttcttaaaaccaattgcacgtttggtgaaagtttcttcaactctgaatcaaaagctgaaattctcagaattacaggaaatgcaaaccatcatttaatttctaatttcaagttacatccgctttatggagatactatttagataacaagaatacaacttgatacttttattgttatacctttttgaacatgtatgatttctgttgttatttacctttttaaacagataaatatttttttttcattttagagtagcggaatctaatcttaatctaatcttttaggagtatatttcagagaaattccaagcacaccagtatgaccatccttatttcagaaatgacaatgcatagaggaaaagtaatatgtgcaaagcctccgaagaggatggttaagtaaagacttaggttaccagtatcaggctttcgtttttgtatgtaggtagctctactgcctcctcttaaaaccaacaaaggaaagagagactggctgcaaacttttagaaggaatggcttcgaatagggttcctgggaggaatcccgaggaaatagacgctgctgctctgctgattgtctccactatcctgttttgctcctacccactaatccagcctgggaggctctgggcattagcggaaggcttcaccacaaggagacaggagcgagtattccataggcatgcgctcctagtggcacgagtggcttgggtcaggatcaaagagtgaaggattcggaagtcagctatctggagagagagagagattgtgttttattcgtgtcccatagctttcctatcctatccctatcctagcttttaacctgagccagagctcactacacaggttcctggctatcgagtctgaatctgcactactcaacttataaactgtctgcagacacctgttagggaaattgctgatcatgggcggcaggatctgaactcgctttaccttcttgtttggagcacagggaccgcccagctagaggagcaccagcgcactgcgccccagccctgggcgagggtgcggaggatttgttctcggtgcaatcctgctggcgcttttccggggttctgcgcggatccagctccccatctctgctcctacacacacaaaagaaaacaactctcgattggaagttgtggaattttctcagcccctacgaggcgcggggattctccagccccggccctcctcccgccagcctgaggtctccttcgctcgcctgccttgctagggaccgcagtccctcagccgcagctgggtctgtccgccccgcctttgccctcgccttttcccggggcggatttggtgaagtcggcctcaagtccaggaggtctgtcttcgccgggccagctctc

SEQ ID NO: 728875 - DNA, 4304 bp, Homo sapiens
  misc_feature (1740)..(1740): n is a, c, g, or t
  misc_feature (2091)..(2091): n is a, c, g, or t
  misc_feature (4295)..(4295): n is a, c, g, or t
  misc_feature (4299)..(4304): n is a, c, g, or t
gctgctctgctgattgtctccactatcctgttttgctcctacccactaatccagcctgggaggctctgggcattagcggaaggcttcaccacaaggagacaggagcgagtattccataggcatgcgctcctagtggcacgagtggcttgggtcaggatcaaagagtgaaggattcggaagtcagctatcttctcgtttggagcacagggaccgcccagctagaggagcaccagcgcactgcgccccagccctgggcgagggtgcggaggatttgttctcggtgcaatcctgctggcgcttttccggggttctgcgcggatccagctccccatctctgctccttgctagggaccgcagtccctcagccgcagctgggtctgtccgccccgcctttgccctcgccttttcccggggcggatttggtgaagtcggcctcaagtccaggaggtctgtcttcgccgggccagctctcgcggaactggggggtagagagcaaagggagagattcgtggaagggaagggaggtaggggtggcgcaaacgcccagagtatcaaacttgggggtggcacagtaggtgacagcagcagctgcaggtggtggctggggacccgcgagggggcgcccctctgggtagggtctggctgagcgggcttgcaagcccgggaggcggctgagagaccctggacactgttcctgctccctcgccaccaaaacttctcctccagtcccctcccctgcaggaccatcgcccgcagcctctgcacctgttttcttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactgctccggctgcccgcccgcgcggcgcgggctgtcctggaccctaggaggggacggaaccggacttgcctttgggcaccttccagggccctctccaggtcggctggctaatcatcggacagacggactgcacacatcttgtttccgcgtctccgcaaaaacgcgaggtccaggtcagttgtagactcttgtgctggttgcaggccaagtggacctgtactgaaaatgggtccaataggtgcagaggctgatgagaaccagacagtggaagaaatgaaggtggaacaatacgggccacaaacaactcctagaggtgaactggtccctgaccctgagccagagcttatagatagtaccaagctgattgaggtacaagttgttctcatattggcctactgctccatcatcttgcttggggtaattggcaactccttggtgatccatgtggtgatcaaattcaagagcatgcgcacagtaaccaactttttcattgccaatctggctgtggcagatcttttggtgaacactctgtgtctaccgttcactcttacctataccttaatgggggagtggaaaatgggtcctgtcctgtgccacctggtgccctatgcccagggcctggcagtacaagtatccacaatcaccttgacagtaattgccctggaccggcacaggtgcatcgtctaccacctagagagcaagatctccaagcgaatcagcttcctgattattggcttggcctggggcatcagtgccctgctggcaagtcccctggccatcttccgggagtattcgctgattgagatcatnccggactttgagattgtggcctgtactgaaaagtggcctggcgaggagaagagcatctatggcactgtctatagtctttcttccttgttgatcttgtatgttttgcctctgggcattatatcattttcctacactcgcatttggagtaaattgaagaaccatgtcagtcctggagctgcaaatgaccactaccatcagcgaaggcaaaaaaccaccaaaatgctggtgtgtgtggtggtggtgtttgcggtcagctggctgcctctccatgccttccagcttgccgttgacattgacagccaggtcctggacctgaaggagtacaaactcatcttcacagtgttccacatnatcgccatgtgctccacttttgccaatccccttctctatggctggatgaacagcaactacagaaaggctttcctctcggccttccgctgtgagcagcggttggatgccattcactctgaggtgtccgtgacattcaaggctaaaaagaacctggaggtcagaaagaacagtggccccaatgactctttcacagaggctaccaatgtctaaggaagctgtggtgtgaaaatgtatggatgaattctgaccagagctatgaatctggttgatggcggctcacaagtgaaaactgatttcccattttaaagaagaagtggatctaaatggaagcatctgctgtttaattcctggaaaactggctgggcagagcctgtgtgaaaatactggaattcaaagataaggcaacaaaatggtttacttaacagttggttgggtagtaggttgcattatgagtaaaagcagagagaagtacttttgattattttcctggagtgaagaaaacttgaacaagaaattggtattatcaaagcattgctgagagacggtgggaaaataagttgactttcaaatcacgttaggacctggattgaggaggtgtgcagttcgctgctccctgcttggcttatgaaaacaccactgaacagaaatttctccagggagccacaggctctccttcatcgcattttgatttttttgttcattctctagacaaaatccatcagggaatgctgcaggaaacgattgccaactatacgaatggcttcgaggagataaactgaaatttgctatataattaatattttggcagatgataggggaactcctcaacactcagtgggccaattgttcttaaaaccaattgcacgtttggtgaaagtttcttcaactctgaatcaaaagctgaaattctcagaattacaggaaatgcaaaccatcatttaatttctaatttcaagttacatccgctttatggagatactatttagataacaagaatacaacttgatacttttattgttatacctttttgaacatgtatgatttctgttgttattcctattggagctaagtttgtctacactaaaatttaaatcagactagagaataatttttgtggcatgttgtaacatttcacagtatttacaagctatttttgcacaggtacatagctctcatgtatttaaagaacactgcagtgttattttctttgaaattcatcctccacggacccattcatactaaataaaacaatgtaattacattaaaatggacctatctgtaagaggtactaaaaacactggattcatttcatcttgcaaatgttgtatttcaaaccagtttcacataagttatttgtcttcttttcaaaataattagctatatttttatataatatgaatatatacataaaaattgtttctataaattgtagaacatagatgctacagtattttttatttaattatattatgaataaaattgttatttcaatagtacccaaccaaagatgcttaaaaaccttctatgttcataaaaaataacaactgagatgttaaaatagtcatacgtctttagatgctattaaagtttcattagtcatatttttgtaaatatgacagaatttgtgaatatatttttaaagcaaaaaacttcaacatgcatatgatatatagttacaacattaattttatgaactggagagctttactttgtggatatatttaaaattcatattatagctcctattaaattccttccatgatagatataaaggactggtttttaagtgcactgcacttctggaatactgaaaaagaatgaaaacaatatgttagattaggtgtaagactttaagaagcgaacaaaaagtaatgtatatctgtaatatataatcaaatgattcatttttctgttagactaggcaaattgttcaaaaataacctttttgtcttttaagtagcagtcactttgcttaagatgctaatagaaaactgtggttaaagatttaccctccctcttggtgaattattacactgtaagaaatgtatatgctactgtgttacatgttgtattagtaaattattagaatccaattaatgattcaattaacatatatcttatccaattcattatgtcaattcattaataaaataccttttatgtagaggctttatgttgcaattaaaaagttgggaaaatgaganaaannnnnn

SEQ ID NO: 728876 - DNA, 4294 bp, Homo sapiens
  misc_feature (1740)..(1740): n is a, c, g, or t
  misc_feature (2091)..(2091): n is a, c, g, or t
gctgctctgctgattgtctccactatcctgttttgctcctacccactaatccagcctgggaggctctgggcattagcggaaggcttcaccacaaggagacaggagcgagtattccataggcatgcgctcctagtggcacgagtggcttgggtcaggatcaaagagtgaaggattcggaagtcagctatcttctcgtttggagcacagggaccgcccagctagaggagcaccagcgcactgcgccccagccctgggcgagggtgcggaggatttgttctcggtgcaatcctgctggcgcttttccggggttctgcgcggatccagctccccatctctgctccttgctagggaccgcagtccctcagccgcagctgggtctgtccgccccgcctttgccctcgccttttcccggggcggatttggtgaagtcggcctcaagtccaggaggtctgtcttcgccgggccagctctcgcggaactggggggtagagagcaaagggagagattcgtggaagggaagggaggtaggggtggcgcaaacgcccagagtatcaaacttgggggtggcacagtaggtgacagcagcagctgcaggtggtggctggggacccgcgagggggcgcccctctgggtagggtctggctgagcgggcttgcaagcccgggaggcggctgagagaccctggacactgttcctgctccctcgccaccaaaacttctcctccagtcccctcccctgcaggaccatcgcccgcagcctctgcacctgttttcttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactgctccggctgcccgcccgcgcggcgcgggctgtcctggaccctaggaggggacggaaccggacttgcctttgggcaccttccagggccctctccaggtcggctggctaatcatcggacagacggactgcacacatcttgtttccgcgtctccgcaaaaacgcgaggtccaggtcagttgtagactcttgtgctggttgcaggccaagtggacctgtactgaaaatgggtccaataggtgcagaggctgatgagaaccagacagtggaagaaatgaaggtggaacaatacgggccacaaacaactcctagaggtgaactggtccctgaccctgagccagagcttatagatagtaccaagctgattgaggtacaagttgttctcatattggcctactgctccatcatcttgcttggggtaattggcaactccttggtgatccatgtggtgatcaaattcaagagcatgcgcacagtaaccaactttttcattgccaatctggctgtggcagatcttttggtgaacactctgtgtctaccgttcactcttacctataccttaatgggggagtggaaaatgggtcctgtcctgtgccacctggtgccctatgcccagggcctggcagtacaagtatccacaatcaccttgacagtaattgccctggaccggcacaggtgcatcgtctaccacctagagagcaagatctccaagcgaatcagcttcctgattattggcttggcctggggcatcagtgccctgctggcaagtcccctggccatcttccgggagtattcgctgattgagatcatnccggactttgagattgtggcctgtactgaaaagtggcctggcgaggagaagagcatctatggcactgtctatagtctttcttccttgttgatcttgtatgttttgcctctgggcattatatcattttcctacactcgcatttggagtaaattgaagaaccatgtcagtcctggagctgcaaatgaccactaccatcagcgaaggcaaaaaaccaccaaaatgctggtgtgtgtggtggtggtgtttgcggtcagctggctgcctctccatgccttccagcttgccgttgacattgacagccaggtcctggacctgaaggagtacaaactcatcttcacagtgttccacatnatcgccatgtgctccacttttgccaatccccttctctatggctggatgaacagcaactacagaaaggctttcctctcggccttccgctgtgagcagcggttggatgccattcactctgaggtgtccgtgacattcaaggctaaaaagaacctggaggtcagaaagaacagtggccccaatgactctttcacagaggctaccaatgtctaaggaagctgtggtgtgaaaatgtatggatgaattctgaccagagctatgaatctggttgatggcggctcacaagtgaaaactgatttcccattttaaagaagaagtggatctaaatggaagcatctgctgtttaattcctggaaaactggctgggcagagcctgtgtgaaaatactggaattcaaagataaggcaacaaaatggtttacttaacagttggttgggtagtaggttgcattatgagtaaaagcagagagaagtacttttgattattttcctggagtgaagaaaacttgaacaagaaattggtattatcaaagcattgctgagagacggtgggaaaataagttgactttcaaatcacgttaggacctggattgaggaggtgtgcagttcgctgctccctgcttggcttatgaaaacaccactgaacagaaatttctccagggagccacaggctctccttcatcgcattttgatttttttgttcattctctagacaaaatccatcagggaatgctgcaggaaacgattgccaactatacgaatggcttcgaggagataaactgaaatttgctatataattaatattttggcagatgataggggaactcctcaacactcagtgggccaattgttcttaaaaccaattgcacgtttggtgaaagtttcttcaactctgaatcaaaagctgaaattctcagaattacaggaaatgcaaaccatcatttaatttctaatttcaagttacatccgctttatggagatactatttagataacaagaatacaacttgatacttttattgttatacctttttgaacatgtatgatttctgttgttatttacctttttaaacagataaatatttttttttcattttagagtagcggaatctaatcttaatctaatcttttaggagtatatttcagagaaattccaagcacaccagtatgaccatccttatttcagaaatgacaatgcatagaggaaaagtaatatgtgcaaagcctccgaagaggatggttaagtaaagacttaggttaccagtatcaggctttcgtttttgtatgtaggtagctctactgcctcctcttaaaaccaacaaaggaaagagagactggctgcaaacttttagaaggaatggcttcgaatagggttcctgggaggaatcccgaggaaatagacgctgctgctctgctgattgtctccactatcctgttttgctcctacccactaatccagcctgggaggctctgggcattagcggaaggcttcaccacaaggagacaggagcgagtattccataggcatgcgctcctagtggcacgagtggcttgggtcaggatcaaagagtgaaggattcggaagtcagctatctggagagagagagagattgtgttttattcgtgtcccatagctttcctatcctatccctatcctagcttttaacctgagccagagctcactacacaggttcctggctatcgagtctgaatctgcactactcaacttataaactgtctgcagacacctgttagggaaattgctgatcatgggcggcaggatctgaactcgctttaccttcttgtttggagcacagggaccgcccagctagaggagcaccagcgcactgcgccccagccctgggcgagggtgcggaggatttgttctcggtgcaatcctgctggcgcttttccggggttctgcgcggatccagctccccatctctgctcctacacacacaaaagaaaacaactctcgattggaagttgtggaattttctcagcccctacgaggcgcggggattctccagccccggccctcctcccgccagcctgaggtctccttcgctcgcctgccttgctagggaccgcagtccctcagccgcagctgggtctgtccgccccgcctttgccctcgccttttcccggggcggatttggtgaagtcggcctcaagtccaggaggtctgtcttcgccgggccagctctc

SEQ ID NO: 728877 - DNA, 4400 bp, Homo sapiens
  misc_feature (136)..(136): n is a, c, g, or t
  misc_feature (1836)..(1836): n is a, c, g, or t
  misc_feature (2187)..(2187): n is a, c, g, or t
  misc_feature (4391)..(4391): n is a, c, g, or t
  misc_feature (4395)..(4400): n is a, c, g, or t
tatcctatccctatcctagcttttaacctgagccagagctcactacacaggttcctggctatcgagtctgaatctgcactactcaacttataaactgtctgcagacacctgttagggaaattgctgatcatgggcngcaggatctgaactcgctttaccttctcgtttggagcacagggaccgcccagctagaggagcaccagcgcactgcgccccagccctgggcgagggtgcggaggatttgttctcggtgcaatcctgctggcgcttttccggggttctgcgcggatccagctccccatctctgctcctacacacacaaaagaaaacaactctcgattggaagttgtggaattttctcagcccctacgaggcgcggggattctccagccccggccctcctcccgccagcctgaggtctccttcgctcgcctgccttgctagggaccgcagtccctcagccgcagctgggtctgtccgccccgcctttgccctcgccttttcccggggcggatttggtgaagtcggcctcaagtccaggaggtctgtcttcgccgggccagctctcgcggaactggggggtagagagcaaagggagagattcgtggaagggaagggaggtaggggtggcgcaaacgcccagagtatcaaacttgggggtggcacagtaggtgacagcagcagctgcaggtggtggctggggacccgcgagggggcgcccctctgggtagggtctggctgagcgggcttgcaagcccgggaggcggctgagagaccctggacactgttcctgctccctcgccaccaaaacttctcctccagtcccctcccctgcaggaccatcgcccgcagcctctgcacctgttttcttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactgctccggctgcccgcccgcgcggcgcgggctgtcctggaccctaggaggggacggaaccggacttgcctttgggcaccttccagggccctctccaggtcggctggctaatcatcggacagacggactgcacacatcttgtttccgcgtctccgcaaaaacgcgaggtccaggtcagttgtagactcttgtgctggttgcaggccaagtggacctgtactgaaaatgggtccaataggtgcagaggctgatgagaaccagacagtggaagaaatgaaggtggaacaatacgggccacaaacaactcctagaggtgaactggtccctgaccctgagccagagcttatagatagtaccaagctgattgaggtacaagttgttctcatattggcctactgctccatcatcttgcttggggtaattggcaactccttggtgatccatgtggtgatcaaattcaagagcatgcgcacagtaaccaactttttcattgccaatctggctgtggcagatcttttggtgaacactctgtgtctaccgttcactcttacctataccttaatgggggagtggaaaatgggtcctgtcctgtgccacctggtgccctatgcccagggcctggcagtacaagtatccacaatcaccttgacagtaattgccctggaccggcacaggtgcatcgtctaccacctagagagcaagatctccaagcgaatcagcttcctgattattggcttggcctggggcatcagtgccctgctggcaagtcccctggccatcttccgggagtattcgctgattgagatcatnccggactttgagattgtggcctgtactgaaaagtggcctggcgaggagaagagcatctatggcactgtctatagtctttcttccttgttgatcttgtatgttttgcctctgggcattatatcattttcctacactcgcatttggagtaaattgaagaaccatgtcagtcctggagctgcaaatgaccactaccatcagcgaaggcaaaaaaccaccaaaatgctggtgtgtgtggtggtggtgtttgcggtcagctggctgcctctccatgccttccagcttgccgttgacattgacagccaggtcctggacctgaaggagtacaaactcatcttcacagtgttccacatnatcgccatgtgctccacttttgccaatccccttctctatggctggatgaacagcaactacagaaaggctttcctctcggccttccgctgtgagcagcggttggatgccattcactctgaggtgtccgtgacattcaaggctaaaaagaacctggaggtcagaaagaacagtggccccaatgactctttcacagaggctaccaatgtctaaggaagctgtggtgtgaaaatgtatggatgaattctgaccagagctatgaatctggttgatggcggctcacaagtgaaaactgatttcccattttaaagaagaagtggatctaaatggaagcatctgctgtttaattcctggaaaactggctgggcagagcctgtgtgaaaatactggaattcaaagataaggcaacaaaatggtttacttaacagttggttgggtagtaggttgcattatgagtaaaagcagagagaagtacttttgattattttcctggagtgaagaaaacttgaacaagaaattggtattatcaaagcattgctgagagacggtgggaaaataagttgactttcaaatcacgttaggacctggattgaggaggtgtgcagttcgctgctccctgcttggcttatgaaaacaccactgaacagaaatttctccagggagccacaggctctccttcatcgcattttgatttttttgttcattctctagacaaaatccatcagggaatgctgcaggaaacgattgccaactatacgaatggcttcgaggagataaactgaaatttgctatataattaatattttggcagatgataggggaactcctcaacactcagtgggccaattgttcttaaaaccaattgcacgtttggtgaaagtttcttcaactctgaatcaaaagctgaaattctcagaattacaggaaatgcaaaccatcatttaatttctaatttcaagttacatccgctttatggagatactatttagataacaagaatacaacttgatacttttattgttatacctttttgaacatgtatgatttctgttgttattcctattggagctaagtttgtctacactaaaatttaaatcagactagagaataatttttgtggcatgttgtaacatttcacagtatttacaagctatttttgcacaggtacatagctctcatgtatttaaagaacactgcagtgttattttctttgaaattcatcctccacggacccattcatactaaataaaacaatgtaattacattaaaatggacctatctgtaagaggtactaaaaacactggattcatttcatcttgcaaatgttgtatttcaaaccagtttcacataagttatttgtcttcttttcaaaataattagctatatttttatataatatgaatatatacataaaaattgtttctataaattgtagaacatagatgctacagtattttttatttaattatattatgaataaaattgttatttcaatagtacccaaccaaagatgcttaaaaaccttctatgttcataaaaaataacaactgagatgttaaaatagtcatacgtctttagatgctattaaagtttcattagtcatatttttgtaaatatgacagaatttgtgaatatatttttaaagcaaaaaacttcaacatgcatatgatatatagttacaacattaattttatgaactggagagctttactttgtggatatatttaaaattcatattatagctcctattaaattccttccatgatagatataaaggactggtttttaagtgcactgcacttctggaatactgaaaaagaatgaaaacaatatgttagattaggtgtaagactttaagaagcgaacaaaaagtaatgtatatctgtaatatataatcaaatgattcatttttctgttagactaggcaaattgttcaaaaataacctttttgtcttttaagtagcagtcactttgcttaagatgctaatagaaaactgtggttaaagatttaccctccctcttggtgaattattacactgtaagaaatgtatatgctactgtgttacatgttgtattagtaaattattagaatccaattaatgattcaattaacatatatcttatccaattcattatgtcaattcattaataaaataccttttatgtagaggctttatgttgcaattaaaaagttgggaaaatgaganaaannnnnn

SEQ ID NO: 728878 - DNA, 4274 bp, Homo sapiens; identical to SEQ ID NO: 262809
  misc_feature (136)..(136): n is a, c, g, or t
  misc_feature (1710)..(1710): n is a, c, g, or t
  misc_feature (2061)..(2061): n is a, c, g, or t
  misc_feature (4265)..(4265): n is a, c, g, or t
  misc_feature (4269)..(4274): n is a, c, g, or t

SEQ ID NO: 728879 - DNA, 4264 bp, Homo sapiens
  misc_feature (136)..(136): n is a, c, g, or t
  misc_feature (1710)..(1710): n is a, c, g, or t
  misc_feature (2061)..(2061): n is a, c, g, or t
tatcctatccctatcctagcttttaacctgagccagagctcactacacaggttcctggctatcgagtctgaatctgcactactcaacttataaactgtctgcagacacctgttagggaaattgctgatcatgggcngcaggatctgaactcgctttaccttctcgtttggagcacagggaccgcccagctagaggagcaccagcgcactgcgccccagccctgggcgagggtgcggaggatttgttctcggtgcaatcctgctggcgcttttccggggttctgcgcggatccagctccccatctctgctccttgctagggaccgcagtccctcagccgcagctgggtctgtccgccccgcctttgccctcgccttttcccggggcggatttggtgaagtcggcctcaagtccaggaggtctgtcttcgccgggccagctctcgcggaactggggggtagagagcaaagggagagattcgtggaagggaagggaggtaggggtggcgcaaacgcccagagtatcaaacttgggggtggcacagtaggtgacagcagcagctgcaggtggtggctggggacccgcgagggggcgcccctctgggtagggtctggctgagcgggcttgcaagcccgggaggcggctgagagaccctggacactgttcctgctccctcgccaccaaaacttctcctccagtcccctcccctgcaggaccatcgcccgcagcctctgcacctgttttcttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactgctccggctgcccgcccgcgcggcgcgggctgtcctggaccctaggaggggacggaaccggacttgcctttgggcaccttccagggccctctccaggtcggctggctaatcatcggacagacggactgcacacatcttgtttccgcgtctccgcaaaaacgcgaggtccaggtcagttgtagactcttgtgctggttgcaggccaagtggacctgtactgaaaatgggtccaataggtgcagaggctgatgagaaccagacagtggaagaaatgaaggtggaacaatacgggccacaaacaactcctagaggtgaactggtccctgaccctgagccagagcttatagatagtaccaagctgattgaggtacaagttgttctcatattggcctactgctccatcatcttgcttggggtaattggcaactccttggtgatccatgtggtgatcaaattcaagagcatgcgcacagtaaccaactttttcattgccaatctggctgtggcagatcttttggtgaacactctgtgtctaccgttcactcttacctataccttaatgggggagtggaaaatgggtcctgtcctgtgccacctggtgccctatgcccagggcctggcagtacaagtatccacaatcaccttgacagtaattgccctggaccggcacaggtgcatcgtctaccacctagagagcaagatctccaagcgaatcagcttcctgattattggcttggcctggggcatcagtgccctgctggcaagtcccctggccatcttccgggagtattcgctgattgagatcatnccggactttgagattgtggcctgtactgaaaagtggcctggcgaggagaagagcatctatggcactgtctatagtctttcttccttgttgatcttgtatgttttgcctctgggcattatatcattttcctacactcgcatttggagtaaattgaagaaccatgtcagtcctggagctgcaaatgaccactaccatcagcgaaggcaaaaaaccaccaaaatgctggtgtgtgtggtggtggtgtttgcggtcagctggctgcctctccatgccttccagcttgccgttgacattgacagccaggtcctggacctgaaggagtacaaactcatcttcacagtgttccacatnatcgccatgtgctccacttttgccaatccccttctctatggctggatgaacagcaactacagaaaggctttcctctcggccttccgctgtgagcagcggttggatgccattcactctgaggtgtccgtgacattcaaggctaaaaagaacctggaggtcagaaagaacagtggccccaatgactctttcacagaggctaccaatgtctaaggaagctgtggtgtgaaaatgtatggatgaattctgaccagagctatgaatctggttgatggcggctcacaagtgaaaactgatttcccattttaaagaagaagtggatctaaatggaagcatctgctgtttaattcctggaaaactggctgggcagagcctgtgtgaaaatactggaattcaaagataaggcaacaaaatggtttacttaacagttggttgggtagtaggttgcattatgagtaaaagcagagagaagtacttttgattattttcctggagtgaagaaaacttgaacaagaaattggtattatcaaagcattgctgagagacggtgggaaaataagttgactttcaaatcacgttaggacctggattgaggaggtgtgcagttcgctgctccctgcttggcttatgaaaacaccactgaacagaaatttctccagggagccacaggctctccttcatcgcattttgatttttttgttcattctctagacaaaatccatcagggaatgctgcaggaaacgattgccaactatacgaatggcttcgaggagataaactgaaatttgctatataattaatattttggcagatgataggggaactcctcaacactcagtgggccaattgttcttaaaaccaattgcacgtttggtgaaagtttcttcaactctgaatcaaaagctgaaattctcagaattacaggaaatgcaaaccatcatttaatttctaatttcaagttacatccgctttatggagatactatttagataacaagaatacaacttgatacttttattgttatacctttttgaacatgtatgatttctgttgttatttacctttttaaacagataaatatttttttttcattttagagtagcggaatctaatcttaatctaatcttttaggagtatatttcagagaaattccaagcacaccagtatgaccatccttatttcagaaatgacaatgcatagaggaaaagtaatatgtgcaaagcctccgaagaggatggttaagtaaagacttaggttaccagtatcaggctttcgtttttgtatgtaggtagctctactgcctcctcttaaaaccaacaaaggaaagagagactggctgcaaacttttagaaggaatggcttcgaatagggttcctgggaggaatcccgaggaaatagacgctgctgctctgctgattgtctccactatcctgttttgctcctacccactaatccagcctgggaggctctgggcattagcggaaggcttcaccacaaggagacaggagcgagtattccataggcatgcgctcctagtggcacgagtggcttgggtcaggatcaaagagtgaaggattcggaagtcagctatctggagagagagagagattgtgttttattcgtgtcccatagctttcctatcctatccctatcctagcttttaacctgagccagagctcactacacaggttcctggctatcgagtctgaatctgcactactcaacttataaactgtctgcagacacctgttagggaaattgctgatcatgggcggcaggatctgaactcgctttaccttcttgtttggagcacagggaccgcccagctagaggagcaccagcgcactgcgccccagccctgggcgagggtgcggaggatttgttctcggtgcaatcctgctggcgcttttccggggttctgcgcggatccagctccccatctctgctcctacacacacaaaagaaaacaactctcgattggaagttgtggaattttctcagcccctacgaggcgcggggattctccagccccggccctcctcccgccagcctgaggtctccttcgctcgcctgccttgctagggaccgcagtccctcagccgcagctgggtctgtccgccccgcctttgccctcgccttttcccggggcggatttggtgaagtcggcctcaagtccaggaggtctgtcttcgccgggccagctctc

SEQ ID NO: 728880 - DNA, 3558 bp, Homo sapiens; identical to SEQ ID NO: 262810
  misc_feature (994)..(994): n is a, c, g, or t
  misc_feature (1345)..(1345): n is a, c, g, or t
  misc_feature (3549)..(3549): n is a, c, g, or t
  misc_feature (3553)..(3558): n is a, c, g, or t

SEQ ID NO: 728881 - DNA, 3548 bp, Homo sapiens
  misc_feature (994)..(994): n is a, c, g, or t
  misc_feature (1345)..(1345): n is a, c, g, or t
aattcatagtggttatacaattcataaagtttataatattcattccacttaaaatgaaattaatccatttgatagcattcactttgaaattatgtctatactatcggtattatactttaccgtcatagcatatatttcagaaacctgatttaattgatccatatttgacaatagacttattaaagggtctatttcattaaaatgttttgctatgcacaattttagagagtagaggatattttgatccctaaccaaaattaaaccagtccatttgtgaaatttctttgcttcacctttgtgttttcctcgttccattggtttttgttgttgttgttttgttttattttgtttttctttttaggttgtagactcttgtgctggttgcaggccaagtggacctgtactgaaaatgggtccaataggtgcagaggctgatgagaaccagacagtggaagaaatgaaggtggaacaatacgggccacaaacaactcctagaggtgaactggtccctgaccctgagccagagcttatagatagtaccaagctgattgaggtacaagttgttctcatattggcctactgctccatcatcttgcttggggtaattggcaactccttggtgatccatgtggtgatcaaattcaagagcatgcgcacagtaaccaactttttcattgccaatctggctgtggcagatcttttggtgaacactctgtgtctaccgttcactcttacctataccttaatgggggagtggaaaatgggtcctgtcctgtgccacctggtgccctatgcccagggcctggcagtacaagtatccacaatcaccttgacagtaattgccctggaccggcacaggtgcatcgtctaccacctagagagcaagatctccaagcgaatcagcttcctgattattggcttggcctggggcatcagtgccctgctggcaagtcccctggccatcttccgggagtattcgctgattgagatcatnccggactttgagattgtggcctgtactgaaaagtggcctggcgaggagaagagcatctatggcactgtctatagtctttcttccttgttgatcttgtatgttttgcctctgggcattatatcattttcctacactcgcatttggagtaaattgaagaaccatgtcagtcctggagctgcaaatgaccactaccatcagcgaaggcaaaaaaccaccaaaatgctggtgtgtgtggtggtggtgtttgcggtcagctggctgcctctccatgccttccagcttgccgttgacattgacagccaggtcctggacctgaaggagtacaaactcatcttcacagtgttccacatnatcgccatgtgctccacttttgccaatccccttctctatggctggatgaacagcaactacagaaaggctttcctctcggccttccgctgtgagcagcggttggatgccattcactctgaggtgtccgtgacattcaaggctaaaaagaacctggaggtcagaaagaacagtggccccaatgactctttcacagaggctaccaatgtctaaggaagctgtggtgtgaaaatgtatggatgaattctgaccagagctatgaatctggttgatggcggctcacaagtgaaaactgatttcccattttaaagaagaagtggatctaaatggaagcatctgctgtttaattcctggaaaactggctgggcagagcctgtgtgaaaatactggaattcaaagataaggcaacaaaatggtttacttaacagttggttgggtagtaggttgcattatgagtaaaagcagagagaagtacttttgattattttcctggagtgaagaaaacttgaacaagaaattggtattatcaaagcattgctgagagacggtgggaaaataagttgactttcaaatcacgttaggacctggattgaggaggtgtgcagttcgctgctccctgcttggcttatgaaaacaccactgaacagaaatttctccagggagccacaggctctccttcatcgcattttgatttttttgttcattctctagacaaaatccatcagggaatgctgcaggaaacgattgccaactatacgaatggcttcgaggagataaactgaaatttgctatataattaatattttggcagatgataggggaactcctcaacactcagtgggccaattgttcttaaaaccaattgcacgtttggtgaaagtttcttcaactctgaatcaaaagctgaaattctcagaattacaggaaatgcaaaccatcatttaatttctaatttcaagttacatccgctttatggagatactatttagataacaagaatacaacttgatacttttattgttatacctttttgaacatgtatgatttctgttgttatttacctttttaaacagataaatatttttttttcattttagagtagcggaatctaatcttaatctaatcttttaggagtatatttcagagaaattccaagcacaccagtatgaccatccttatttcagaaatgacaatgcatagaggaaaagtaatatgtgcaaagcctccgaagaggatggttaagtaaagacttaggttaccagtatcaggctttcgtttttgtatgtaggtagctctactgcctcctcttaaaaccaacaaaggaaagagagactggctgcaaacttttagaaggaatggcttcgaatagggttcctgggaggaatcccgaggaaatagacgctgctgctctgctgattgtctccactatcctgttttgctcctacccactaatccagcctgggaggctctgggcattagcggaaggcttcaccacaaggagacaggagcgagtattccataggcatgcgctcctagtggcacgagtggcttgggtcaggatcaaagagtgaaggattcggaagtcagctatctggagagagagagagattgtgttttattcgtgtcccatagctttcctatcctatccctatcctagcttttaacctgagccagagctcactacacaggttcctggctatcgagtctgaatctgcactactcaacttataaactgtctgcagacacctgttagggaaattgctgatcatgggcggcaggatctgaactcgctttaccttcttgtttggagcacagggaccgcccagctagaggagcaccagcgcactgcgccccagccctgggcgagggtgcggaggatttgttctcggtgcaatcctgctggcgcttttccggggttctgcgcggatccagctccccatctctgctcctacacacacaaaagaaaacaactctcgattggaagttgtggaattttctcagcccctacgaggcgcggggattctccagccccggccctcctcccgccagcctgaggtctccttcgctcgcctgccttgctagggaccgcagtccctcagccgcagctgggtctgtccgccccgcctttgccctcgccttttcccggggcggatttggtgaagtcggcctcaagtccaggaggtctgtcttcgccgggccagctctc

SEQ ID NO: 728882 - DNA, 470 bp, Homo sapiens
aatgttgtggaaggaagggaaacttcaggaaaggcttgctcacctcgctcggggccgcggaggtgcctggccacagtgccaccctcctgaccctgccgaggtactcgagggccaccacgcatcccctcactggctgcagatcacatcagtttttcagtcagacttgttaatgtcaagggtccgtcacggtggtgataccactgtgtgacaggaagcgagagtcaacgcagggagcctgcaccctgcaaacagccacagcccttcactgaacggggagcataaatcccaccctagttagaaccatggcttttgtgcggaccagaagtgccagagccacaatataggggtgagatgtcttaccgttttgcggtgttgagtgtgtggattcccttttaagatagaaagtaggaaaactgccagtaagggagacgactcactaaaagaggattcagtctctggttgacatgttt

SEQ ID NO: 728883 - DNA, 451 bp, Homo sapiens; identical to SEQ ID NO: 1192

SEQ ID NO: 728884 - DNA, 613 bp, Homo sapiens
taatttgaaggttcttctttagtgctgattgatgttcctaagtcaccatccctaaagctatttttgattattccccatctctgctatcaggagcataatagaacagtggctggaattagagtcactcatgagggagacaggcaaacctgtgtgggttgggggtgtcttcctatgtaatagaaggtctcgtggtggggcatgctgtctttcgtttgaggggatgatgggcctccagttggtggcgaatcttttgaaacttgtttttagcattcccaaatttttttagagaaaaattcagaaagtacaggtgcctttggcgtttcatagtcaatatacaagcgagacacaagtattctccatggatgatttttgtgttgtcatggaatgaaagaaaaataccagtgggtctttactggccataatattttcgttttctcagttggcacatagctctttcgtgaattcacttctttccatcccctctctctacttttaaatattttatgggcagtaagctcacaatatgtgctagcacggctgctctctccaggggtcaggatgggtttaataatgagatgcgtaacagtgactctgtaaaaacccatttcaggtt

SEQ ID NO: 728885 - DNA, 487 bp, Homo sapiens
gtggaatcctaatagttttttccgtaatctccaactatatttaaaataatgcccttctaaatagctctgtaaagagcctattggaagctgcacatttaaaaatggcaatagcactgcaatatgctgtagcatgatgcctgtcagccatgttccagacaattccttgtaagtcatctttcatttaagtaaaaaacaggttatgaagtactgcctcccagaccggaagtgccattctaaaaactccactatatatatcctgggagccataaaactgcctattgggaggctaaatgctctgcttttctataaaacagagataaggttctagagggaagtactgttaccagaaacaagggcacgtttcttctctgcctagggaatgcttcatctgggggacagaggggaaggtttcaatggaaaagggaacttattatttaaccaggtccctactacatggtggccaacccttttcaaatgactcctctca

SEQ ID NO: 728886 - DNA, 435 bp, Homo sapiens
ggaaagtcctaactgtaatggagttcgctttcccaatgctgactcttatggttagtgcctttggagtttaagaagcatttcctgctccaagatcatgaagatactctcctctgtcttatggaagcttggttatttttgccttcacatttagatctttcatctaccccagatgaatgctacctgcttttaccctgagaactgtgtttggggggaccatgtacccctgaggggctcttcggggcacacagctcttctcttaccatgggcctcagaggcaggcccggagtgagtttcagactttgtgagtgaagcccttcaaaacacgaaatattcccagaaacccagtaagtgcagcagacctactctaactgggggcagtgggaggacgcccacatcctgccccctcagcccctctctgacaccccagggtggccc

SEQ ID NO: 728887 - DNA, 455 bp, Homo sapiens
gttaatatttattttctaaaaatattaaggctctcagttgtttcattaattctaaagggttaaaaagggctgaaatttgtttatagcactaaatgtttttaataggaaatttactcacataaaaaatttaagcagaagtagtagaatacagattatcataaaacatattttctatgaaaggcatttcttcctcatcttcaataaatatgaagaagttagaggagaggaaaagcaatcactctaagacaacttttcgtctttgagggacattatgataagcctgaaattaatacgcacaggctattgcatttttctgtgagaaatgtgcccctttgctgtgagattctaaaatgtgttcagatttagtttttattcaaatgatccaaggtaacgcattagttagataactgctatttcagatagtgaggttagctgagaaaaggaagcatggtaga

SEQ ID NO: 728888 - DNA, 451 bp, Homo sapiens
tagacagatattgtgtaacaagttaaccttaaggacacatgccttaaaggactattgagcaaaaaaaaataactaagctctttccaggtaacactcagggaacttttgcagtgtcatatccgttctctggtacctatgtgtccgatcttcctgcccatctgtttttttcactcaaagtcccagaatcctatgccacgggcagggattttcacctctcaatatagacccatgtaccttaccccatgttccaactgacttcctgagaaataaatcattgtccttgtatttcataagagacaacaaacattgattttgttgttaacatatgtgaggcttcgttcatccaataactatatattttaatcaccaataagtatcctaaaatttcagacggtaatgccctgagggatcaacttttaattcaattattgactacagtttgaggggtgcc

SEQ ID NO: 728889 - DNA, 748 bp, Homo sapiens
gtcacagttgctttgactatagagtccctatgtagaaatagaattatcctattctttttttggcaacctcactgatttacaatgaaattattggaatggtcaatagatacatccatatagcattttgacataagcaaaatgtaacttgactgaatagtaaaataatactgtaattttttatttccaatttcaaagattattttaaagaactgaggagatgatatattatgttgctatgcattggcaatttctggtaggaagttagggggaagatcaactcaaattctgaaactttactccattataaacttttctacatcctattagttccaaatatgcagaaagggattgtgcagatgataccattctgcttaaatgacaaacctggaatgatgaatgcttttcctggtcaattaacccctgccaaagctctcagtgactaaaagaaatgctgtggaacacagtctcaagtagactataaaatatacaattagaggtcttctgaagaggatagtgttccattagaaatctaccagctccttttaactctatgggtccctatttctcagaacttttaccagaggtttgttcagaaactggctcatcaccagttttcttaacaaagctttcagatctttgttatcacacaaagagataaagagtctgaaatcctccttatgattcaggcatcatctgttatcctagatcaatgtcaagctaaagatttttggaaaggattttggcaaag

SEQ ID NO: 728890 - DNA, 524 bp, Homo sapiens
tcaatctagaccttgagactaactgggagacagctggtgctgcagagtcacacactggctctgtgcctccagcaagccgtgtgctctgtctcccctgcttcccgccacatggagtgcagaagggaactcattcattattttaaatacaaaaaaagtaatacatgcttattgtaatagattcatgcaattcagaaaatgtaagaagtgaataacccctagaggtaatagtaacagtttggtgtgtatcctttcagacacagtgatattaatatatgtttgtgtacacatcaatatatacccacctttttaaaaagtaaggaatatatttacctattctgctctgtcttttagttacttaatgtcttttcatgtcagtacataggggatctccttccttgttttcagtggtgtgcacgatttctttgtatttagccattagcctgttgatggcaatctcagttgtttctgttttctttattacaaataatgctgtggtctttaccatttgtgtacacctaacttta

SEQ ID NO: 728891 - DNA, 352 bp, Homo sapiens
ggatttctgccaattacaagcaaaaggacccttaatgatgcaagtactgaactgggaataataaacaccaatagttgagtcaatgttcttgccattaaccaactgcacatgggagcaaatcacccctatagttgagaaagctgtctccaaaaaaggagaagtctttccttcctacttcaaaaatgtattcagagcctcagtagagaagatgtacacaaaaatgctttttaagtagtaaattgctgaacaatgataagagagtattattgaaacctcagggatgtagagtagaatgagcattattttttccctcttactactaaaaaaactgagtcacaaaaattagatggta

SEQ ID NO: 728892 - DNA, 452 bp, Homo sapiens
ggagctgcacttcagagagtcccactgtaatctgttaatagaatctgctttaaatgagtcactccttagactggcaatgacacccagcttagtctgtaaaatcaggaatctttgtgttggctgaaggaacttagtaatcttagttgaattcctcttccccatgtctttcaaaaccagagcactgggtcgaacctaacccacaaaataattcgtccaaattaaattgacttttttacataacatcagcaccaccccttacacttttaaagttaaagaccctgttgatcaggttacctgggaaatttcaagtgcatctgaccggggattatcaagctccttgtggacatctgtttctgatgctgtggaatgtgatgtcaccacaaataggaggattctgaattttgctggtactaatgctgagtggtgacttattggggccttgctcatgttac

SEQ ID NO: 728893 - DNA, 504 bp, Homo sapiens
gcttcccacatctggaggatgacgaccctcccctgaccacatctggagggcgtccagctgcgagccagcggggcacagctctcttctcctggcctggatccccacccccccaacccaggaagactgagaatcccatcatcgcgtgcacatctcatcccaggagggagagaggagctgccgagtagaaagcagactggctgcagggacagaagacaccaagggcaccctcccccacagctgcgcctggacctcctgcgagaagaggaagccttaggggtctttattgtaccctcaagaccccagagagaaacagaagtgctgaggggtcgcaggcaggtctcttaccctctctgggcctcgaatatttatccataggaggctgaaggtaactgcctcgcaactcattcatgagggtcaatgggacgacagtggcaagaggggttggcacactgcccagactgttccaaagccagggctggggctgccaaaaaggccacctgtgct

SEQ ID NO: 728894 - DNA, 1184 bp, Homo sapiens
tgcagccgccgccgccgccgacaccgcggcacatgggccggccccgccgctgccgtcgcccctagccccagcagccctggtctcgcagcctcctgcggctctggtcgcccgaccagccatgtctctcggcggagcctccgagcgcagcgtcccggccaccaagattgaaattaccgtgtcctgccggaacctgctagaccttgataccttctccaagtccgaccccatggtggtgctttacacgcagagccgggccagccaggagtggcgggagttcggacggaccgaggtgattgataacacgctgaacccagacttcgtgcgcaaattcgtcctcgactatttctttgaggaaaagcaaaatctgcgcttcgatgtgtacaacgtggactccaaaaccaacatctccaaaccggatttcctgggacaagcgttcctggccctgggagaggtgattggaggccagggcagccgagtagagcgaaccctcacgggtgtaccaggcaagaagtgtgggaccatattgctgactgcagaagagcttagcaattgtcgggacattgccaccatgcagctgtgtgcaaacaagctggacaagaaggacttctttgggaaatcagaccccttccttgtgttctacaggagcaatgaggatggcacgttcaccatctgccacaagacagaggttgtgaaaaacacgctgaatcctgtgtggcagcccttcagcatccctgtgcgggctctgtgcaatggagactatgacagaacggtgaagattgatgtgtacgactgggaccgggatggaagccacgatttcattggtgagttcaccaccagctaccgggagctgagcaaggcccagaaccagttcacagtatatgaggttcttaaccctcggaagaaatgtaagaagaagaaatatgtcaactcaggaactgtgacgctgctctccttctctgtggactctgaattcacttttgttgattacatcaagggagggacacagctgaacttcacagtagccattgacttcacggcttccaatgggaatcctctgcagcctacctccctgcactacatgagtccctaccagctcagcgcctatgccatggccctcaaggcagtgggagagatcatccaggactatgacagtgataagctcttcccagcttatggctttgggg

SEQ ID NO: 728895 - DNA, 3622 bp, Homo sapiens
agaaagcttggtacatgttccaggctatgatcctaaggacaaaagcttcagcaatatggcatttgagactacccatttttaaggcaatacctgtatgaatgcacacacacacgtgcaatacacacacacacacacaaactccacatacttcttgcctacttgttagtagatatgtatagttgccattgctagaagacagggatgtctggtgcctatttctacttatttataactacatgcaaaatgactgtctctcgggatattctttgaaagactccaactttcacagagaaaagccaacctgctccaaatgcccttgactacttccttcttgaataaattagggctggatttcattaccattcaaaaaagcgaagtctttttgcttggtgtcatattaaacttcaggtttttcgttttagtagttttttaaccatcaaaatatcttggagtttagaggcagaacgggaaacagaaatatgcatatttaacactttcctgccacgagggataaaatagaggaatgacatccacccctgacctcatacctgacatacatgtagatatattttatgccacccatctcccatcctgtagctacaattggcatacaactactattaacctcccttcaccaccactgtcaggtcctcttccagtcattccagtcattagctgtcctgaccaaacattaaaaaaaaaattcagctaaatacagaagaagatggtatgtctggctagtgggagtgattataactaaaaactttgctccttttgtgctgtccatgcagtatgtcttcttcctttctatcactttacaatgaaaaattgcctcagagctcaataagaagtctagagcctttttccagggctaaggaaagagaaaaggaatgtcctatagaaggttgttaggatagaatttggtaaaagaacgttgcaaatattgtaacagaccataggagatttcatcagcaataggattcttctttggagaaaatacattgtccataagacttgtactctgctcattcaactcatgtgagcaagctcaactcactccacctgggttaggtaacagaagtggagaacttcatagttcgtgtctagaaaataatgtttaaagttctggagaatgagggtattgcagattaaaaggcgagttgacaaatgaaggagcagtgaaagatttttggaagaagtgaagaagtgaaattctgaaaaggtaaaagaaagaaccagtatgtcacaggggccaagtcagaggacagataataagaaacaaagttgtatctgagagtcatatattaggacaggtgtcagatatttattttggtggccagataaaagcaaaaggcctagaaacagtgtgttagcaaagtaagaagaaatggtccaaataggcaaggataaggaaatccaaaggttgtctttaaatatttctcaaaagagaaagccttgaaagaagcatacaatagagaaaaaataaattaccagtatttattattagaaaagatagaaagacagacaaatcagtggaggaattaaaacagagaaactggagtttataaaacagagcccaatccttgccttctctccctccactcaaatagaaaaggagaatggagaaagagaaagaaggtattaggctacagtttataagagagatgagaaaaaaatacatttgggaatagagggaaagggtcaaaaggggtcacatttggagaaatatctgaaaatgagaaggagcagaatttttggaaacattttttaaagtctggcaacgctaattaagctgttgatctaaggatttgcaaattgagaggtgcaattattttccaaatgatttgtgacactcttattaattagaatatatattttgtgaatattgaaatctgagccaaaactagttagctttattaatatcttagggaaagaagagagaaagaaagagggagggagagagagaaagaaagaaagaaagaaagaaagaaagaaagaaagaaagaaagaaagaaaaagaaaagaagaaagaaagaaagaaaaagacaggaagaggaagagagagacagaaagaataaaaaaacagcaattctgaggatgagaataaattaatggtaggtattacatatgcatgtacatatatatatatctgtacacatatatatgtaaatatgatttggaatacatcaggattgtgaacttccacttgggatagcataaaagcaaaatataccatacaatttttcattttactcacaaattttactcacaaattctcctaaagacatttcactaggtcagtacatttccgagaaagttttaaaaacgtttcttcttttatagtccctaattatcttacctggagtgttatcaaaatgtcatacaactggaaaatgcaattattattataaaaatatctctgccttctcttgtgtaatgaaatttatggcattaggagatgacatttcaagagattttagaggtcaatgtagagactccccccattcttcttaattgaacaaacatgcataaatctagggtttcaggtagagagcagatgggaatctacaggaaactgtcttccatagtgtatgaaaaccgtgtttgttgtgtggtgaagcaaaaggaaactatgaagcgcacagtcaatagattcagctagtgagtcccagcactcctttcaggccctcactaggattagcagcccagagtcatgccaaggccactggtgcagtacaaagacagttcagtgacaagttccatccataccatggaagagggttaaacttgtggctgtttttgccacagcatgaccagagacattctcaataaatggcactaggaatgatgagttttagaggggcctaaaatgttccaaacttgatactcaccactgtacctttaaagcacaaccacagatattggtaaaaatggaacagaattacctcaatacctctttaactcattctgaatgaattcattttgatgacagacattttttgtcaccatttggaataagaactacaacagcttatgattgaggtgaggaactgcagtcaaatggcttaggttcaaacacgagttctgacacaaatctaggtaattttgggcaatattttaaaatcttagtttattcaccaattaataggagtaaaaattacccctacttaatagaattattatgaagatttatataagtaaatcatataaagtgcttagcacagtgtgactggcccacatggaacatttaatacttggtctgcagtatatgaagaaaatggtgtacatgttaacttaaatggtttcattatttctcttcaggatttttaagatgtgggatcagaatatatgttactattttgagaattagaaataataagaaaaacagaatgtatacattaaaagtcatgcctaaatttccaaagagtagtttttttaatgccagagtttaaataaaatattattttccagagagtaacttttctaaaggtcctaaattctgaaaagagagaaaactactgttataaacaagtttattactaaaagatgcaattcattactatgatttattattattttgtacatgtaaaccttgataaataaacagcatctcaacaccaaa

SEQ ID NO: 728896 - DNA, 3596 bp, Homo sapiens
agaaagcttggtacatgttccaggctatgatcctaaggacaaaagcttcagcaatatggcatttgagactacccatttttaaggcaatacctgtatgaatgcacacacacacgtgcaatacacacacacacacacaaactccacatacttcttgcctacttgttagtagatatgtatagttgccattgctagaagacagggatgtctggtgcctatttctacttatttataactacatgcaaaatgactgtctctcgggatattctttgaaagactccaactttcacagagaaaagccaacctgctccaaatgcccttgactacttccttcttgaataaattagggctggatttcattaccattcaaaaaagcgaagtctttttgcttggtgtcatattaaacttcaggtttttcgttttagtagttttttaaccatcaaaatatcttggagtttagaggcagaacgggaaacagaaatatgcatatttaacactttcctgccacgagggataaaatagaggaatgacatccacccctgacctcatacctgacatacatgtagatatattttatgccacccatctcccatcctgtagctacaattggcatacaactactattaacctcccttcaccaccactgtcaggtcctcttccagtcattccagtcattagctgtcctgaccaaacattaaaaaaaaaattcagctaaatacagaagaagatggtatgtctggctagtgggagtgattataactaaaaactttgctccttttgtgctgtccatgcagtatgtcttcttcctttctatcactttacaatgaaaaattgcctcagagctcaataagaagtctagagcctttttccagggctaaggaaagagaaaaggaatgtcctatagaaggttgttaggatagaatttggtaaaagaacgttgcaaatattgtaacagaccataggagatttcatcagcaataggattcttctttggagaaaatacattgtccataagacttgtactctgctcattcaactcatgtgagcaagctcaactcactccacctgggttaggtaacagaagtggagaacttcatagttcgtgtctagaaaataatgtttaaagttctggagaatgagggtattgcagattaaaaggcgagttgacaaatgaaggagcagtgaaagatttttggaagaagtgaagaagtgaaattctgaaaaggtaaaagaaagaaccagtatgtcacaggggccaagtcagaggacagataataagaaacaaagttgtatctgagagtcatatattaggacaggtgtcagatatttattttggtggccagataaaagcaaaaggcctagaaacagtgtgttagcaaagtaagaagaaatggtccaaataggcaaggataaggaaatccaaaggttgtctttaaatatttctcaaaagagaaagccttgaaagaagcatacaatagagaaaaaataaattaccagtatttattattagaaaagatagaaagacagacaaatcagtggaggaattaaaacagagaaactggagtttataaaacagagcccaatccttgccttctctccctccactcaaatagaaaaggagaatggagaaagagaaagaaggtattaggctacagtttataagagagatgagaaaaaaatacatttgggaatagagggaaagggtcaaaaggggtcacatttggagaaatatctgaaaatgagaaggagcagaatttttggaaacattttttaaagtctggcaacgctaattaagctgttgatctaaggatttgcaaattgagaggtgcaattattttccaaatgatttgtgacactcttattaattagaatatatattttgtgaatattgaaatctgagccaaaactagttagctttattaatatcttagggaaagaagagagaaagaaagagggagggagagagagaaagaaagaaagaaagaaagaaagaaagaaaagaagaaagaaagaaagaaaaagacaggaagaggaagagagagacagaaagaataaaaaaacagcaattctgaggatgagaataaattaatggtaggtattacatatgcatgtacatatatatatatctgtacacatatatatgtaaatatgatttggaatacatcaggattgtgaacttccacttgggatagcataaaagcaaaatataccatacaatttttcattttactcacaaattttactcacaaattctcctaaagacatttcactaggtcagtacatttccgagaaagttttaaaaacgtttcttcttttatagtccctaattatcttacctggagtgttatcaaaatgtcatacaactggaaaatgcaattattattataaaaatatctctgccttctcttgtgtaatgaaatttatggcattaggagatgacatttcaagagattttagaggtcaatgtagagactccccccattcttcttaattgaacaaacatgcataaatctagggtttcaggtagagagcagatgggaatctacaggaaactgtcttccatagtgtatgaaaaccgtgtttgttgtgtggtgaagcaaaaggaaactatgaagcgcacagtcaatagattcagctagtgagtcccagcactcctttcaggccctcactaggattagcagcccagagtcatgccaaggccactggtgcagtacaaagacagttcagtgacaagttccatccataccatggaagagggttaaacttgtggctgtttttgccacagcatgaccagagacattctcaataaatggcactaggaatgatgagttttagaggggcctaaaatgttccaaacttgatactcaccactgtacctttaaagcacaaccacagatattggtaaaaatggaacagaattacctcaatacctctttaactcattctgaatgaattcattttgatgacagacattttttgtcaccatttggaataagaactacaacagcttatgattgaggtgaggaactgcagtcaaatggcttaggttcaaacacgagttctgacacaaatctaggtaattttgggcaatattttaaaatcttagtttattcaccaattaataggagtaaaaattacccctacttaatagaattattatgaagatttatataagtaaatcatataaagtgcttagcacagtgtgactggcccacatggaacatttaatacttggtctgcagtatatgaagaaaatggtgtacatgttaacttaaatggtttcattatttctcttcaggatttttaagatgtgggatcagaatatatgttactattttgagaattagaaataataagaaaaacagaatgtatacattaaaagtcatgcctaaatttccaaagagtagtttttttaatgccagagtttaaataaaatattattttccagagagtaacttttctaaaggtcctaaattctgaaaagagagaaaactactgttataaacaagtttattactaaaagatgcaattcattactatgatttattattattttgtacatgtaaaccttgataaataaacagcatctcaacaccaaa

SEQ ID NO: 728897 - DNA, 3267 bp, Homo sapiens
agaaagcttggtacatgttccaggctatgatcctaaggacaaaagcttcagcaatatggcatttgagactacccatttttaaggcaatacctgtatgaatgcacacacacacgtgcaatacacacacacacacacaaactccacatacttcttgcctacttgttagtagatatgtatagttgccattgctagaagacagggatgtctggtgcctatttctacttatttataactacatgcaaaatgactgtctctcgggatattctttgaaagactccaactttcacagagaaaagccaacctgctccaaatgcccttgactacttccttcttgaataaattagggctggatttcattaccattcaaaaaagcgaagtctttttgcttggtgtcatattaaacttcaggtttttcgttttagtagttttttaaccatcaaaatatcttggagtttagaggcagaacgggaaacagaaatatgcatatttaacactttcctgccacgagggataaaatagaggaatgacatccacccctgacctcatacctgacatacatgtagatatattttatgccacccatctcccatcctgtagctacaattggcatacaactactattaacctcccttcaccaccactgtcaggtcctcttccagtcattccagtcattagctgtcctgaccaaacattaaaaaaaaaattcagctaaatacagaagaagatggtatgtctggctagtgggagtgattataactaaaaactttgctccttttgtgctgtccatgcagtatgtcttcttcctttctatcactttacaatgaaaaattgcctcagagctcaataagaagtctagagcctttttccagggctaaggaaagagaaaaggaatgtcctatagaaggttgttaggatagaatttggtaaaagaacgttgcaaatattgtaacagaccataggagatttcatcagcaataggattcttctttggagaaaatacattgtccataagacttgtactctgctcattcaactcatgtgagcaagctcaactcactccacctgggttaggtaacagaagtggagaacttcatagttcgtgtctagaaaataatgtttaaagttctggagaatgagggtattgcagattaaaaggcgagttgacaaatgaaggagcagtgaaagatttttggaagaagtgaagaagtgaaattctgaaaaggtaaaagaaagaaccagtatgtcacaggggccaagtcagaggacagataataagaaacaaagttgtatctgagagtcatatattaggacaggtgtcagatatttattttggtggccagataaaagcaaaaggcctagaaacagtgtgttagcaaagtaagaagaaatggtccaaataggcaaggataaggaaatccaaaggttgtctttaaatatttctcaaaagagaaagccttgaaagaagcatacaatagagaaaaaataaattaccagtatttattattagaaaagatagaaagacagacaaatcagtggaggaattaaaacagagaaactggagtttataaaacagagcccaatccttgccttctctccctccactcaaatagaaaaggagaatggagaaagagaaagaaggtattaggctacagtttataagaaagaaaagaagaaagaaagaaagaaaaagacaggaagaggaagagagagacagaaagaataaaaaaacagcaattctgaggatgagaataaattaatggtaggtattacatatgcatgtacatatatatatatctgtacacatatatatgtaaatatgatttggaatacatcaggattgtgaacttccacttgggatagcataaaagcaaaatataccatacaatttttcattttactcacaaattttactcacaaattctcctaaagacatttcactaggtcagtacatttccgagaaagttttaaaaacgtttcttcttttatagtccctaattatcttacctggagtgttatcaaaatgtcatacaactggaaaatgcaattattattataaaaatatctctgccttctcttgtgtaatgaaatttatggcattaggagatgacatttcaagagattttagaggtcaatgtagagactccccccattcttcttaattgaacaaacatgcataaatctagggtttcaggtagagagcagatgggaatctacaggaaactgtcttccatagtgtatgaaaaccgtgtttgttgtgtggtgaagcaaaaggaaactatgaagcgcacagtcaatagattcagctagtgagtcccagcactcctttcaggccctcactaggattagcagcccagagtcatgccaaggccactggtgcagtacaaagacagttcagtgacaagttccatccataccatggaagagggttaaacttgtggctgtttttgccacagcatgaccagagacattctcaataaatggcactaggaatgatgagttttagaggggcctaaaatgttccaaacttgatactcaccactgtacctttaaagcacaaccacagatattggtaaaaatggaacagaattacctcaatacctctttaactcattctgaatgaattcattttgatgacagacattttttgtcaccatttggaataagaactacaacagcttatgattgaggtgaggaactgcagtcaaatggcttaggttcaaacacgagttctgacacaaatctaggtaattttgggcaatattttaaaatcttagtttattcaccaattaataggagtaaaaattacccctacttaatagaattattatgaagatttatataagtaaatcatataaagtgcttagcacagtgtgactggcccacatggaacatttaatacttggtctgcagtatatgaagaaaatggtgtacatgttaacttaaatggtttcattatttctcttcaggatttttaagatgtgggatcagaatatatgttactattttgagaattagaaataataagaaaaacagaatgtatacattaaaagtcatgcctaaatttccaaagagtagtttttttaatgccagagtttaaataaaatattattttccagagagtaacttttctaaaggtcctaaattctgaaaagagagaaaactactgttataaacaagtttattactaaaagatgcaattcattactatgatttattattattttgtacatgtaaaccttgataaataaacagcatctcaacaccaaa

SEQ ID NO: 728898 - DNA, 467 bp, Homo sapiens
acattctcaattataatgtgcagaaatccccgtggttttccaatcctgactacattccccaacattaactgcttctttacaggtaagagtgagtctgcagttgtcccagtggccaatacaatgcctcctcttctctcgtctgcccttccaccaagcctctggcactctcaggcactcttttctaaggaatcagtgacaagataggaagcaataaggtcaggttagagtagctgctgcaaatgatcaaacatgataaggacaatgaggtgaactgtggttgcttttctcatcctgctcttctgacacctcccactctgcacaccaatccactatggaaaccaataagccttctttcagacccatggcaaacatgctgtaacagaaagcacagctacagagggcatgcattggaggcctgtgagctgaatctggcccacagatgtgatttgtttgaccccaacagtgtt

SEQ ID NO: 728899 - DNA, 682 bp, Homo sapiens
ggatgcaactgctagttttagatgtaaatagtgttatttactggactttgtgatattattttcttaactacactttactatggccctgttgaaaacagactatcaagttttttgtctctgttctgtcatctctcttaagccaggcacctttagagtgtttgcaatttgttcgaagtggttgaggatctcaggccctgctcacgtgaggtggagtgcaggggagctaccggtttccctgctgacctgctgaatgctaccttcccctcgagttgaatacaccttaaggaaaatgataacacgagggacgtgtaacttgttttgaagcattaaaaaccagcagctcttcactatgttccatattttaaccaaactactgtagactactaaacatagccaagccagaacattccttctggattaagcctaggccacttgaggggcagccaggggtgatggtgtcaggtgagaatcctgtgtcttgaaggagtggcctttacaggaagagtgcccatgttttcacctgcagcgttgccaccagagtgtgcaatacctcctgcacacaggctcagggtaaactgctccaaagctgggttttgtgttgcatacaaagtcaataaaatagttgctaatcctgaatggcagccagtgatgtgaaggtactattaaagtgaacaaaaactag

SEQ ID NO: 728900 - DNA, 1019 bp, Homo sapiens
gtcacataagagacagagcaagtaaaatattacgctacagtgctactggcccataatcaggcaactgcagagtcttagggggttatctaatgtagtcttggggtggctggatagacttcccaaagaaggtgatgccgaagctgaggtcggaaattacgaagatcagctatcaaacttggaaatcatgtcttagagatcaaggagccaagagatgagacaagcctgggttcctaggtgatagggtgtggctgtgtccccacccaaatctcgtcttgaattgtagctcccataatccccacatgttgtggagggaccctgtggaaggaaggcctgaggagagaagacacatagtcatgctgactaaaccagatcacctagaattaccaaatggaaagattgtgcctgcagcctggcctgttgcccacagcggtctacctgccacactgggaaagatcgagcagagacagagaagaaaaggaggctccatttttcaggctgctctcccgcaggctcatgttttgtgttcatgccaggcagagaacacaaaatgttccaataaataagtatcaaaggttagtggtgaaaatgaaggaggaagaggcattgcgtgaaaaactaaacatgcaaaatattacacacaaagagaaccaaaatgcaggttcactggaaatgatagacaatatgttaaaaccaagaggagagaagagagctgaaataatcaaatgggaaacacacaatttaggggctaagatcttgttgtgttcagccacaaatgatggccagcagtgaggaatctgtgtgttctccacactcttcgctcctgggaagtcaactcacatggaccatgatatcaatatctggtccttcccctaatatctgtttgaccttgggtcagttacttaaacttcctaagccttagttctttgtctggaaactagggatagttatacctacaacacaaccactttgtaaggaatatgttggaaattatatgcaaattggcttccgttggtgtttgg

SEQ ID NO: 728901 - DNA, 865 bp, Homo sapiens
gtcacataagagacagagcaagtaaaatattacgctacagtgctactggcccataatcaggcaactgcagagtcttagggggttatctaatgtagtcttggggtggctggatagacttcccaaagaaggtgatgccgaagctgaggtcggaaattacgaagatcagctatgaaggcctgaggagagaagacacatagtcatgctgactaaaccagatcacctagaattaccaaatggaaagattgtgcctgcagcctggcctgttgcccacagcggtctacctgccacactgggaaagatcgagcagagacagagaagaaaaggaggctccatttttcaggctgctctcccgcaggctcatgttttgtgttcatgccaggcagagaacacaaaatgttccaataaataagtatcaaaggttagtggtgaaaatgaaggaggaagaggcattgcgtgaaaaactaaacatgcaaaatattacacacaaagagaaccaaaatgcaggttcactggaaatgatagacaatatgttaaaaccaagaggagagaagagagctgaaataatcaaatgggaaacacacaatttaggggctaagatcttgttgtgttcagccacaaatgatggccagcagtgaggaatctgtgtgttctccacactcttcgctcctgggaagtcaactcacatggaccatgatatcaatatctggtccttcccctaatatctgtttgaccttgggtcagttacttaaacttcctaagccttagttctttgtctggaaactagggatagttatacctacaacacaaccactttgtaaggaatatgttggaaattatatgcaaattggcttccgttggtgtttgg

SEQ ID NO: 728902 - DNA, 743 bp, Homo sapiens
gccttttaaaggaccatgggctgtttgaggggccaacatcattaactggaaggcctgaggagagaagacacatagtcatgctgactaaaccagatcacctagaattaccaaatggaaagattgtgcctgcagcctggcctgttgcccacagcggtctacctgccacactgggaaagatcgagcagagacagagaagaaaaggaggctccatttttcaggctgctctcccgcaggctcatgttttgtgttcatgccaggcagagaacacaaaatgttccaataaataagtatcaaaggttagtggtgaaaatgaaggaggaagaggcattgcgtgaaaaactaaacatgcaaaatattacacacaaagagaaccaaaatgcaggttcactggaaatgatagacaatatgttaaaaccaagaggagagaagagagctgaaataatcaaatgggaaacacacaatttaggggctaagatcttgttgtgttcagccacaaatgatggccagcagtgaggaatctgtgtgttctccacactcttcgctcctgggaagtcaactcacatggaccatgatatcaatatctggtccttcccctaatatctgtttgaccttgggtcagttacttaaacttcctaagccttagttctttgtctggaaactagggatagttatacctacaacacaaccactttgtaaggaatatgttggaaattatatgcaaattggcttccgttggtgtttgg

SEQ ID NO: 728903 - DNA, 948 bp, Homo sapiens
gtcacataagagacagagcaagtaaaatattacgctacagtgctactggcccataatcaggcaactgcagagtcttagggggttatctaatgtagtcttggggtggctggatagacttcccaaagaaggtgatgccgaagctgaggtcggaaattacgaagatcagctatcaaacttggaaatcatgtcttagagatcaaggagccaagagatgagacaagcctgggttcctaggtgatagggtgtggctgtgtccccacccaaatctcgtcttgaattgtagctcccataatccccacatgttgtggagggaccctgtggaagattgtgcctgcagcctggcctgttgcccacagcggtctacctgccacactgggaaagatcgagcagagacagagaagaaaaggaggctccatttttcaggctgctctcccgcaggctcatgttttgtgttcatgccaggcagagaacacaaaatgttccaataaataagtatcaaaggttagtggtgaaaatgaaggaggaagaggcattgcgtgaaaaactaaacatgcaaaatattacacacaaagagaaccaaaatgcaggttcactggaaatgatagacaatatgttaaaaccaagaggagagaagagagctgaaataatcaaatgggaaacacacaatttaggggctaagatcttgttgtgttcagccacaaatgatggccagcagtgaggaatctgtgtgttctccacactcttcgctcctgggaagtcaactcacatggaccatgatatcaatatctggtccttcccctaatatctgtttgaccttgggtcagttacttaaacttcctaagccttagttctttgtctggaaactagggatagttatacctacaacacaaccactttgtaaggaatatgttggaaattatatgcaaattggcttccgttggtgtttgg

SEQ ID NO: 728904 - DNA, 474 bp, Homo sapiens; identical to SEQ ID NO: 400171

SEQ ID NO: 728905 - DNA, 539 bp, Homo sapiens
aaaagaaagaaagaaagaaagaaaaaaatgccatacagatgaatctttaaagattttaatttatatatacctcttctaccattcattggctggagtagttgaacagacatcagcaggcacaatgctaggcaggcactggagattcagtgatgaataaaacaaaactgacctggaacctggcctcctgaagcttctcttcatctgtctaaattcctttctttcaaggcccagtgcaagtgacaccttcatcaggaagggcttccacatgattctatctgcaaatctcccttttctgaactattatgcttatagtctgtaccaggccacatgacatatgttattttgtggcattctagaattattccaatcttttcattcttataattggtgtgttgtattcaataaataatgttgttattccagttttcatcactggtcacgcaagagtcctctcttaattatattttatccccatagttcaccccgtttcctccccatcctaagtaactattaccatacctaaatatatatctaattag

SEQ ID NO: 728906 - DNA, 1249 bp, Homo sapiens
tgacctccctggctcaggtgatcctgtcacctcagccttccaagtagctgagaccacaggcatgcaccactaagcctggctaatttttcaatttttatttttcgtagagacagggtctccctgggttgcccaaactggtcttgaattcctgggctcaagcaatcctcctgtcccggcaccccgaagtgttgggactacaggcatgagccactgtgcacagccctttttgtttttgtttttgtttttttttaaaggtaatttcccagtggaatcctcgagatttcttcacgtttttggaaaaatgagttacattttagattgttttcctttttggaatttaatggtatacattatattacatagctatgttgagctctatttctattacactaaaaagtaggctaattgtcttaactttcatcagtaatgacattaaatgtgtgaagattatacttggaataaagcacttggattcattcatttcttcagtaaatatttattgagcactagtatgttccaacgagtgtctgtctacattctggggacaagtgataactaaatccctgtcctcgtggagagttaacaatcaacaaactaacaaacatttaatttatgtcatcaactcatttccacaaatataacaacatcttgacttcaagtttcctgagtttctggtctaaagaattgctaccttcaagagctcaaatcatttgttggggagagaggcctgtgatatattttctcctttacaatgaaagtagctgtaaaaagaggaagagaaattctgagggtaaagataaaaaatgttgaaatcttctttctggatttcagattgagtctcttgccctaattgatgcaatttacactccatgcatctccttccctggaccttctccagttcttggggactacagatgaacttacttttaatgcattttatggcatttggaggccctccagtggacaaatactatacctgaaaaaaatccttttgctgtgctaaagtgttcaggtgtgaagtgtactcatgtttgcaaatcactttgaaatatataaacaaaaatgaattaatggatgaatagagtgatgcatagatcattagacatgtgataaaaataactgttaattgtagaatctagatgatgagtatattatatgatatggcccactgtataattctttcaacttttctgtttgaatgtttgataataaaatattgaataaaaatctttttgctaaagaaatatgc

SEQ ID NO: 728907 - DNA, 432 bp, Homo sapiens
gaagtgggagcggctgtcaggttagagctgtgctctgcctcaggggcaggggatgctaactctgagttggattctggggctgcttcaggttccctctcttgctttggctccttgggctcactgtgaaacgggtctgaattgtccctattccactcctcctctgaatctgtctctggctgggtgctgaggagggggccgttgttgatggggacactctgaacttcagcctgggcttcagctggtggcctagcagcttcctcctgagaatccttcatgtcctcggagtccttctcagcacacagcctgtacaccatcacatcatcctgaaagtccgactcttctatgtaggaccctttgaagagcaggagggcattcttcttcatctcctggatgtgtttggggggatcaatgggtgctggggggcctgaaacc

SEQ ID NO: 728908 - DNA, 1535 bp, Homo sapiens
cccaaatgcttctttggatctcaggctctaggtgcaatgtgaaggggagtcactgggcagactgatccctggctcagacagttcagtgggagaatcccaaaggccttttccctccttcctgagcctccgggcaaggagggagggatcttggttccagggtctcagtaccccctgtgccatttgagctgcttgcgctcatcatctctattaataaccaacttccctcccccactgccagtgctgcccccacgcctgcccagctcgtgttctccggtcacagcagctcagtcctccaaagctgctggaccccagggagagctgaccactgcccgagcagccggctgaatccacctccacaatgccgctctcaggaaccccggcccctaataagaagaggaaatccagcaagctgatcatggaactcactggaggtggacaggagagctcaggcttgaacctgggcaaaaagatcagtgtcccaagggatgtgatgttggaggaactgtcgctgcttaccaaccggggctccaagatgttcaaactgcggcagatgagggtggagaagtttatttatgagaaccaccctgatgttttctctgacagctcaatggatcacttccagaagttccttccaacagtggggggacagctgggcacagctggtcagggattctcatacagcaagagcaacggcagaggcggcagccaggcaagggggcagtggctctgccggacagtatggctctgatcagcagcaccatctgggctctgggtctggagctgggggtacaggtggtcccgcgggccaggctggcagaggaggagctgctggcacagcaggggttggtgagacaggatcaggagaccaggcaggcggagaaggaaaacatatcactgtgttcaagacctatatttccccatgggagcgagccatgggggttgacccccagcaaaaaatggaacttggcattgacctgctggcctatggggccaaagctgaacttcccaaatataagtccttcaacaggacggcaatgccctatggtggatatgagaaggcctccaaacgcatgaccttccagatgcccaagtttgacctggggcccttgctgagtgaacccctggtcctctacaaccaaaacctctccaacaggccttctttcaatcgaacccctattccctggctgagctctggggagcctgtagactacaacgtggatattggcatccccttggatggagaaacagaggagctgtgaggtgtttcctcctctgatttgcatcatttcccctctctggctccaatttggagagggaatgctgagcagatagcccccattgttaatccagtatccttatgggaatggagggaaaaaggagagatctacctttccatcctttactccaagtccccactccacgcatccttcctcaccaactcagagctccccttctacttgctccatatggaacctgctcgtttatggaatttgctctgccaccagtaacagtcaataaacttcaaggaaaatgaa

SEQ ID NO: 728909 - DNA, 1577 bp, Homo sapiens
cccaaatgcttctttggatctcaggctctaggtgcaatgtgaaggggagtcactgggcagactgatccctggctcagacagttcagtgggagaatcccaaaggccttttccctccttcctgagcctccgggcaaggagggagggatcttggttccagggtctcagtaccccctgtgccatttgagctgcttgcgctcatcatctctattaataaccaacttccctcccccactgccagtgctgcccccacgcctgcccagctcgtgttctccggtcacagcagctcagtcctccaaagctgctggaccccagggagagctgaccactgcccgagcagccggctgaatccacctccacaatgccgctctcaggaaccccggcccctaataagaagaggaaatccagcaagctgatcatggaactcactggaggtggacaggagagctcaggcttgaacctgggcaaaaagatcagtgtcccaagggatgtgatgttggaggaactgtcgctgcttaccaaccggggctccaagatgttcaaactgcggcagatgagggtggagaagtttatttatgagaaccaccctgatgttttctctgacagctcaatggatcacttccagaagttccttccaacagtggggggacagctgggcacagctggtcagggattctcatacagcaagagcaacggcagaggcggcagccaggcaagggggcagtggctctgccggacagtatggctctgatcagcagcaccatctgggctctgggtctggagctgggggtacaggtggtcccgcgggccaggctggcagaggaggagctgctggcacagcaggggttggtgagacaggatcaggagaccaggcaggcggagaaggaaaacatatcactgtgttcaagacctatatttccccatgggagcgagccatgggggttgacccccagcaaaaaatggaacttggcattgacctgctggcctatggggccaaagctgaacttcccaaatataagtccttcaacaggacggcaatgccctatggtggatatgagaaggcctccaaacgcatgaccttccagatgcccaagtttgacctggggcccttgctgagtgaacccctggtcctctacaaccaaaacctctccaacaggccttctttcaatcgaacccctattccctggctgagctctggggagcctgtagactacaacgtggatattggcatccccttggatggagaaacagaggagctgtgaggtgtttcctcctctgatttgcatcatttcccctctctggctccaatttggagagggaatgctgagcagatagcccccattgttaatccagtatccttatgggaatggagggaaaaaggagagatctacctttccatcctttactccaagtccccactccacgcatccttcctcaccaactcagagctccccttctacttgctccatatggaacctgctcgtttatggaatttgctctgccaccagtaacagtcaataaacttcaaggaaaatgaactcattcttcctttgatatttgagagcagatgaaagccgagg

SEQ ID NO: 728910 - DNA, 1451 bp, Homo sapiens
cccaaatgcttctttggatctcaggctctaggtgcaatgtgaaggggagtcactgggcagactgatccctggctcagacagttcagtgggagaatcccaaaggccttttccctccttcctgagcctccgggcaaggagggagggatcttggttccagggtctcagtaccccctgtgccatttgagctgcttgcgctcatcatctctattaataaccaacttccctcccccactgccagtgctgcccccacgcctgcccagctcgtgttctccggtcacagcagctcagtcctccaaagctgctggaccccagggagagctgaccactgcccgagcagccggctgaatccacctccacaatgccgctctcaggaaccccggcccctaataagaagaggaaatccaagatgttcaaactgcggcagatgagggtggagaagtttatttatgagaaccaccctgatgttttctctgacagctcaatggatcacttccagaagttccttccaacagtggggggacagctgggcacagctggtcagggattctcatacagcaagagcaacggcagaggcggcagccaggcaagggggcagtggctctgccggacagtatggctctgatcagcagcaccatctgggctctgggtctggagctgggggtacaggtggtcccgcgggccaggctggcagaggaggagctgctggcacagcaggggttggtgagacaggatcaggagaccaggcaggcggagaaggaaaacatatcactgtgttcaagacctatatttccccatgggagcgagccatgggggttgacccccagcaaaaaatggaacttggcattgacctgctggcctatggggccaaagctgaacttcccaaatataagtccttcaacaggacggcaatgccctatggtggatatgagaaggcctccaaacgcatgaccttccagatgcccaagtttgacctggggcccttgctgagtgaacccctggtcctctacaaccaaaacctctccaacaggccttctttcaatcgaacccctattccctggctgagctctggggagcctgtagactacaacgtggatattggcatccccttggatggagaaacagaggagctgtgaggtgtttcctcctctgatttgcatcatttcccctctctggctccaatttggagagggaatgctgagcagatagcccccattgttaatccagtatccttatgggaatggagggaaaaaggagagatctacctttccatcctttactccaagtccccactccacgcatccttcctcaccaactcagagctccccttctacttgctccatatggaacctgctcgtttatggaatttgctctgccaccagtaacagtcaataaacttcaaggaaaatgaactcattcttcctttgatatttgagagcagatgaaagccgagg

SEQ ID NO: 728911 - DNA, 1409 bp, Homo sapiens
cccaaatgcttctttggatctcaggctctaggtgcaatgtgaaggggagtcactgggcagactgatccctggctcagacagttcagtgggagaatcccaaaggccttttccctccttcctgagcctccgggcaaggagggagggatcttggttccagggtctcagtaccccctgtgccatttgagctgcttgcgctcatcatctctattaataaccaacttccctcccccactgccagtgctgcccccacgcctgcccagctcgtgttctccggtcacagcagctcagtcctccaaagctgctggaccccagggagagctgaccactgcccgagcagccggctgaatccacctccacaatgccgctctcaggaaccccggcccctaataagaagaggaaatccaagatgttcaaactgcggcagatgagggtggagaagtttatttatgagaaccaccctgatgttttctctgacagctcaatggatcacttccagaagttccttccaacagtggggggacagctgggcacagctggtcagggattctcatacagcaagagcaacggcagaggcggcagccaggcaagggggcagtggctctgccggacagtatggctctgatcagcagcaccatctgggctctgggtctggagctgggggtacaggtggtcccgcgggccaggctggcagaggaggagctgctggcacagcaggggttggtgagacaggatcaggagaccaggcaggcggagaaggaaaacatatcactgtgttcaagacctatatttccccatgggagcgagccatgggggttgacccccagcaaaaaatggaacttggcattgacctgctggcctatggggccaaagctgaacttcccaaatataagtccttcaacaggacggcaatgccctatggtggatatgagaaggcctccaaacgcatgaccttccagatgcccaagtttgacctggggcccttgctgagtgaacccctggtcctctacaaccaaaacctctccaacaggccttctttcaatcgaacccctattccctggctgagctctggggagcctgtagactacaacgtggatattggcatccccttggatggagaaacagaggagctgtgaggtgtttcctcctctgatttgcatcatttcccctctctggctccaatttggagagggaatgctgagcagatagcccccattgttaatccagtatccttatgggaatggagggaaaaaggagagatctacctttccatcctttactccaagtccccactccacgcatccttcctcaccaactcagagctccccttctacttgctccatatggaacctgctcgtttatggaatttgctctgccaccagtaacagtcaataaacttcaaggaaaatgaa

SEQ ID NO: 728912 - DNA, 470 bp, Homo sapiens
ccttttattacttttaggatttcctttttatcactggttttgatggattcgattaaggtgttccttggtgaagttttctgcatgtttcttgttcttgggataatcatatttctgtaatatttgaagtttatgatttccatggagcttctaaatctttcatccagtatgttttaaatatctttgtctctcttctccactacctgcccttcagggattccatttagccctatactagggtgtttaaagttttgatgctgatggtctttatgtgttttcaagtcatttgttaatgtgtgtttcatttatgttagtttcaacttctattccttctagtttaataatcttctcttctgcaatatttaatccagtgccttcttccatttcacactgtaaatcatagtttttatctacagaatttgatatttaaaaaatcttcaacctctccatttaattaaaatacaattatacta

SEQ ID NO: 728913 - DNA, 486 bp, Homo sapiens
ctctccacacaggtgtctgagagggctgaggtgggcaaggcgctgagagtccatgtcaccctcaccaacaccttaatggtggctctgagcagctgcacgatggtgctggaaggaagcggcctcatcaatgggcagatagcaaaggaccttgggactctggtggccggacacaccctccaaattcaactggacctctacccgaccaaagctggaccccgccagctccaggttctcatcagcagcaacgaggtcaaggagatcaaaggctacaaggacatcttcgtcactgtggctggggctccctgagacccgccctccagctgccctccctggcacccctgccccacctggctcctttctactcctggctatgtcgtcttggctccacctctgtcctctctctagcctgcctgggaatgaatgaagctctgttagaaacaccgtgtgctttgggaagagacaataaagatgtctttatttaaaaaa

SEQ ID NO: 728914 - DNA, 556 bp, Homo sapiens
gtaggtcagctctgaaagcacccggtgctgcggggcctgccttcctgtggcttcggcttgggcgccatcccaagccgggttggccagaactctgcctgtgcagccccgcccccaggcaagcaggaaacaatgcacctgagcaacctcctcccatctgcagaggaggaagctaaggtgtaggggggtcaaggcactggcctaaggtcccacagccaaggggtggctgggaggtgcaatcaggtctgcctggcacagagtctggtctcctgaccacgatgccaaactggttattattgtcaccacaatagaatactaataatagttgtcgtaattattattattgtggagggctgttctccaggcaggcaggtctgggttgctgcgtcactggggccaggaggctggctagtgcccacaatgaggcagggtcctgtcccaaacagcactaggagaatgctggagatgggaggctgagcccatcctgcagcctgggtcagcagcctggggcctcaccccaccctccatccaatgctgggtggcgggcagcctctccaat

SEQ ID NO: 728915 - DNA, 492 bp, Homo sapiens
gggaaaaatcagaactttgttgtacttccttacattcatttcctgattacatgatgcttttgttttgaatcacgtgtggagggtgtcaccaaaatctttagatgctttgtccttatgtggatctggacccagatcctagcaaatgttaccatctctgcctcacaaagatctgacagaatgcaggcagttggggctatccttaggagagacagctctccttcgcagtagatgcacctgggtgataaatccaactctgaccacaaggtggcaaaagagtaaatgacaattcctcatatatgttttgtatgtttatataaaactattggtttatataaaatgctctctaaaaatattaagaaaaacgtgtgctccttcacacatttttgggttgatgtctgatattttgcatcacaaatgtcaattggctacaaataatgtaatttgtgacaaatgttaatattcaaaaataaaactgttatgtcactatttcac

SEQ ID NO: 728916 - DNA, 574 bp, Homo sapiens; identical to SEQ ID NO: 415347

SEQ ID NO: 728917 - DNA, 403 bp, Homo sapiens
  misc_feature (75)..(75): n is a, c, g, or t
gaagaacaagcgaaatggctgacagccctggcctccaaagtcaccaggctcaaatcgctcgccctggacatcgantagggatgcagaggatcagaaaccggtacctggatggcatggtgcaggtgatggtcctaccagtgtgtctgttgaggtcacccgtcctaaagtgacctccctgaaagcctgagttgaaatccagactccacttcttgaggcctggccttggactcttgggcagcctctggaaatcctcctcttcaggcccagcggataccccaccttccctgtccatgtcttccttgtactccctgtattacccattgatgtgtaacaggtcaccctaaaacttcacctaaaatagcaatgatttatcatgtctcattgaatttgagacggggcacgc

SEQ ID NO: 728918 - DNA, 395 bp, Homo sapiens; identical to SEQ ID NO: 415346
  misc_feature (4)..(4): n is a, c, g, or t

SEQ ID NO: 728919 - DNA, 909 bp, Homo sapiens; identical to SEQ ID NO: 415361

SEQ ID NO: 728920 - DNA, 467 bp, Homo sapiens
tttatggcacctcttaaaggccaggtagaagagaggcaaccgaaagttactcagtagaacagtacagtcctcatttcttcaaggcagacagccttaaccacctagaggctgatggcctggggagtacttttcaagttctgaagcagatttgtcaaagtagacaaaatggcatttccctcctgaagattcttcactacctcgattcttatgaaatagtctaaggaagttctaaagaaataagacaagtgaattctattttcgttaccagagaaatacaatcgtactagacggggctgtaatctggtaactgtatgtattttagttcttcagtccctgggaaggagacaggagaaggtgggagggaggaaggggccagctgaaatggaaacagatccctgatccggggcggtcagtggaacccttcttggtgtgcgagagcctgtgcatttcagaggcagcaaaaaagt

SEQ ID NO: 728921 - DNA, 821 bp, Homo sapiens; identical to SEQ ID NO: 66318

SEQ ID NO: 728922 - DNA, 885 bp, Homo sapiens
cccagccacagccaccagccggtccccagcctgcatcccagccttcttggctggcagtcccgggtccacctcccacaggaactgtcctggggcatagacatcctcactgctcctctccagctatcctaggccactgtgtacacaccaggggactgaccccagagtgaacgggaagaggcggcccagggcagagctcagacagggacacctcttcggtgcactgaaaggtgtatatacgcttgtgtgcccaccccaaggcccaccttcccccaccgcccccagggctcccactcaccagggcgaccgtcaaggcccttttcctcccggagcaggaacccaaaaccctggggccctttctccaggtgcaggcagcggggcttggtgggcagtgcccagccctctgccaggggtgcagccaggggcaatcccagctggcgacactgttcttccaccttctggccctgccaccagcaaggtcacctgctgtccactctgccaaagctgtggggacccagcagggcatcagtataacacctgggcagggagagaagaggtatgctccccccacagcccctcctcccaggcactaagtggagcctggcacaaactgtagagggggaggatggtgataaaggtaggagaccagataaggaggttaggcgcatggggaaggaggcgtttcccgaggtgggcccaggcccggattgggggaggagagtgggagacaggcagtcacaccttcctggtgagttggttgtgagtgaacttctccacactgaccccattcacttccagcagccggccccgggggcacccctgcccgctcagctgctcctccagtacttagcaccaaccagaaaggaccctgattgcatagaaattaaa

SEQ ID NO: 728923 - DNA, 332 bp, Homo sapiens
atccagtatctccgtgattaccttcatctgccccggagattgtgcctgccactctatgctgcagccgtccagagactggaagtcctcagcctaaaggtctgaagggtgagcgacctgcaagactcacaagagggaaagcggacagagataacctacagacggagtgctgtgccgcctggtgccgacagcaaagctgaggctggggctgggtcagcaaccgaattccagtttagaggtggatttggttgaggatgtggtcagccacctcagtaaaattggagaggattattttgcattgaataaacttacagcaaaaaaacttaaaaaaaaaa

SEQ ID NO: 728924 - DNA, 640 bp, Homo sapiens
  misc_feature (332)..(332): n is a, c, g, or t
agcagtgcactccgtgaaggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgacttngatgagctgtgtttgaacgcacagcccgtggctgggagtgtactaaggacagatgtggcagaagtcagcaactgaagaaacatgcctgtcactgctcaagaggactgtctggtgccaggggcgagactgctgtaccaagttaccaagtggctttgcaaaggacgagtcgcatggggttgaatgcatgactgtgaggacatacaggccgcacgaatgccctgcaggggctttgttcgcctccattaactcatcttctccgctggctggctatcacgcgccatcatacatgacgaaacggagacatagtc

SEQ ID NO: 728925 - DNA, 590 bp, Homo sapiens; identical to SEQ ID NO: 407351

SEQ ID NO: 728926 - DNA, 905 bp, Homo sapiens
aggatgtgacaccccgagctactcacgtcagtctccaggaggttgtgcatgctggtttctgccacctccttggactcctcgaacttctccagcgcctggcgtagctcctcatcggggatcttgccctgccgcttcttcttgtagtcaaagtccaggcggcggccctccagtttcttcaggtggtgctggagacgtgggggacatgggtcacaccagtagcggccagagggccgccccacgcatggctttgacccactgtccctgcaccactggggatcctgcctgcctgagacccagagggcagtgccgaggctggaggttctggagggggtcaatgaagttctgcttgacctcgatgtccagggagtccttcacctctgccaggcgcttcatggactcgccggcatccagcaatgcgtcacctgtggagaagtggtgggggaagccatcataccgggcctgggaccactagactgagacactcctcagcctttgtttttgaaatagcgtttcacaggctggaacgcagtggcgctgtaccagctcactgcaggcctcaaactgggctcaagccatgctggcacctcagcctcccaagtagccgggaccacaggcgttcacccccacacctggatcctttccaacttctttgagatgaagtctcgctgttgcccaggctgcagtgcagtggcatgatctcagctcactgcaacctctgcctcccaggttcaagcaattctcctgtctcagcctcctgagtaagggggattacaggggcctgccaccacatccagctaatttttgtatttttaatagagacggggtttcaccatatagaccacaccggtctcgaactcctgaccttgtgatccgcccgcctcggcctcccaaagtgttgggattac

SEQ ID NO: 728927 - DNA, 3013 bp, Homo sapiens; identical to SEQ ID NO: 271853

SEQ ID NO: 728928 - DNA, 582 bp, Homo sapiens; identical to SEQ ID NO: 465342

SEQ ID NO: 728929 - DNA, 576 bp, Homo sapiens
  misc_feature (573)..(573): n is a, c, g, or t
tttggcatcttggcatcccatgtccccacactacaggtcctacggcctgggctggtagtggttcacacagaagacggcaccacgactaagtactttgtgagcagcggctccgtcactgtgaatgccgactcctctgtgcagttactagctgaagaagctgtgacactggacatgctggacctgggggcagcccgggccaacctggagaaggcgcagtcagaactgtcaggtgcggcggacgaggcagcacgggctgagatccagatccgtattgaggccaatgaagccctagtgaaggccctggagtaggtggtacctactgtctgacacccacggggaaactgagccaggtccaggccgatgagaagttcccagtgggctgaagtggccaccaggggtcagcagtgctccagttgctgggcttaaagcttcctggtgcctgtctgccaggtcatggaggattccccaatctggcatccccacgatgcctctggagagatggccttgattgcccctcaaagccacctgaaccgtcgtcaacttacccagcctgtctccattaaacaccaggancca

SEQ ID NO: 728930 - DNA, 642 bp, Homo sapiens
  misc_feature (14)..(14): n is a, c, g, or t
  misc_feature (604)..(604): n is a, c, g, or t
  misc_feature (639)..(639): n is a, c, g, or t
gccaaagctcctgnccctggagctagagaagacagcctgccaggagtatactgtcacagagttccagcctctgtactatgtggccgagagtttcaatgatgccaaggagaaagtgaggacttttgctgccacaatcccccggcccttctccgttcgctatgacccctacactcaaagggttgaggtcctggacaatactcagcagttgaagattttagctgactccattaatagtgaggttggaatcctttgccatgccctgcagaaaataaagtcatgaacagaaagtgacgtcatagacagaacttaggaggtcaaccaaaaaaatctgctgatagaagtatagtaactgcttcttttccctgaagaagaaaagttttatttgcaatgtcagcttttaatatattttcctaacatagtggaggatcaccaaataaatcaatttctctgaaatgaaagtatattaaaacccatcagtggtagatccttcagagtcacatttgatttagatatctcagaccttcaatttggtttaaaatgtaatttcccagttctcatcaacattccatccaaattttgggacccatatcatttgggctccggnctgttcattttttaacctccccaggtaagcaaatnacg

SEQ ID NO: 728931 - DNA, 1575 bp, Homo sapiens
  misc_feature (1429)..(1429): n is a, c, g, or t
  misc_feature (1493)..(1493): n is a, c, g, or t
  misc_feature (1533)..(1533): n is a, c, g, or t
cctctcctttcttctgtagctcgcgttgaagccgcacgtccggccccgatcccggcaccatgagcttcggctcggagcactacctgtgctcctcctcctcctaccgcaaggtgttcggggatggctctcgcctgtccgcccgcctctctggggccggcggcgcgggcggcttccgctcgcagtcgctgtcccgcagcaatgtggcctcctcggccgcctgctcctcggcctcgtcgctcggcctcggcctggcctatcgccggccgccggcgtccgacgggctggacctgagccaggcggcggcgcgcaccaacgagtacaagatcatccgcaccaacgagaaggagcagctgcagggcctcaacgaccgcttcgccgtgttcatcgagaaggtgcatcagctggagacgcagaaccgcgcgttggaggccgagctggccgcgctgcgacagcgccacgctgagccgtcgcgcgtcggcgagctcttccagcgcgagctgcgcgacctgcgcgcgcagctggaggaggccagctcggctcgctcgcaggccctgctggagcgcgacgggctggcggaggaggtgcagcggctgcgggcgcgctgcgaggaggagagccgcggacgcgaaggcgccgagcgcgccctgaaggcgcacagcgcgacgtggacggcgccacgctggcccgcctggacctggagaagaaggtggagtcgctgctggacgagctggccttcgtacgccaggtgcacgacgaggaggtagccgagctgctggccacgctgcaggcgttcgtcgcaggccgcggccgaggtggacgtgactgtggctaaaccagacctgacctcggctctgagggagatccgcgcccagtatgagtccctggccgctaagaacctgcagtccgcggaagaatggtacaagtccaagtttgccaacctgaacgagcaggcggcgcgcacaccgaggccatccgggccagccgcgaggagatccacgagtatcggcgccagctgcaggcgcgcaccatcgagatcgagggcctgcgcggggccaacgagtccttggagaggcagatcctggagctggaggagcggcacagtgccgaggtagctggctaccaggatagcattgggcagctggagaatgatctgaggaacaccaagagtgagatggcacgccaccttcgggaataccaggacttgctcaatgtcaaaatggctcttgacattgagatagcagcttacaggaaactgctggaaggcgaggagacacgttttagcaccagtgggttaagcatttcggggctgaatccacttcccaatccaagttacctgctcccacctagaatcctcagtgctacaacctccaaagtctcatccactgggctatcacttaagaaagaggaggaggaggaggaggcatctaangtagcctctaagaaaacctcccagatagggggaaagttttgaagaaatattagaggagacagtnatatctactaagaaaaccgagaaatcaaatatagaagaancaccatttcaagccaaaaaatataattccattgctttgaaaa

SEQ ID NO: 728932 - DNA, 2877 bp, Homo sapiens
  misc_feature (159)..(159): n is a, c, g, or t
  misc_feature (318)..(318): n is a, c, g, or t
  misc_feature (356)..(356): n is a, c, g, or t
  misc_feature (708)..(708): n is a, c, g, or t
  misc_feature (712)..(712): n is a, c, g, or t
  misc_feature (714)..(714): n is a, c, g, or t
  misc_feature (729)..(729): n is a, c, g, or t
  misc_feature (739)..(739): n is a, c, g, or t
  misc_feature (756)..(756): n is a, c, g, or t
  misc_feature (801)..(801): n is a, c, g, or t
  misc_feature (872)..(872): n is a, c, g, or t
  misc_feature (895)..(895): n is a, c, g, or t
  misc_feature (903)..(903): n is a, c, g, or t
  misc_feature (915)..(915): n is a, c, g, or t
  misc_feature (921)..(921): n is a, c, g, or t
  misc_feature (930)..(930): n is a, c, g, or t
  misc_feature (2812)..(2812): n is a, c, g, or t
  misc_feature (2817)..(2817): n is a, c, g, or t
  misc_feature (2829)..(2830): n is a, c, g, or t
  misc_feature (2842)..(2842): n is a, c, g, or t
  misc_feature (2849)..(2849): n is a, c, g, or t
  misc_feature (2853)..(2853): n is a, c, g, or t
  misc_feature (2862)..(2862): n is a, c, g, or t
  misc_feature (2872)..(2872): n is a, c, g, or t
acagagcgctcccttggaggcacccagggacctggccagccgtgcagctgcccaggcgctatggcgagtgcggtcagggggtcgaggccgtggccccggctggggctccagctccagttcgcggcgctgctgctcgggacgctgagtccacaggttcanactctcaggccagagaacctcctgctggtgtccaccttggatggaagtctccacgcactaagcaagcagacaggggacctgaagtggactctgagggatgatcccgtcatcgaaggaccaatgtacgtcacagaaatggcctttctctctgacccagcngatggcagcctgtacatcttggggacccaaaaacaacngggattaatgaaactgccattcaccatccctgagctggttcatgcctctccctgccgcagctctgatggggtcttctacacaggccggaagcaggatgcctggtttgtggtggaccctgagtcaggggagacccagatgacactgaccacagagggtccctccaccccccgcctctacattggccgaacacagtatacggtcaccatgcatgacccaagagccccagccctgcgctggaacaccacctaccgccgctactcagcgccccccatggatggctcacctgggaaatacatgagccacctggcgtcctgcgggatgggcctgctgctcactgtggacccaggaagngggncngtgctgtggacacangacctgggcntgcctgtgatgggcgtntacacctggcaccaggacggcctgcgccagctgccgcatctcacnctggctcgagacactctgcatttcctcgccctccgctggggccacatccgactgcctgcctcaggcccccnggacacagccaccctcttctctnccttgganacccagctgctnatgacnctgtatgtngggaaggatgaaactggcttctatgtctctaaagcactggtccacacaggagtggccctggtgcctcgtggactgaccctggcccccgcagatggccccaccacagatgaggtgacactccaagtctcaggagagcgagagggctcacccagcactgctgttagatacccctcaggcagtgtggccctcccaagccagtggctgctcattggacaccacgagctacccccagtcctgcacaccaccatgctgagggtccatcccaccctggggagtggaactgcagagacaagacctccagagaatacccaggccccagccttcttcttggagctattgagcctgagccgagagaaactttgggactccgagctgcatccagaagaaaaaactccagactcttacttggggctgggaccccaagacctgctggcagctagcctcactgctgtcctcctgggagggtggattctctttgtgatgaggcagcaacagccgcaggtggtggagaagcagcaggagacccccctggcacctgcagactttgctcacatctcccaggatgcccagtccctgcactcgggggccacccggaggagccagaagaggcttcagagtccctcaaagcaagcccagccactcgacgaccctgaagctgagcaactcaccgtagtggggaagatttccttcaatcccaaggacgtgctgggccgcggggcaggcgggactttcgttttccggggacagtttgagggacgggcagtggctgtcaagcggctcctccgcgagtgctttggcctggttcggcgggaagttcaactgctgcaggagtctgacaggcaccccaacgtgctccgctacttctgcaccgagcggggaccccagttccactacattgccctggagctctgccgggcctccttgcaggagtacgtagaaaacccggacctggatcgcgggggtctggagcccgaggtcgtgctgcagcagctgatgtctggcctggcccacctgcactctttacacatagtgcaccgggacctgaagccaggaaatattctcatcaccgggcctgacagccagggcctgggcagagtggtgctctcagacttcggcctctgcaagaagctgcctgctggccgctgtagcttcagcctccactccggcatccccggcacggaaggctggatggcgcccgagcttctgcagctcctgccaccagacagtcctaccagcgctgtggacatcttctctgcaggctgcgtgttctactacgtgctttctggtggcagccacccctttggagacagtctttatcgccaggcaaacatcctcacaggggctccctgtctggctcacctggaggaagaggtccacgacaaggtggttgcccgggacctggttggagccatgttgagcccactgccgcagccacgcccctctgccccccaggtgctggcccaccccttcttttggagcagagccaagcaactccagttcttccaggacgtcagtgactggctggagaaggagtccgagcaggagcccctggtgagggcactggaggcgggaggctgcgcagtggtccgggacaactggcacgagcacatctccatgccgctgcagacagatctgagaaagttccggtcctataaggggacatcagtgcgagacctgctccgtgctgtgaggaacaagaagcaccactacagggagctcccagttgaggtgcgacaggcactcggccaagtccctgatggcttcgtccagtacttcacaaaccgcttcccacggctgctcctccacacgcaccgagccatgaggagctgcgcctctgagagcctcttcctgccctactacccgccagactcagaggccaggnggccntgccctggggcnncagggaggtgangtgggcnggangccacacanatggtctccntgctg

SEQ ID NO: 728933 - DNA, 687 bp, Homo sapiens
  misc_feature (1)..(1): n is a, c, g, or t
  misc_feature (7)..(7): n is a, c, g, or t
  misc_feature (16)..(16): n is a, c, g, or t
natgacnctgtatgtngggaaggatgaaactggcttctatgtctctaaagcactggtccacacaggagtggccctggtgcctcgtggactgaccctggcccccgcagatggccccaccacagatgaggtgacactccaagtctcaggagagcgagagggctcacccagcactgctgttagatacccctcaggcagtgtggccctcccaagccagtggctgctcattggacaccacgagctacccccagtcctgcacaccaccatgctgagggtccatcccaccctggggagtggaactgcagagacaagacctccagagaatacccaggccccagccttcttcttggagctattgagcctgagccgagagaaactttgggactccgagctgcatccagaagaaaaaactccagactcttacttggggctgggaccccaagacctgctggcagctagcctcactgctgtcctcctgggagggtggattctctttgtgatgaggcagcaacagccgcaggtggtggagaagcagcaggagacccccctggcacctgcctggggctgatgaagcagagatgttcgctggatcccaggccctggcacccctcaggaaatacaagaaaaagaatattcacatctgtttaatgtgcataaagccaaggaaaggacagttccgaattcaataga

SEQ ID NO: 728934 - DNA, 689 bp, Homo sapiens
tgacactgggtgtgggaatttctgcatttcctcaagaggctgtgtagcaaaatgattcagtgtgctggctctggagcctgactgcctgggttcaaggccaggctctgccatttagtagctgtgtgacattagccaagttacatggcctctccaagccccagtttccttacctgaaaagtggaaatgatagtaatacctgttaattggttgctatggaaatgggctcacctggcacagtgagcactgtgtgttgctgctcttactccttcctgtaaattttccgtctcctagaaactgccattcaccatccctgagctggttcatgcctctccctgccgcagctctgatggggtcttctacacaggccggaagcaggatgcctggtttgtggtggaccctgagtcaggggagacccagatgacactgaccacagagggtccctccaccccccgcctctacattggccgaacacagtatacggtcaccatgcatgacccaagagccccagccctgcgctggaacaccacctaccgccgctactcagcgccccccatggatggctcacctgggaaatgtgagttccacctttctctggtcccatcttggagcaaggtccccaacccagggaaccctgaacagcatccatgaccaattcccagccacatttcgacccacttgacctccccagg

SEQ ID NO: 728935 - DNA, 638 bp, Homo sapiens
  misc_feature (1)..(1): n is a, c, g, or t
  misc_feature (7)..(7): n is a, c, g, or t
  misc_feature (16)..(16): n is a, c, g, or t
natgacnctgtatgtngggaaggatgaaactggcttctatgtctctaaagcactggtccacacaggagtggccctggtgcctcgtggactgaccctggcccccgcagatggccccaccacagatgaggtgacactccaagtctcaggagagcgagagggctcacccagcactgctgttagatacccctcaggcagtgtggccctcccaagccagtggctgctcattggacaccacgagctacccccagtcctgcacaccaccatgctgagggtccatcccaccctggggagtggaactgcagagacaagacctccagagaatacccaggccccagccttcttcttggagctattgagcctgagccgagagaaactttgggactccgagctgcatccagaagaaaaaactccagactcttacttggggctgggaccccaagacctgctggcagctagcctcactgctgtcctcctgggagggtggattctctttgtgatgaggcagcaacagccgcaggtggtggagaagcagcaggagacccccctggcacctgccctcaggaaatacaagaaaaagaatattcacatctgtttaatgtgcataaagccaaggaaaggacagttccgaattcaataga

SEQ ID NO: 728936 - DNA, 475 bp, Homo sapiens
ctgagcaactcaccgtagtggggaagatttccttcaatcccaaggacgtgctgggccgcggggcaggcgggactttcgttttccggggacagtttgagggacgggcagtggctgtcaagcggctcctccgcgagtgctttggcctggttcggcgggaagttcaactgctgcaggagtctgacaggcaccccaacgtgctccgctacttctgcaccgagcggggaccccagttccactacattgccctggagctctgccgggcctccttgcaggagtgcaccgggacctgaagccaggaaatattctcatcaccgggcctgacagccagggcctgggcagagtggtgctctcagacttcggcctctgcaagaagctgcctgctggccgctgtagcttcagcctccactccggcatccccggcacggaaggctggatggcgcccgagcttctgcagctcctgccaccagacagtcct

SEQ ID NO: 728937 - DNA, 492 bp, Homo sapiens; identical to SEQ ID NO: 288149

SEQ ID NO: 728938 - DNA, 1504 bp, Homo sapiens
aaagaaacaaaattgggatgttcgggttggagagttagcaggggcatctccaggagggtcctgccccccaccccaaagccggcctcagggagttccaggcgttcccacactccccaggcaggacggtggacgcagcgcagacaggaagctccccgagataacgctgcggccgggcggcctgatttgctgggctgtctgatggcccgggccgaggcttctccctgcgcctgggactgcggccgcctctctaaatagcagccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagta

SEQ ID NO: 728939 - DNA, 1143 bp, Homo sapiens
  misc_feature (1030)..(1030): n is a, c, g, or t
  misc_feature (1043)..(1043): n is a, c, g, or t
  misc_feature (1056)..(1057): n is a, c, g, or t
  misc_feature (1059)..(1059): n is a, c, g, or t
  misc_feature (1064)..(1064): n is a, c, g, or t
  misc_feature (1074)..(1074): n is a, c, g, or t
  misc_feature (1087)..(1087): n is a, c, g, or t
aaagaaacaaaattgggatgttcgggttggagagttagcaggggcatctccaggagggtcctgccccccaccccaaagccggcctcagggagttccaggcgttcccacactccccaggcaggacggtggacgcagcgcagacaggaagctccccgagataacgctgcggccgggcggcctgatttgctgggctgtctgatggcccgggccgaggcttctccctgcgcctgggactgcggccgcctctctaaatagcagccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaagcagtcacagccagtcgtgacagcttctgacatctccaaaaggaagtgcacctcgtcctttgtagaaatgggatcacagggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgacaagctgcatgggcgaggcgataccggggcagccgccggcggntcacggtcacacnccggaaggggccnngnccgcncccccgggcncacaagggggggnccatgccacgcgggcggggagtgccgccgggaagcggcacacatcgggtgggaggc

SEQ ID NO: 728940 - DNA, 1583 bp, Homo sapiens
aaagaaacaaaattgggatgttcgggttggagagttagcaggggcatctccaggagggtcctgccccccaccccaaagccggcctcagggagttccaggcgttcccacactccccaggcaggacggtggacgcagcgcagacaggaagctccccgagataacgctgcggccgggcggcctgatttgctgggctgtctgatggcccgggccgaggcttctccctgcgcctgggactgcggccgcctctctaaatagcagccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaagcagtcacagccagtcgtgacagcttctgacatctccaaaaggaagtgcacctcgtcctttgtagaaatgggatcacagggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagta

SEQ ID NO: 728941 - DNA, 1432 bp, Homo sapiens
aaagaaacaaaattgggatgttcgggttggagagttagcaggggcatctccaggagggtcctgccccccaccccaaagccggcctcagggagttccaggcgttcccacactccccaggcaggacggtggacgcagcgcagacaggaagctccccgagataacgctgcggccgggcggcctgatttgctgggctgtctgatggcccgggccgaggcttctccctgcgcctgggactgcggccgcctctctaaatagcagccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagta

SEQ ID NO: 728942 - DNA, 1656 bp, Homo sapiens
  misc_feature (1435)..(1435): n is a, c, g, or t
  misc_feature (1441)..(1441): n is a, c, g, or t
  misc_feature (1455)..(1455): n is a, c, g, or t
aaagaaacaaaattgggatgttcgggttggagagttagcaggggcatctccaggagggtcctgccccccaccccaaagccggcctcagggagttccaggcgttcccacactccccaggcaggacggtggacgcagcgcagacaggaagctccccgagataacgctgcggccgggcggcctgatttgctgggctgtctgatggcccgggccgaggcttctccctgcgcctgggactgcggccgcctctctaaatagcagccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagtaaanaaaaanaaaaaaaaaaaaanaaacccggggcaaaacacagagcgcgacaacaagcgcagaaacgcgcacatggggcaatgcgggtcctgaaccaagattgtgtccaaggggaaaccgcggcccaaaaggagcgcaaaatcgaaagcaggcaccgtagacccgcgaagcacaggcacccaaagacaacggcaaggaacacgaaagaggccaacaccacaaaa

SEQ ID NO: 728943 - DNA, 1633 bp, Homo sapiens
aaagaaacaaaattgggatgttcgggttggagagttagcaggggcatctccaggagggtcctgccccccaccccaaagccggcctcagggagttccaggcgttcccacactccccaggcaggacggtggacgcagcgcagacaggaagctccccgagataacgctgcggccgggcggcctgatttgctgggctgtctgatggcccgggccgaggcttctccctgcgcctgggactgcggccgcctctctaaatagcagccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagtagttaagtccaaatagtggcaatggggtcttgaattactaccttttaatttctatatggaaaagaactcactttgaccaacacttctgtaaattacattacaatataggttccttcacactattatccatgtaaaaacaattttgctttgcttcaaacccagatttcaggaaaacaacaacaaaattctccaaactttacta

SEQ ID NO: 728944 - DNA, 1807 bp, Homo sapiens
  misc_feature (1586)..(1586): n is a, c, g, or t
  misc_feature (1592)..(1592): n is a, c, g, or t
  misc_feature (1606)..(1606): n is a, c, g, or t
aaagaaacaaaattgggatgttcgggttggagagttagcaggggcatctccaggagggtcctgccccccaccccaaagccggcctcagggagttccaggcgttcccacactccccaggcaggacggtggacgcagcgcagacaggaagctccccgagataacgctgcggccgggcggcctgatttgctgggctgtctgatggcccgggccgaggcttctccctgcgcctgggactgcggccgcctctctaaatagcagccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaagcagtcacagccagtcgtgacagcttctgacatctccaaaaggaagtgcacctcgtcctttgtagaaatgggatcacagggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagtaaanaaaaanaaaaaaaaaaaaanaaacccggggcaaaacacagagcgcgacaacaagcgcagaaacgcgcacatggggcaatgcgggtcctgaaccaagattgtgtccaaggggaaaccgcggcccaaaaggagcgcaaaatcgaaagcaggcaccgtagacccgcgaagcacaggcacccaaagacaacggcaaggaacacgaaagaggccaacaccacaaaa

SEQ ID NO: 728945 - DNA, 1784 bp, Homo sapiens
aaagaaacaaaattgggatgttcgggttggagagttagcaggggcatctccaggagggtcctgccccccaccccaaagccggcctcagggagttccaggcgttcccacactccccaggcaggacggtggacgcagcgcagacaggaagctccccgagataacgctgcggccgggcggcctgatttgctgggctgtctgatggcccgggccgaggcttctccctgcgcctgggactgcggccgcctctctaaatagcagccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaagcagtcacagccagtcgtgacagcttctgacatctccaaaaggaagtgcacctcgtcctttgtagaaatgggatcacagggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagtagttaagtccaaatagtggcaatggggtcttgaattactaccttttaatttctatatggaaaagaactcactttgaccaacacttctgtaaattacattacaatataggttccttcacactattatccatgtaaaaacaattttgctttgcttcaaacccagatttcaggaaaacaacaacaaaattctccaaactttacta

SEQ ID NO: 728946 - DNA, 1728 bp, Homo sapiens
  misc_feature (1507)..(1507): n is a, c, g, or t
  misc_feature (1513)..(1513): n is a, c, g, or t
  misc_feature (1527)..(1527): n is a, c, g, or t
aaagaaacaaaattgggatgttcgggttggagagttagcaggggcatctccaggagggtcctgccccccaccccaaagccggcctcagggagttccaggcgttcccacactccccaggcaggacggtggacgcagcgcagacaggaagctccccgagataacgctgcggccgggcggcctgatttgctgggctgtctgatggcccgggccgaggcttctccctgcgcctgggactgcggccgcctctctaaatagcagccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagtaaanaaaaanaaaaaaaaaaaaanaaacccggggcaaaacacagagcgcgacaacaagcgcagaaacgcgcacatggggcaatgcgggtcctgaaccaagattgtgtccaaggggaaaccgcggcccaaaaggagcgcaaaatcgaaagcaggcaccgtagacccgcgaagcacaggcacccaaagacaacggcaaggaacacgaaagaggccaacaccacaaaa

SEQ ID NO: 728947 - DNA, 1705 bp, Homo sapiens
aaagaaacaaaattgggatgttcgggttggagagttagcaggggcatctccaggagggtcctgccccccaccccaaagccggcctcagggagttccaggcgttcccacactccccaggcaggacggtggacgcagcgcagacaggaagctccccgagataacgctgcggccgggcggcctgatttgctgggctgtctgatggcccgggccgaggcttctccctgcgcctgggactgcggccgcctctctaaatagcagccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagtagttaagtccaaatagtggcaatggggtcttgaattactaccttttaatttctatatggaaaagaactcactttgaccaacacttctgtaaattacattacaatataggttccttcacactattatccatgtaaaaacaattttgctttgcttcaaacccagatttcaggaaaacaacaacaaaattctccaaactttacta

SEQ ID NO: 728948 - DNA, 1394 bp, Homo sapiens
aggctgtgcagctctggctgggggcttttttccggctgtgttagccctgctgtggaaagcaagtggactgtcctgcagcccagacaagcccagtggcctttgtgcttttaattgtgataaatgtacctgctttagaaaatgtttaattatgttggaagcaacttaaactgttggatgcctacggctctctcagaagtttggtgaaagtggctttggccctgactttgtggtagcgtgtgtgggtttgtgagtggaaccttcagctttaggttggaaacggtggctgtggagagctggacttttggctgtggaggtcacgtccctgcccaatgtggtgggtgcctccgagtccctacggttgtcttccctgcgccctgccagggatgcgggagagaagggagacaaaggcgcccccggacggcctggaagagtcggccccacgggagaaaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagta

SEQ ID NO: 728949 - DNA, 1618 bp, Homo sapiens
  misc_feature (1397)..(1397): n is a, c, g, or t
  misc_feature (1403)..(1403): n is a, c, g, or t
  misc_feature (1417)..(1417): n is a, c, g, or t
aggctgtgcagctctggctgggggcttttttccggctgtgttagccctgctgtggaaagcaagtggactgtcctgcagcccagacaagcccagtggcctttgtgcttttaattgtgataaatgtacctgctttagaaaatgtttaattatgttggaagcaacttaaactgttggatgcctacggctctctcagaagtttggtgaaagtggctttggccctgactttgtggtagcgtgtgtgggtttgtgagtggaaccttcagctttaggttggaaacggtggctgtggagagctggacttttggctgtggaggtcacgtccctgcccaatgtggtgggtgcctccgagtccctacggttgtcttccctgcgccctgccagggatgcgggagagaagggagacaaaggcgcccccggacggcctggaagagtcggccccacgggagaaaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagtaaanaaaaanaaaaaaaaaaaaanaaacccggggcaaaacacagagcgcgacaacaagcgcagaaacgcgcacatggggcaatgcgggtcctgaaccaagattgtgtccaaggggaaaccgcggcccaaaaggagcgcaaaatcgaaagcaggcaccgtagacccgcgaagcacaggcacccaaagacaacggcaaggaacacgaaagaggccaacaccacaaaa

SEQ ID NO: 728950 - DNA, 1595 bp, Homo sapiens
aggctgtgcagctctggctgggggcttttttccggctgtgttagccctgctgtggaaagcaagtggactgtcctgcagcccagacaagcccagtggcctttgtgcttttaattgtgataaatgtacctgctttagaaaatgtttaattatgttggaagcaacttaaactgttggatgcctacggctctctcagaagtttggtgaaagtggctttggccctgactttgtggtagcgtgtgtgggtttgtgagtggaaccttcagctttaggttggaaacggtggctgtggagagctggacttttggctgtggaggtcacgtccctgcccaatgtggtgggtgcctccgagtccctacggttgtcttccctgcgccctgccagggatgcgggagagaagggagacaaaggcgcccccggacggcctggaagagtcggccccacgggagaaaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagtagttaagtccaaatagtggcaatggggtcttgaattactaccttttaatttctatatggaaaagaactcactttgaccaacacttctgtaaattacattacaatataggttccttcacactattatccatgtaaaaacaattttgctttgcttcaaacccagatttcaggaaaacaacaacaaaattctccaaactttacta

SEQ ID NO: 728951 - DNA, 641 bp, Homo sapiens
aaagaaacaaaattgggatgttcgggttggagagttagcaggggcatctccaggagggtcctgccccccaccccaaagccggcctcagggagttccaggcgttcccacactccccaggcaggacggtggacgcagcgcagacaggaagctccccgagataacgctgcggccgggcggcctgatttgctgggctgtctgatggcccgggccgaggcttctccctgcgcctgggactgcggccgcctctctaaatagcagccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaagagatagttctgcaggtcaggcatgggtgagaaagtccctgaggctgcggtatctgaagcctccagagcagcatcttcaagggatgcgggagagaagggagacaaaggcgcccccggacggcctggaagagtcggccccacgggagaaaaag

SEQ ID NO: 728952 - DNA, 294 bp, Homo sapiens; identical to SEQ ID NO: 275909

SEQ ID NO: 728953 - DNA, 266 bp, Homo sapiens
  misc_feature (149)..(149): n is a, c, g, or t
  misc_feature (201)..(202): n is a, c, g, or t
gaaagaggtttttaaattctccatgaagtgcactatgttccatcattccttcccaaagccaccggaagcattccttctaggaaaggtggagtcggtagtgagaagccggagtgcccctacagacatacaaggagattgttcactgctgngaggagcaggtcttaactcttgccactgaacagacctatgctgtggagggtnngacaccatcaaccgcctgtcctgctgctctttggccgggtcgtgtgaccagatggcagtttctg

SEQ ID NO: 728954 - DNA, 241 bp, Homo sapiens
gaaagaggtttttaaattctccatgaagtgcactatgttccatcattccttcccaaagccaccggaagcattccttctaggaaaggtggagtcggtagtgagaagccggagtgagaagacccctgagcgatggattcattcattttctgaatttcctatgttaggacagtattagagcccagtaggctttagagccccaagatgagcgtgcattagtgagcagatgtgagggctgtctaca

SEQ ID NO: 728955 - DNA, 524 bp, Homo sapiens
  misc_feature (202)..(202): n is a, c, g, or t
  misc_feature (209)..(209): n is a, c, g, or t
  misc_feature (394)..(394): n is a, c, g, or t
  misc_feature (417)..(417): n is a, c, g, or t
  misc_feature (430)..(430): n is a, c, g, or t
  misc_feature (485)..(485): n is a, c, g, or t
cggccgctcggcggaggggacgggccgggtactctcctccttcctccccgagctccagctgcctggtcaggacctttctctcgctgccgctgggaccccgtgtcatcgcccaggccgagcacgatgccccctaaaaagggaggtgatggaattaaaccacccccaatcattggcaagatttggaacctcactgaaaattggntatcgtnggattgccaaatgtgggacaatctactttcttcaatgtgttaaccaaactagctcaggccttcagccagaaaaacttcccggttctgcactattgatcctaatgagcagcagagtacctgtgccagatgaaaggtttgacttctcttgtgtcaataaccacaaaaccagcaagcaaaattcctgncctttctaaatgtggtggctatngctggcttgtganaggagctcacaatgggcaagggctggggactgctttttatctcatattagtgccntgtgcatgggccattcttttccattcctaacaacgttgc

SEQ ID NO: 728956 - DNA, 3091 bp, Homo sapiens
gtccaatatttgatatacctggaaggctttatccagtcagagagaaattctgcaatttgattggtccacgagacagagaaaatactgcgtatattcaagcgattgtgaaagtcaccatggatatccatttgaatgaaatggctggagacatcttggtttttctgactggccagtttgaaatagaaaaaagttgtgagttactttttcagatggcagagtctgttgattatgattatgatgttcaagataccaccctcgatggcttgttaatattgccgtgttatggatcaatgacaacagatcaacagaggaggatatttttgccaccaccacctggaattagaaaatgtgtcatatccaccaatatttctgcaacgtctttgacaatagatggaatcagatatgtggtagatggtggcttcgtgaagcagttaaatcacaaccccagattagggttggacatcctggaggtggttccaatttcaaagagcgaggcattacagcgaagtggccgagctggcaggacttcttcaggaaaatgctttcggatctatagtaaagatttttggaaccagtgtatgcctgaccatgtgatccctgaaattaagagaactagtttgacatctgtagttctgaccttaaagtgccttgccatacacgatgtcataaggtttccctatttggatccacctaatgagagacttattttagaagctcttaaacaactttaccagtgtgatgctattgacaggagtggccatgtcaccagattgggtttgtctatggtggagtttcctttgcctccacatctgacatgtgcagtaataaaagctgcttccctggattgtgaagatctactacttccaatagcagcaatgttgtctgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtggaagctcaacttcgagaactaatcaggaagcttaaacagcaaagtgatttcccaaaagagacctttgaaggccctaaacatgaagtactacgaagatgtctttgtgcgggctatttcaaaaatgtagctcgaagatctgttgggagaacgttttgcacaatggatggtcgtggaagcccagttcacattcatccttcctcagcacttcatgaacaggaaaccaaacttgaatggatcatttttcatggggtattggttaccaccaaagtctacgcaagaattgtatgcccaatccgttatgaatgggtaagagacttgttacccaagttgcatgaatttaatgcacatgatttgagcagtgtggcccgacgtgaagtgatgaagatctactacttccaatagcagcaatgttgtttgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtgagaagatgcaagaaggagatggacaaataaggaaaatgtaaagcagctaaaggatggaatatcgaaagacgtcttaaagaaaatgcaaagaagaaatgatgacaaatccatatttgatgcacgggctcgtttccttgagagaaagcagcagaggacccaggaccacagtgacacacgaaaggaaacaggctaaggtggtgaaccctccaattcaggaagtgggaaaaggagccaggaaatgtgcttctactttgccagttatttcagacagcactaccaagaggaggtggtcagcacttgttattggcctatgaactaaaagcaaatcaaagctcataaatcaaagctcatcagttcccataaatgcagttgtcaaagaaaagatttggttgccatagtcataagcaatgatacatgaaaccaatgaaagacagtacatgtaataatattttcctcagtacaattttgctggccttaactggtatcaaacgctgtcattgagatgttttcaaagaacattgagttgtatttaatcagcgtgtactccatttgcattgaagcattaaaaattatttttcttaaaatctctttaaggccttcttgttgctgttagaatagtgctatatatcaggtatgtgaccatttatttcagaaggctgaacataagaggtttctactcagcaatacttagatgtctaactgtttaattgctacagagctttatagatatttagagaaaagacttaatcaattagtaaataaaattgcctatgcaggattctttcttgaattaatattaatccttaaattgatttttctgggattatacaaattcctctttatataaaagtatattgtttaaaacagtagctatagccattaaccaaaggacagatgatatatatatatatgatatatatatatatataagttcttttttagctgtacctacgtacttatatcagcaccatgtatgtaggtgtgatagtactttcaaacagcgcctccacctggcctactctgttatttccacctgtttgggtagggccatttaacttccattatgccaaacttgggatgggattttcgaagcagacaacactatttcatcgtgtttcaaattggaaccttgaggctagttagtatcacactcaggccacactcagcacttgcccactcttgtttactgccttgtattctagttatttgtgtatttgtctccctcactagattatacgctccttgtgggcagggactgtgtcttttttcatctttgtatctttcatgcacctagcatagtgctttgcacatagtagtcactcagtgtttgttaaataaagctattagtgtcattaaaattcaaaagacagt

SEQ ID NO: 728957 - DNA, 2459 bp, Homo sapiens; identical to SEQ ID NO: 290139

SEQ ID NO: 728958 - DNA, 2285 bp, Homo sapiens; identical to SEQ ID NO: 290138

SEQ ID NO: 728959 - DNA, 815 bp, Homo sapiens; identical to SEQ ID NO: 285121

SEQ ID NO: 728960 - DNA, 803 bp, Homo sapiens
agcggagaaagctggttccacttcatcttggagatggaggaaagcttgccagaacaactgcacaccccatccactcctcatgttctcagtttgttcttctctgtgatacaaccagcatcacgagaacagccagcagcagctccagcgtgataaaattttcactccttgacaagtgtaagaagccggaaaactgtgcccagccagaagttttgtgtcgcccctttgagatgctgtctaacctccacgagctgcttccgaatcacctgatggagacgctttattcccgcaagagtgaagaggacaagaaaaaatgtgagaatcctgaactctctggcttagaaagaatcttagcaagacatcagttgccaaaagagattaatctgaccccaaagccgaacagaatgcccccgtggaaaagaaaaatcatcaacaatgtaactgacgggtggaagaaatgtcacttgttgaagagaaacacgaaagagcctccaatgtccaccatagttgtcagaaaacttattcaaaaaaatgtacccagaagacacagcctaaggaatacaagcaggaaactgagaaacctgccaacaacagctaaagggacacaaacaggaaaatcacagtgccttctgggtatatcagaacctacctgaaattcacaaactctaaacaatgaatgctcaactctgttgtatgaagtagccacaattaccaaccttcctgcacaaatcaaacaagagatatcttaaaataggaatgatgctgaaactctacagcttttgtgtgaaacacatagaagaagaaag

SEQ ID NO: 728961 - DNA, 1011 bp, Homo sapiens
agcggagaaagctggttccacttcatcttggagatggaggaaagcttgccagaacaactgcacaccccatccactcctcatgttctcagtttgttcttctctgtgatacaaccagcatcacgagaacagccagcagcagctccagcgtgataaaattttcactccttgacaagtgtaagaagccggaaaactgtgcccagccagaagttttgtgtcgcccctttgagatgctgtctaacctccacgagctgcttccgaatcacctgatggagacgctttattcccgcaagagtgaagaggacaagaaaaaatgtgagaatcctgaactctctggcttagaaagaatcttagcaagacatcagttgccaaaagagattaatctgaccccaaagccgaacagaatgcccccgtggaaaagaaaaatcatcaacaatgtaactgacgggtggaagaaatgtcacttgttgaagagaaacacgaaagagcctccaatgtccaccatagttgtcagaaaacttattcaaaaaaatgtacccagaagacacagcctaaggaatacaagcaggaaactgagaaacctgccaacaacagctaaagggacacaaacagtcaaatctcatgagaccagcaggatgaacaggtaacagaggtcaaagagaaagaatgaatgcccacctatggatggaggcagtttagagaaatatgcttgtccaaagtcacaattaactgcactgacacagagaagcagatattgcacttttgctcaactaaataccactttgatgactaagaacgggccctctgggatcagacaaaggaaaatcacagtgccttctgggtatatcagaacctacctgaaattcacaaactctaaacaatgaatgctcaactctgttgtatgaagtagccacaattaccaaccttcctgcacaaatcaaacaagagatatcttaaaataggaatgatgctgaaactctacagcttttgtgtgaaacacatagaagaagaaag

SEQ ID NO: 728962 - DNA, 961 bp, Homo sapiens
attcgcgggccgcggggtcgccgccggccgcccaggcgcggagcctctcgggggtcacccggccgccgggcccgcgggacgcacggggccgccaggggaggacaacaagcctcaggccctgtccctgcgccccgcccggcctcccccgcggggctgcgcagcccactcggccatcctggcctgaaggggccgcccccggcctcgcgggaaagcctgagcctcccgggccttctcgggccttctcggactttcccccaggcgtcctggaccttcttcggccttcctgggcctcctcgggcttccttgaccctccccaggccttccccgaggcctccaggcccttccctgggcctctccaggctgagctctccgcgacatggccagtgggcctctgggacccggggcccggcccacccgcctccaccctccattcccaccgcctgctcacatcaagccaggagcaccgcccggtgagaatcctgaactctctggcttagaaagaatcttagcaagacatcagttgccaaaagagattaatctgaccccaaagccgaacagaatgcccccgtggaaaagaaaaatcatcaacaatgtaactgacgggtggaagaaatgtcacttgttgaagagaaacacgaaagagcctccaatgtccaccatagttgtcagaaaacttattcaaaaaaatgtacccagaagacacagcctaaggaatacaagcaggaaactgagaaacctgccaacaacagctaaagggacacaaacaggaaaatcacagtgccttctgggtatatcagaacctacctgaaattcacaaactctaaacaatgaatgctcaactctgttgtatgaagtagccacaattaccaaccttcctgcacaaatcaaacaagagatatcttaaaataggaatgatgctgaaactctacagcttttgtgtgaaacacatagaagaagaaag

SEQ ID NO: 728963 - DNA, 950 bp, Homo sapiens
attcgcgggccgcggggtcgccgccggccgcccaggcgcggagcctctcgggggtcacccggccgccgggcccgcgggacgcacggggccgccaggggaggacaacaagcctcaggccctgtccctgcgccccgcccggcctcccccgcggggctgcgcagcccactcggccatcctggcctgaaggggccgcccccggcctcgcgggaaagcctgagcctcccgggccttctcgggccttctcggactttcccccaggcgtcctggaccttcttcggccttcctgggcctcctcgggcttccttgaccctccccaggccttccccgaggcctccaggcccttccctgggcctctccaggctgagctctccgcgacatggccagtgggcctctgggacccggggcccggcccacccgcctccaccctccattcccaccgcctgctcacatcaagccaggagcaccgcccggtgagaatcctgaactctctggcttagaaagaatcttagcaagacatcagttgccaaaagagattaatctgaccccaaagccgaacagaatgcccccgtggaaaagaaaaatcatcaacaatgtaactgacgggtggaagaaatgtcacttgttgaagagaaacacgaaagagcctccaatgtccaccatagttgtcagagaagttttgttcacattctttggaatcagaagtggaattcaagcaacactgattcttctcctgatgctgtcctgaaccaacacattgggatcttcaagggtcctttgagttcagttgtcttctcagagatgccaggaagcctcaggtgtatgcatgtctgttcgtatgttgtctacataataccaagttgacttcgtttgttcgttcgtgtgtttttgttgagctaccgggcctggccccacattgacttttaaataaatgtgagtattcataaattaag

SEQ ID NO: 728964 - DNA, 1959 bp, Homo sapiens
aaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaatgtgttt

SEQ ID NO: 728965 - DNA, 424 bp, Homo sapiens; identical to SEQ ID NO: 595022

SEQ ID NO: 728966 - DNA, 613 bp, Homo sapiens; identical to SEQ ID NO: 595019
  misc_feature (21)..(21): n is a, c, g, or t
  misc_feature (33)..(33): n is a, c, g, or t
  misc_feature (35)..(35): n is a, c, g, or t
  misc_feature (537)..(537): n is a, c, g, or t
  misc_feature (545)..(545): n is a, c, g, or t
  misc_feature (549)..(549): n is a, c, g, or t
  misc_feature (552)..(553): n is a, c, g, or t

SEQ ID NO: 728967 - DNA, 390 bp, Homo sapiens; identical to SEQ ID NO: 595024
  misc_feature (239)..(239): n is a, c, g, or t

SEQ ID NO: 728968 - DNA, 418 bp, Homo sapiens
tctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggcttccttagtttttgttttgttttgttttttgagatggagtctcactctgtcgcccaggctggaatgcagtggcatgatctcagctcactgcaacctctgcctcctgagttcaaatgattctcctgcctcagcctcccgagtagctgggattacaggcacctgccaccacgcccagctaatttttgtatttttagtaaagacgggggatttcac

SEQ ID NO: 728969 - DNA, 441 bp, Homo sapiens
tctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggcttccttagtttttgttttgttttgttttttgagatggagtctcactctgtcgcccaggctggaatgcagtggcatgatctcagctcactgcaacctctgcctcctgaggcaggagagttgcttgaacctggggggcggaggttcagtgagccactgcactccagcctgatgacagagcaagactcagtctcaaaaataaataaaaataataaaacctccataagtaatcctgaaaa

SEQ ID NO: 728970 - DNA, 2087 bp, Homo sapiens
aaaacttaactgctaatagcctgctgttgatcagaagccttacctttggtcctggctggtgctgaaagcgcttgagcacaccgctcctagggctgatgacttctgaggaaccttattggaaaagcattttgctctaagattcagtaaacgctgtcccgtgccaaggaagtggcgtcaacctgaggctctgggatcagacccaccggactcacgccggctctgccacttgttgcccgcagtctcggcccgttccctctgcgttggcaacgggcactgactgtccgatacctcagcgatcgtaggggagtagagacgttcctaatgccgggcgcaccgccggcgggccggcggttccgttggcttccctgacacacttcctacagtcatttctttcagctgagatctttccctttaatacctcgttaattaacgtgtaatcttttggttaaaatgtcacagctaagactaaacccgaagaaaagaatgaaaccacgggaagttcttcagacagtcgccgcaaggttatgggccgaagtggtgcaggggcggcgcccggggaagcgactaacagagctgtgcgcactgggggtgctgcaggcgctgagaagagtgtggagaggctgcgtggagctgcgcgctcggggtgggggttgcactaccaatgaagcgcgtgtttgtcaccacgggatgggttctgcgccagtggggctgggagcccgtccggggctgtacatggggctgcgcgcaaggtgaggactgcgcatgtgggcttggggcctgcgcgcaccggaggctgcaggcgctggggagggtgtggggggctgtgcgtggggctgccctcaccggaagctgcacgctctgggaagcgcagaggcgggggtgctgctcgcgctggggagcacgtgaggggacactcagggactgcccgcgcgaatggcttccaacgcatgcgccccaccccacatttcacagtcgccatgacgaccgggaggtccgcaacggctgcggggacaagtccgttgaggctgccaggcgagtcaggtctctctggacctcgcctgactcggctgggctgtgcctgaaattgacccagctccaccatactccttgattatgagaaaacaaggagtaagctcaaagcggctgcaatcttccggccgcagccagtctaaggggcggcgcggggcctccctcgcccgggagccggaggtagaggaggagatggaaaagtcggccctaggcggcgggaaactgccaaggggctcctggaggtcctccccggggaggatccaaagtctgaaagagcgaaaaggcttggagctagaggtggtggccaagacctttcttctcggccccttccagttcgtccgtaattccctggcgcagctccgggaaaaggtgcaggaactgcaggcgcggcggttctccagcagaaccactctcggcatcgctgtctttgtggcaattttacattggttacatttagtaacactttttgaaaatgatcgtcatttctctcacctctcatctttggaacgggagatgacttttcgcactgaaatgggactttattattcatacttcaagaccattattgaagcaccttcgtttttggaaggactgtggatgattatgaatgacaggcttactgaatatcctcttataattaatgcaataaaacgcttccatctttatccagaggtgagtcataatttgagacaaataatatttgtagagtgatcctctttgtcagataaaaatagtaagcacaatcttgttaagaaagggaggggacgtttcaggtttattaattgtgtgtatccttatagttgagtagaatatcataagttcctctcttaaaatttaaagaccccagaaactgttctctcatgaactcgaagaatgaaccttagtgtgtaaataatggccagggtggtcccatattaaagagtggtgcataaaccaagagaagatgctagagcggactgaaacgagcgatcagagaggcagggggaatcagaagcacagcgttcagtgtcaaagcgacggccagttaaagtgaaataacctttgacaagttgaatatc

SEQ ID NO: 728971 - DNA, 1750 bp, Homo sapiens
ttggtcctggctggtgctgaaagcgcttgagcacaccgctcctagggctgatgacttctgaggaaccttattggaaaagcattttgctctaagattcagtaaacgctgtcccgtgccaaggaagtggcgtcaacctgaggctctgggatcagacccaccggactcacgccggctctgccacttgttgcccgcagtctcggcccgttccctctgcgttggcaacgggcactgactgtccgatacctcagcgatcgtaggggagtagagacgttcctaatgccgggcgcaccgccggcgggccggcggttccgttggcttccctgacacacttcctacagtcatttctttcagctgagatctttccctttaatacctcgttaattaacgtgtaatcttttggttaaaatgtcacagctaagactaaacccgaagaaaagaatgaaaccacgggaagttcttcagacagtcgccgcaaggttatgggccgaagtggtgcaggggcggcgcccggggaagcgactaacagagctgtgcgcactgggggtgctgcaggcgctgagaagagtgtggagaggctgcgtggagctgcgcgctcggggtgggggttgcactaccaatgaagcgcgtgtttgtcaccacgggatgggttctgcgccagtggggctgggagcccgtccggggctgtacatggggctgcgcgcaaggtgaggactgcgcatgtgggcttggggcctgcgcgcaccggaggctgcaggcgctggggagggtgtggggggctgtgcgtggggctgccctcaccggaagctgcacgctctgggaagcgcagaggcgggggtgctgctcgcgctggggagcacgtgaggggacactcagggactgcccgcgcgaatggcttccaacgcatgcgccccaccccacatttcacagtcgccatgacgaccgggaggtccgcaacggctgcggggacaagtccgttgaggctgccaggcgagtcaggtctctctggacctcgcctgactcggctgggctgtgcctgaaattgacccagctccaccatactccttgattatgagaaaacaaggagtaagctcaaagcggctgcaatcttccggccgcagccagtctaaggggcggcgcggggcctccctcgcccgggagccggaggtagaggaggagatggaaaagtcggccctaggcggcgggaaactgccaaggggctcctggaggtcctccccggggaggatccaaagtctgaaagagcgaaaaggcttggagctagaggtggtggccaagacctttcttctcggccccttccagttcgtccgtaattccctggcgcagctccgggaaaaggtgcaggaactgcaggcgcggcggttctccagcagaaccactctcggcatcgctgtctttgtggcaattttacattggttacatttagtaacactttttgaaaatgatcgtcatttctctcacctctcatctttggaacgggagatgacttttcgcactgaaatgggactttattattcatacttcaagaccattattgaagcaccttcgtttttggaaggactgtggatgattatgaatgacaggcttactgaatatcctcttataattaatgcaataaaacgcttccatctttatccagaggtaatcatagcctcctggtattgcacattcatgggaataatgaatttatttggactagaaactaagacctgctggaatgtcaccagaatagaac

SEQ ID NO: 728972 - DNA, 1363 bp, Homo sapiens; identical to SEQ ID NO: 206217

SEQ ID NO: 728973 - DNA, 866 bp, Homo sapiens; identical to SEQ ID NO: 345440

SEQ ID NO: 728974 - DNA, 756 bp, Homo sapiens
gtcagaggagaagaagaaggagtcagtgctatctctaagtaggatttttgagtctgtaaacttgtaaaaatagtggtgtccttaaaacacacacagaaagaaagagaaagaacagattttggggagaaaagatgaacttgactttgaatttactaagctttagataaggaagtaaaacctagatgaaattgcccatcaggcaaaggaaaggtaaggttgaagttagaagtagatttagttgtcatctctgtagaagggattctcaccagacagagattttctaaagaagggactgaggcctgagggaatggctttacttaggaactacaagaagaaaaaaaaaaaaaatgaagaaatggtcattgacctatttgaagcttaggataatcctcaaacaatgagatttcactgtattttgtttttatttatttatttgagacagagtctcgctctgtcacccaggctggagtgcaatggcatgatctcgactcactgtaacctccacctccaggatgcaagcagttctcctgcctcagcctcccaggtagctgggattacaggtgcccaccaccacacctggctaattttatgtttttagtagagacgagttttcaccgtgttggccaggctggtctcgaactcctgacctcaagtgatccacctgccttggcctcccaaagtgctgagattacaggcatgagccaccgtgcctggctgtgtattttcttttgcttagccttatgttaaaagctccca

SEQ ID NO: 728975 - DNA, 521 bp, Homo sapiens
gtcagaggagaagaagaaggagtcagtgctatctctaagtaggatttttgagtctgtaaacttgtaaaaatagtggtgtccttaaaacacacacagaaagaaagagaaagaacagattttggggagaaaagatgaacttgactttgaatttactaagctttagataaggaagtaaaacctagatgaaattgcccatcaggcaaaggaaaggtaaggttgaagttagaagtagatttagttgtcatctctgtagaagggattctcaccagacagagattttctaaagaagggactgaggcctgagggaatggctttacttaggaactacaagaagaaaaaaaaaaaaaatgaagaaatggtcattgacctatttgaagcttaggataatcctcaaacaatgagatttcactgtattttgtttttatttatttatttgagacagagtctcgctctgtcacccaggagaatcacttaaggccaggagtccagcctgggcaacatagcaggatcctatcccttta

SEQ ID NO: 728976 - DNA, 585 bp, Homo sapiens
  misc_feature (13)..(13): n is a, c, g, or t
  misc_feature (19)..(19): n is a, c, g, or t
  misc_feature (21)..(21): n is a, c, g, or t
  misc_feature (29)..(29): n is a, c, g, or t
  misc_feature (32)..(32): n is a, c, g, or t
  misc_feature (123)..(123): n is a, c, g, or t
  misc_feature (147)..(147): n is a, c, g, or t
  misc_feature (157)..(157): n is a, c, g, or t
tcacatggcatgnaagttngntgagctgnagnaaaagattgatcgtcgttttggtaaaagctggaagatggtttcacattcttgaagtctggtgatgctgttattgttgatatggtttttggncagtctatgtgtgttgagagtttnttagactatncacttttgggtcgctttgctgtttcgtgatatgagatagatagttgcggtgggtgttattaaagcagtggataagaaggctgctggagctggtaaggttattaagtttgtctagaaagtttagaaggctaaatgaatattatccctaatacctgccaccccactcttaatcagtggtggaagaacggtctcagaactgtttgtttcaattggccatttaagtttagtagtaaaagactggttaatgataacaatgcattgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgaga

SEQ ID NO: 728977 - DNA, 1269 bp, Homo sapiens
catctttcatatcttgatatgcagctgcatcagatggaaaaaaatttactaaagcaccctgttaaagagctggtgtgctccagtgaggccctctccttttctcagcacagtgtggcagtggtaatctattcaaattttgcctgttacacaaaataatccacttatatatacagtcagccttccgtacttgtgggttctgcatctgtggattccaccaactgtagatggaaaatactcaaaaagaaagttgtgtctgtactgaatatgtacagactttttccttgtcattattccctaaacaatacagcgtaacaactatttaaataggatttacattgttttaggtattataaattacctagagatgatttaaagtatatgggaggatgtgcataggttatatgcaatttctgcaccattttatgtcaaggattttgaacatcctcagattttggtgttcgagggcatcctggaatcaattccccatgataccgagggatgactggatattaatcgatttccctcaagcctgcccttgctgtgaactagtgctacaagcacgggaaatccatctgctctctggcttaaaatatgtatctcatctaaaattgttcgttaaagtgtgaataaattgctaagtggttgttgcttagcaataatttttgcctgaccatcagcagagcttttatttacctttgtaattaaaatccaacatagcatgggctcttgggcaaaatatttcactgactattaagcatgtagaacaggaaaatgaaatacactatttgtgcccttgacctagaaccagaaccactaattatgagaactttgttttatgtaccaaattcacattgaccattttctgagctctagactgatcgtagtaagttttgtgacttaacaatgaaagaaagtagaaagatgctttgggttttcaaaatgttgttttttaaaattgttctttgggtgaatttactcagtgctgctttgagttgtatacagaaacaaatgttgggaattgctcctcagaaatgtgttcctaagttgtgttttcaactttacatcatgaggtgaagcattagggaaagagattctttcgatttgtttaataatctaattatacagaccaaagtgctttacgtttctgctctatgttaatgttttagaatggtgattttgctgattaatttagacctggaattgaaataatgtgctcagaataataacatggttatagttcttgtatgataaagtattcaatttcagaat

SEQ ID NO: 728978 - DNA, 973 bp, Homo sapiens
tccggctgcccgcgcacctctccacgccggccccgttccgcggctcgccctcggctgcgctcggctcccgcgggcgctcggccccgagcccctcctccccctacccgccggccggacagggaggagccaatggctgggcctgccatccacaccgctcccatgctgttcctcgtcctcctgctgcccctggagctgagcctggcaggcgcccttgcacctgggacccctgcccggaacctccctgagaatcacattgacctcccaggcccagcgctgtggacgcctcaggccagccaccaccgccggcggggcccgggcaagaaggagtggggcccaggcctgcccagccaggcccaggatggggctgtggtcaccgccaccaggcaggcctccaggctgccagaggctgaggggctgctgcctgagcagagtcctgcaggcctgctgcaggacaaggacctgctcctgggactggcattgccctaccccgagaaggagaaccgacctccaggttgggagaggaccaggaaacgcagcagggagcacaagagacgcagggacaggttgaggctgcaccaaggccgagccttggtccgaggtcccagctccctgatgaagaaggcagagctctccgaagcccaggtgctggatgcagccatggaggaatcctccaccagcctggcgcccaccatgttctttctcaccacctttgaggcagcacctgccacagaagagtccctgatcctgcccgtcacctccctgcggccccagcaggcacagcccaggtctgacggggaggtgatgcccacgctggacatggccttgttcgactggaccgattatgaagacttaaaacctgatggttggccctctgcaaagaagaaagagaaacaccgcggtaaactctccagtgatggtaacgaaacatcaccagccgaaggggaaccatgcgaccatcaccaagactgcctgc

SEQ ID NO: 728979 - DNA, 429 bp, Homo sapiens
aataatagagacagtctttcattcctagtgccaggacccgtctcgggtcaacgaaatctgagacagtcaaggtaacagaggcagctgttcgaatagattcattggagagtctaaggcagctctccggaccaagctgtaaagcagataagatagaaataatcactctggtaccacagcagacaggccttgtaggtactgggccgctcacagcttaatccgacttagaaagcatttttgcctctgaccttctagttgaaacaaaattagttaccagtagacttaggcgaatgctacactgcacacaggcgcataaccccaacctatataaacactaagacaattgttgacactttgagttggcctggtggaattatctccagccttctgcctgtatctggttacagcaataaattcccttctttcctagtc

SEQ ID NO: 728980 - DNA, 740 bp, Homo sapiens; identical to SEQ ID NO: 217386

SEQ ID NO: 728981 - DNA, 869 bp, Homo sapiens
acaaattcactggttatttaaaaagactatgcttgtaaatgacatatcatttttatactgcaactcacaagattctcttcttgtctgtgacttttgaaattgtgtttatatatgtgtttgttataaatatcattgtgtgtatcctaatttgttgagcttcttcatttgtacataactttttttttttttaacttttaggattttttagttatttatttttgtattttgcttatgtagtttgtgtaattttataaatttgatatgtaaaatatattcatctgagtctaggaagtggtgtaatttgttacttttatgtctttcagttatatattctcatttcactgaagacctttggccagagcatagcataaaagattcttttcaaaaagtgatactgagaggatatggaaaatgtggacatgagaatttacaattaagaataagttgtaaaagtgtggatgagtctaaggtgttcaaagaaggttataatgaacttaaccaatgtttgagaactacccagagcaaaatatttcaatgtgataaatacgtgaaagtctttcataaattttcaaattcaaacagtcataagaaaagaaatactggaaagaaggttttcaaatgtaaagaatgtggcaaatcattttgcatgctttcacatctaacacaacatataagaattcacactagagagaattcttacaaatgtgaggaatgtggcaaagttcttaactggttctcagagcttattaaacataagggaattcatatgggagagaaaccctacaaatgtgaggaatgtggcaaagcctttaaccaatcctcaacccttattaaacataagaaaattcatattgaagagaaacccttca

SEQ ID NO: 728982 - DNA, 954 bp, Homo sapiens
agcggacaggacggcttccgggatttggcggggcctttgtctctagctgctgcgggagctccaggtctagtctttactgctctgtgtattctgctcctagaggcccagcctctgtgactccgttatctgcaggtattgggagatgcacagctaagatgccaggaccacctggaagcctagaaatgggaccactgacatttagggatgtggccatagaattctctctggaggagtggcaatgcctggacactgcacaacggaatttatataggaaagtgatgtttgagaactacagaaacctggtcttcctgggtattgctgtctctaagcctcacctgataacctgtttggagcaaggaaaagagccctggaataggaagagacaggagatggtagccaaacccccagttatatattctcatttcactgaagacctttggccagagcatagcataaaagattcttttcaaaaagtgatactgagaggatatggaaaatgtggacatgagaatttacaattaagaataagttgtaaaagtgtggatgagtctaaggtgttcaaagaaggttataatgaacttaaccaatgtttgagaactacccagagcaaaatatttcaatgtgataaatacgtgaaagtctttcataaattttcaaattcaaacagtcataagaaaagaaatactggaaagaaggttttcaaatgtaaagaatgtggcaaatcattttgcatgctttcacatctaacacaacatataagaattcacactagagagaattcttacaaatgtgaggaatgtggcaaagttcttaactggttctcagagcttattaaacataagggaattcatatgggagagaaaccctacaaatgtgaggaatgtggcaaagcctttaaccaatcctcaacccttattaaacataagaaaattcatattgaagagaaacccttca

SEQ ID NO: 728983 - DNA, 1142 bp, Homo sapiens
agcggacaggacggcttccgggatttggcggggcctttgtctctagctgctgcgggagctccaggtctagtctttactgctctgtgtattctgctcctagaggcccagcctctgtgactccgttatctgcaggtattgggagatgcacagctaagatgccaggaccacctggaagcctagaaatgggaccactgacatttagggatgtggccatagaattctctctggaggagtggcaatgcctggacactgcacaacggaatttatataggaaagtgatgtttgagaactacagaaacctggtcttcctgggtattgctgtctctaagcctcacctgataacctgtttggagcaaggaaaagagccctggaataggaagagacaggagatggtagccaaacccccaggcagaactggccgtgaactgtggctcagggagctggaactgagtcatcgaactgcttcagaaaccacagtaaaggacaaggtctgcaggcctgcctgcgtggctataaatggctgtcttcctccaggcctctggaagggcacggtctctcccagactgtggctgggaggagtttgggatgattagagattatatattctcatttcactgaagacctttggccagagcatagcataaaagattcttttcaaaaagtgatactgagaggatatggaaaatgtggacatgagaatttacaattaagaataagttgtaaaagtgtggatgagtctaaggtgttcaaagaaggttataatgaacttaaccaatgtttgagaactacccagagcaaaatatttcaatgtgataaatacgtgaaagtctttcataaattttcaaattcaaacagtcataagaaaagaaatactggaaagaaggttttcaaatgtaaagaatgtggcaaatcattttgcatgctttcacatctaacacaacatataagaattcacactagagagaattcttacaaatgtgaggaatgtggcaaagttcttaactggttctcagagcttattaaacataagggaattcatatgggagagaaaccctacaaatgtgaggaatgtggcaaagcctttaaccaatcctcaacccttattaaacataagaaaattcatattgaagagaaacccttca

SEQ ID NO: 728984 - DNA, 827 bp, Homo sapiens
agcggacaggacggcttccgggatttggcggggcctttgtctctagctgctgcgggagctccaggtctagtctttactgctctgtgtattctgctcctagaggcccagcctctgtgactccgttatctgcaggtattgggagatgcacagctaagatgccaggaccacctggaagcctagaaatggtattgctgtctctaagcctcacctgataacctgtttggagcaaggaaaagagccctggaataggaagagacaggagatggtagccaaacccccagttatatattctcatttcactgaagacctttggccagagcatagcataaaagattcttttcaaaaagtgatactgagaggatatggaaaatgtggacatgagaatttacaattaagaataagttgtaaaagtgtggatgagtctaaggtgttcaaagaaggttataatgaacttaaccaatgtttgagaactacccagagcaaaatatttcaatgtgataaatacgtgaaagtctttcataaattttcaaattcaaacagtcataagaaaagaaatactggaaagaaggttttcaaatgtaaagaatgtggcaaatcattttgcatgctttcacatctaacacaacatataagaattcacactagagagaattcttacaaatgtgaggaatgtggcaaagttcttaactggttctcagagcttattaaacataagggaattcatatgggagagaaaccctacaaatgtgaggaatgtggcaaagcctttaaccaatcctcaacccttattaaacataagaaaattcatattgaagagaaacccttca

SEQ ID NO: 728985 - DNA, 2057 bp, Homo sapiens; identical to SEQ ID NO: 217153

SEQ ID NO: 728986 - DNA, 2260 bp, Homo sapiens; identical to SEQ ID NO: 289176

SEQ ID NO: 728987 - DNA, 2623 bp, Homo sapiens; identical to SEQ ID NO: 289180

SEQ ID NO: 728988 - DNA, 2338 bp, Homo sapiens; identical to SEQ ID NO: 289177

SEQ ID NO: 728989 - DNA, 2543 bp, Homo sapiens; identical to SEQ ID NO: 289181

SEQ ID NO: 728990 - DNA, 1028 bp, Homo sapiens
cccctccacaccttcccacttgaaccggcaccgacctgagggagagggggccgggaagcgctggacgcccggggtcgggggaacgggcgtgggaggcgtctggacctgctgcctccgctccagtgctgggcggggcttcccggcctcccatggggggagggagagacccagggggagggacccacggagggatgcgaggcgggcaggagtcagcccgttggagacctgggcgagggagacgccgagagctaggctcagtgggagggggcgggcgtagaggctgaggcaccgcccagagctcgctgagacagagactgagaacgcccccggccagattccccccggagagacccgggtagggacagggacagagagacgcctctaggggcagaggccctgggaggcaaagacccccaggagagatttacccaccccagacggaaagcgcggctcagagtcggacgaggggagactgtcagaggacaacgccccctaggtctcctgggagaccccgaagcgaccccgggggcagcccgggccgtgtccgggcgagggtgacctatccttggttgagagcgatggggacacaagccctgcagggcttcctctttctcctcttcctcccgctgctgcagccgcgtggggcctcggctgggagcctgcacagtccaggcctgtccgaatgcttccaggtgaatggggctgactaccgcggccaccagaaccgcactggcccgcgcggggcgggccgcccgtgcctcttctgggaccagacgcagcaacacagctacagcagcgccacggccccagcggcacctccacgaagctcacggtccaggtgtgcctacgcttctgccgcatgaaggggtaccagctggcgggcgtggaggccggttacgcctgcttctgtggctctgaaagcgacctggcccggggacgcctggcccccgccaccgactgtgaccagatctgtttcggccaccctggacagctgtgtggcggcgatgggcggctgggcgtctatgaag

SEQ ID NO: 728991 - DNA, 202 bp, Homo sapiens; identical to SEQ ID NO: 289179

SEQ ID NO: 728992 - DNA, 561 bp, Homo sapiens
ggttgtggagcttctccctttcacagagtccctgatctccgaaaatttggttgagatgtaaggttgattttgctgtacaactccttttttgaagttttactcatttccaacaaggaaggcaagttttcctgcttccattgacaaaggagagcaggcacctcctttcctgagtttcagcttgcttctgacagggaaggtgagtgtaagtttttccagcttctaagatggcagagaatgatcacccagtctgagccttatttccaggtaagtagctgaattagagttttgtcttaaaatttttgtttaatgactaaaatttaagattacccaccagctgcttttaattcctccttaccattagaacactcagttaatcatatgaattgtgcatttgtttgttttgcttaactctttttgtttatgtttggggttttattgttgtttcacttttctcccatctcttcctgacttggtcaaatccaaaggaatgttccaaattgtggggagcaaggcatctgaattggctaaaactcctgtggctgcaaaacaaaaacaaaacaa

SEQ ID NO: 728993 - DNA, 942 bp, Homo sapiens
gtatcgacgtgagattttgcaaatttgaaccataggttatatttgtaagattgttctctcagttattaagagtttgaaattggggttgaactgtgtctaaagctatggtttatgtgtatgtttagtttatgtagttgctgtgtgcataacatttggcaggggaaaatgtttttactttcaaacaaactgacaagaaattgttccatcttgaatttgtgtaagaacgtttcagaactaaaacaaacttaccaaaactaggtcttgtccattaaatgagataatgcgtgtaatgtgtctagcaagtacttggaaattattattgttaagactgtcttatagtctaacttatcaactacaatgatgcctcttctgaatttcctaatttcttgcctttatctttttttttttttaattatactttaagttctgggatacatgtgcggaatgtgcgggtttgttacataggtatacatgtgccatggtgatttgctgcacccatcaacctgtcatctaggttttaagccccacatgcattaggtatttgtcttaatgctctcttgccttttatcttttttatgatgaggattatatatatacacacacacacacaatgcctcctgtatgctcagtatcacttttagccaataaaattgagattctggccaggcacagttgctcacacctgtaatctcagcattttaggaggccaaggcaggtggattgcttgagctcaggagtttgacactagcctgggcaacatggcaaaaccctgtctctacaaaaaattaactaggcatggtggtgtgtgcctgtagtcccagctacttgggaggctgaggtgggaagatggcttgagcctgggaggcggaggttgcagtgagtcgagccgagatcacacaccactgcactccagcctgggcaacagagccagaccctgtctca

SEQ ID NO: 728994 - DNA, 1073 bp, Homo sapiens
cttagactttttctagaatattattggccaagtgatttcaggttctctgtggactggtgggggaaggggtgaggagactattggtagaaactgtattatacgaaatccaattgttctttatgaaacccaaataggattcctcagaccctggcactaaagaaaaaatatataccctgagacttttccaaaaccttaaatttgaaaatcctactagcatgtgattacgatgcccccctaaaacacagtatattattatatttttaggagagtcactacttaccataaactgaaaaattttaagaattaacatagacatgaagcctcaaagtaaatcaacgtattactattcatcttggattctcaaaccccctgccctttgatgcgaaatgtaataaatacatcatattaatactttgtagttggcagggtagaagccagcttgaaaggcagatgctggccagacagctaggctcactcgctagcgaaatgactcgcatctgcgaatttaaaagtcatgatacgtcatccaccttcaggattacttgtgaatgtttgcaacactggatattaattaaatccttaaatgctggatatctattgcacatatccgaacaatttgtggtgacactaaaggaatttttgtttcttcaggtatggctatcctgatccttcttacctgaaacgtgtcaaagaggagctgaaagctaaaggaattgagtaagacaactgctggaagatgtcttaaatcaagctttcaaaaaaatatattttaggaggctgatttaatgccagtctaaatccttatgtagaaaggactttgaaatttttcttctcaagaaatggtttgtataagaataacaatctgctagtctgtcatttctggagtgatacttttttttttgagacggagtctgctctgtcgctcgcgctggagtgcagtggcatgatctcggctcactgcaagctccgcctcccaggttcatgccattctcctacctcagcctcccgagtagctgggactacaggcgcccaccaccatgcccggctaatttttgtttttgtatttttagtag

SEQ ID NO: 728995 - DNA, 427 bp, Homo sapiens
gaaatgcggcaatttgtggatgtggatataagtagactctatagcagtggaattggtgttttaagagctgctgatcggggatggtaatctcaaagacagaaagattggtctccatcaacttctaccgtgccagctataaagtactatggagttatttaaattttgcaccaaaggacagggggcttttgaatccgagatgaatactatataagctgatttaatttgaggcgttgtgtctatctgaaggctagaggctcggaatgtcactttgcttccttttaaggtcacctttttttttcaccccttcccccaccagtccacagagaacctgaaatcacttggccaataatattctagaaaaagtctaagttgtgaggagactattggtagaaactgtattatacgaaatccaattgttctttatgaa

SEQ ID NO: 728996 - DNA, 4049 bp, Homo sapiens
ctgagacctgagatgctcccatgagttttgaatatgctctgctccttacagcaaagacaccatttttaaaagtaccattcttttgactttgctgttcccaaggcttctgtgatattccggcccctccgtttaaaagccatcagatttgagagcaataagtcttcaaaaccgggaatttacattgtttttcagctgaccgacttccaggaaaaggactcaaccgcatctacccaaataccgtggcactgcttgcgctctttgccaccggatactccccttccaatgagactttctgattgtgtctaccaactctcctattaggaaacccgtgggttgcatgcagctattctgttgtattctcattctcactctccctcccttctctcactctcactcttgctggaggcgagccactaccattctgctgagaaggaaaagcccgcaactactttaagagattaagacaatatgcgcaatcctcgcctttcctagcaatcactatttaaatctggcaagaactgacaacagtctttgcaagaatggaatccgtaaaacaaaggattttggccccaggaaaagaggggctaaagaattttgctggaaaatcactcggccagatctacagggtgctggagaagaagcaagacaccggggagacaatcgagctgacggaggatgggaagcccctagaggtgcccgagaggaaggcgccgctgtgcgactgcacgtgcttcggcctgccccgccgctacattatcgccatcatgagcggcctgggcttctgcatctccttcggtatccgctgcaacctgggcgtggccattgtggacatggtcaacaacagcaccatccaccgcgggggcaaggtcatcaaggagaaagccaaattcaactgggacccggaaaccgtggggatgatccacggttccttcttttggggctacatcatcactcagattccgggaggctacatcgcgtctcggctggcagccaacagggttttcggagctgccatacttcttacctctaccctaaatatgctaattccatcagcagccagagtgcattatggatgtgtcatctttgtcagaatactgcagggacttgttgagggtgtgacctacccagcatgtcatgggatatggagcaaatgggccccacctctagagaggagtagactggcaaccacctccttttgtggttcctatgccggagctgtgattgcaatgcctttagctggcattcttgtgcagtacactggctggtcttcagtgttttatgtctacggaagctttggaatggtctggtacatgttttggcttttggtgtcttatgaaagtcctgcaaagcatcctactattacagatgaagaacgtaggtacatagaagaaagcattggagagagtgcaaatcttttaggtgcaatggaaaaattcaagactccatggaggaagttttttacatccatgccagtctatgcaataattgttgcaaacttctgcagaagctggactttttatttattgcttattagtcagccagcatattttgaggaagtctttggatttgaaattagcaaggttggtatgctatctgctgtgccacacttagtaatgacaattattgtgcctattgggggacaaattgcagattttctaagaagcaagcagattctttcaactacgacagtgagaaagatcatgaattgtggtggttttggcatggaagccacactgctcctggtcgttggctattctcatactagaggggtagcaatctcattcttggtacttgcagtgggattcagtggatttgctatatctggtttcaatgttaaccacttggatatcgctccaagatatgccagtatcttaatgggcatttcgaatggtgttggcacattgtcaggaatggtttgtcctatcattgttggtgcaatgacaaagaataagtcacgtgaagagtggcagtatgtcttcctgatcgctgccctagtccactatggtggagttatattttatgcaatatttgcctcaggagagaaacaaccctgggcagacccggaggaaacaagtgaagaaaaatgtggatttattcatgaagatgaactcgatgaagaaacaggggacattactcaaaattatataaattatggtaccaccaagtcttatggtgccacaacacaggccaatggaggttggcctagtggttgggaaaagaaagaggaatttgtacaaggagaagtacaagactcacatagctataaggaccgagttgattattcataacaaaactaattactggatttatttttagtgtttgtgattaaattcattgtgattgcacaaaaattttaaaaacacgtgatgtaaacttgcaagcatatcaaccaggcaagtcttgctgtaaaaatgaaaacaaaacaaacccatgaggttaccatcaagtgcaatctgtaaaattgtgaagttccatcatttccattcaagtcatccattcttgcatttgtgacttaaaggttgactggtcaaaattgtagaaacaagtagttacccattggattcatatgagctaaaactcatcactatttactaaagcacaacatctcatcctacaaaagttaagaagccaaagctacttgatcatgcaaaatgcacttatatatttgttacactgtattgcaagatagcacacagaagttggctgcgtcaagtagaggcgacatttattaagtgaaaatcatggagttgggatatctctcaattaaagaaatacattgtgaactatcagctacaaagttgtactgaataactattagaattgcataatgtgagatattttgttagtcctcaaaaggaatatcttgcagtgttttctatgaaatgcttgggcacaaacacttatttctgtgaaagagaacatgtaagttgaggggtatgcttcatgttcttccatccatttacctaatagtatgaaacagttcacatttcaataaaatcaaacttttcatgtagcgtatcacataacttttttgcaaaaaatataaaaagaaataaacttcaatgtattttttattacaactttgtactggttgtaacttgcattagaaaaaaaaaagagatatataaaccacaaagaatctaataagaaatttattatggagatatagcccttaaaatgcaatattaagaacaaagaaatagaaaatggtttagatatctttcttccttcataattaaatactatatgaaacttgtgccacagagctatatgtaatatgaaaagattaacttcatagagatattgtaagtaggtaattttattatttaaagtcctattaagaaatatttgtcttaaatatataggacaatacattatattaaaatggtctctctctatatatatctgtatatcttatacatgtccatacacagaaacataataaacaatcttcacacgaaaccaaaaatagcatacacctaatgttgggttagggaattgcaatttctactttcatagagtcatagaattttaggtggggaagaggcattttgcttgtcatttcttaatataactcaacaagaattgcaacatttgtgtaccaagcaataagtgcaatgcataaaatttcctgtctgtatattaccttcattttgcttgtagtagctgtttgggtggttggaataattttatttttcttttaaaaaagctaacatcagacccctttataatgtcctaaaattatgataatacatttcccaattcaactcaaaatattattggtgtattttgtctattctggatatttgatctgtttaatgtactgtgctagtgactggaggccctgctactgcaaatataaaacctaaagtttgtttaaaaaaatgcaaatcattctttaccttaagaaaaaaaaaataccctttgctttgtgcctcaaagtgatgtaatgtgatcacagcttttgttgtgttgaatgaaaatatgtggactgtcattttgttgcagcaaaaaagtgttaataaaatgctctatttatccttttttta

SEQ ID NO: 728997 - DNA, 537 bp, Homo sapiens
acacacgatcatcaacacatacttagcctttttagatccataaagtccagaaggcagtagggatcccaagacgacctcacccaaagggctccctggctctcctctgatggaggggcactgcttgcttggcccggtcccctccgtgccagttcccaggcgcactctactccagcccttctccctccctcccttcctccctctcctggcccaccctgctcttccctcgccctgcaaattaggtgggtgtggcaagggcaccgcctggtcccaagtgtccctctgtacccacacccacccactcacttgtaagctccttgatgagcaaacccctaaggcccccagctcagactcagcaggcattcaggtcaactcaggcagactggctaaggaccagcccagggcaattttgcagaaatgatcatttgcacagaatgggtttccttcacagggagaaacttgcctctgaaagctattttctgatcaagaaaaggcccactttttaaaaagtgaaacaagtttgcagatacggttctcttc

SEQ ID NO: 728998 - DNA, 637 bp, Homo sapiens
ggagcaagctgccagagagagggtgtcagagagcttcagaggagcccttttgagtcttctgctcagtaatgatcagcacatattgattttatttttaactgacatgaggccatttctgcccacgctcttgatgcttagtaaaacatgaacgagcctgttaaagcaacatgcaggagatggagaagttcggccacatgcccattgctttcctgcgagtggcaggagagtcttctgtcactgggaccagaatgtgcctagaggcaggaaatctcaacacgactgtgagatcagaccacaatccacaaagcgctgctgtttctctcaaaggcaggttctcaggctgagccgtagatttggagaaagcacccctcacccagctccacatctgtgtgtctgcgtgcacacgtgtgtaaaacatggtgtatgtgttctcaaacattcacgaaattagaaatgttgagagagatgaaaataaatataaaaatactgctgtgatacatttttcttgccgcacccacaactggactgtgtacatgggccctctttaggagacttaaactcaatgctgaaacactttgcacaatgcctggcgtgttatgcactcaataaacattagtgtctatcgttaaaaaaaaaa

SEQ ID NO: 728999 - DNA, 578 bp, Homo sapiens
cgtctcccattccaggcttcctcttcaagactgtgtggtggtgtggcttcatttcgcagagaaggggcgtggaaaggtaaaaccatcttcttggacgtgggtctgctcctctctgccggacaatgtgctaccgtggggcttttgtcctgggctgcagtgtggtcctctcgatcctagaaaagaggccgctcaggatggggatgagacttccattgctccgggcccgatgcatcccctcacgttatcgaggcctgcacagacccaaagtggaaccgccgcgaagacgatggacagctggccgcaggacccagggagagacgcagaaagaggctcaccaaagaccggtccacataaaagacatccctttttgacgcacagggcacattcgtccaaagacacacacacacacacacacacacagagggaaagaagcacacagagggtgagagacagagagagaagggagaatgggagacacagccccacacacagtcctaccgcggtggccgagaaatacacgccccaggcaaccctgcggctgccgggttctgctctggaggggaacaaccctcggctga

SEQ ID NO: 729000 - DNA, 495 bp, Homo sapiens
tcctctcctgccggacaatgtgctaccgtggggcttttgtcctgggctgcagtgtggtcctctcgatcctagaaaagaggccgctcaggatggggatgagacttccattgctccgggcccgatgcatcccctcacgttatcgaggcctgcacagacccaaagtggaaccgccgcgaagacgatggacagctggccgcaggacccagggagagacgcagaaagaggctcaccaaagaccggtccacataaaagacatccctttttgacgcacagggcacattcgtccaaagacacacacacacacacacacacacacacacacacacacacacacacagagggaaagaagcacacagagggtgagagacagagagagaagggagaatgggagacacagccccacacacagtcctaccgcggtggccgagaaatacacgccccaggcaaccctgcggctgccgggttctgctctggaggggaacaaccctcggctga

SEQ ID NO: 729001 - DNA, 1379 bp, Homo sapiens; identical to SEQ ID NO: 286033

SEQ ID NO: 729002 - DNA, 376 bp, Homo sapiens; identical to SEQ ID NO: 233459

SEQ ID NO: 729003 - DNA, 432 bp, Homo sapiens; identical to SEQ ID NO: 233460

SEQ ID NO: 729004 - DNA, 347 bp, Homo sapiens
  misc_feature (43)..(43): n is a, c, g, or t
  misc_feature (45)..(45): n is a, c, g, or t
gttgagcccaaagagcttgcttacttgctgggaggcagggcgngnagacgctgacttcaggacgacttgggcctgcagaggtcgccaggaggcccaagctggcgcggaggagcccaccgaccggagaccgtttggggcctggagacgccatcggagggcaggagctgatcctggagaggccaccgtgagcctgacctgggcctggggagcttggcttgaggaagctgtgggccgaccaaggccgccagaggatgggcaggcgctgagtccaaagaggttgttgggaggcagcagtcgggcctggagacgcagccgggaggaagagctgggcccggagaggacgccgg

SEQ ID NO: 729005 - DNA, 871 bp, Homo sapiens; identical to SEQ ID NO: 343124

SEQ ID NO: 729006 - DNA, 507 bp, Homo sapiens
actaggaaaattgaaatgggcacagaaattccttgttcgagagccttctggttatactttaaaaagaagggagcctagcatcttgtcaaatctttgagcccactcactcagagggcctgtcactcatccagaattgaatctgctggtttaacaggtcaggcagtgtgatttgacagcgtgaatcttagagtccagcctttgaacctggcgctgaatcctgactttactgcttattcagggggccactagctaagttaatttgtgagcctgggcaacatggcgtgacccatctctacaaaagatacaaaagttaactggatgtggtggtgcatgcctgtggttcatagctactctggaggctgaggcgggaggatgacctgagtgcgggaggttggggttgcagtgagctgaagttgcgccactgcactccagcctgggtgacagagtgagaccttatcttaatctaaaaaataaaatttctgagcccataaaacagggccaggctca

SEQ ID NO: 729007 - DNA, 749 bp, Homo sapiens
aattcgcggccgcgtcgacacgacagaagggggactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaaaaaaaagaaaaaaaaattataaaaaaaaacatgtggccgcccttggtccaacaagtcttttaatttcttcaagctttttcatttcggcgccaaattaagcgatcttttggccaaatacccccttataaggggggggttttaacaaaaaaaggggcccgcgttttaaaaacagttgatttgtgaaaaaccctgggggtcccacactaaaagacctttttgaacaaaaacccttttttgcgggcggtgggattaacaaaaaagcccccacccaaagggtcttttcaaaaaaatgggccccctttaaggggcaatgaaaaatttgccggcctaaatattttttaccccgcgattt

SEQ ID NO: 729008 - DNA, 750 bp, Homo sapiens
  misc_feature (113)..(113): n is a, c, g, or t
  misc_feature (694)..(694): n is a, c, g, or t
aatacagcgcattcaacttgcaaacacccttccactcccacaaagagcaagctgtcactggccaatcaaaacaatgaaccataatgaaacagtttttcttgctccacccactnggtgaccaaatttgaaaaaaaaaaaaaaccgcgccaactcatgttgttttcaatcaggtccgccaagtttgtatttaaggaactgtttcagttcataccttccactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaaaaaaaagaaaaaaaaaaaaacccaaaggcccttttcagggccgctcacaaagtcgtttaaagagctgaaatgcgttgcgagaatgagtttggatgacagaaataaccgtgacancctgcataagaatgaattgtgtttgccatgaccggccacactgtgacaaaatttca

SEQ ID NO: 729009 - DNA, 551 bp, Homo sapiens
  misc_feature (1)..(1): n is a, c, g, or t
  misc_feature (33)..(33): n is a, c, g, or t
  misc_feature (73)..(74): n is a, c, g, or t
  misc_feature (88)..(88): n is a, c, g, or t
  misc_feature (90)..(90): n is a, c, g, or t
  misc_feature (97)..(97): n is a, c, g, or t
  misc_feature (123)..(123): n is a, c, g, or t
nccaggccaaattggtaacccccggccccatcnccaccttaaacgacgcccatgattgtaatacgactcaccnnaggccaaggttacngnccccccntcgagttcgacgtatcgttagcttgntatcgaattcgcggccgcgcgacacggctgcgagaagacgacagaaggggactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaaaaaaaagaaaaaaa

SEQ ID NO: 729010 - DNA, 494 bp, Homo sapiens
  misc_feature (371)..(371): n is a, c, g, or t
  misc_feature (391)..(391): n is a, c, g, or t
  misc_feature (408)..(408): n is a, c, g, or t
  misc_feature (430)..(430): n is a, c, g, or t
cgcggccgcgcgacacggctgcgagaagacgacagaaggggactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcgggcttggnaaaaaaaattttcccccctntttttaaaaaaaaaagngggggaaaaaaaaaaatttttntaaaaccccccgggcgccgtcttatgagaacttaaaaacaataaaaaaggctaccgatcttcta

SEQ ID NO: 729011 - DNA, 440 bp, Homo sapiens
  misc_feature (45)..(45): n is a, c, g, or t
cgcggccgcgcgacacggctgcgagaagacgacagaaggggacgncgagaagacgacgaagggatgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaaaaaaaagaaaaaaa

SEQ ID NO: 729012 - DNA, 522 bp, Homo sapiens; identical to SEQ ID NO: 243565

SEQ ID NO: 729013 - DNA, 422 bp, Homo sapiens
tctggaaggtttcatacgggaagtgacatgttaagatctggatcttaaagaacttggggttcccgaagaagctcggtgccatcaacaggaaaggatgagactttggattccagaagaacactgctggggcttccccccgagtctgccacttgctgtcgtgcaggcggagtggagagtgacacggccacgtaattggttgaaaatttgaacggcatgctcttgtacctgggagggcgttccaaaggctatgaaaacattgggaacagactcaaccacttcaaaggcacaggtggctggtgaatggaaccctttgctgcctgctggttcccaattttgaatgtatctttttgtttaaaatgtctttgttacaaaccaaacgttacaagaattgtaggggaaatgaattaaaagtagaaacaata

SEQ ID NO: 729014 - DNA, 919 bp, Homo sapiens; identical to SEQ ID NO: 249878

SEQ ID NO: 729015 - DNA, 402 bp, Homo sapiens
  misc_feature (1)..(1): n is a, c, g, or t
  misc_feature (20)..(20): n is a, c, g, or t
  misc_feature (24)..(24): n is a, c, g, or t
ntactactactaaattcgcngccncgtcgacgtgaggaactgagaaacatggatggccttgggaacgtggaaaagggtcactgaaatgggacgacatgaactcaaggaggctatttatgaccatgtcatttgcaacatgaagaaagcttatctggagtgaaagtaaatgagaccaacagagatgagagacccggagaaatcctggttacactgcttgaatcctgtcagtcctatactggagtcctgttaatacaaaataattaagaaagaactctccaccacggggaatgtgaaaggtatatgagtcccttttcacgatgcgatgtcatgtcttttaaataagccatactttatgttcaataaaaagagaataagcaggaaaaaaaagtcgacgcggccgcg

SEQ ID NO: 729016 - DNA, 756 bp, Homo sapiens
  misc_feature (1)..(1): n is a, c, g, or t
  misc_feature (20)..(20): n is a, c, g, or t
  misc_feature (24)..(24): n is a, c, g, or t
  misc_feature (601)..(601): n is a, c, g, or t
ntactactactaaattcgcngccncgtcgacactaccgtttgctggttttgaaaatggagaaaaagagtgaggaactgagaaacatggatggccttgggaacgtggaaaagggtcactgaaatgggacgacatgaactcaaggaggctatttatgaccatgtcatttgcaacatgaagaaagcttatctggagtgaaagtaaatgagaccaacagagatgagagacccggagaaatcctggttacactgcttgaatcctgtcagtcctatactggagtcctgttaatacaaaataatagtaataatccctctgtttcttatgtttatgccaacttcaacaaaaagaaacttgactaagagacaatataagaatttaatgtgtaattaagaaagaactctccaccacggggaatgtgaaaggtatatgagtcccttttcacgatgcgatgtcatgtcttttaaataagccatactttatgttcaataaaaagagaataaggcaggattcgcaagagaacacaatccctttttaactgctgggaagatacttttagtcattaatgactggacgacaatttgggacacatatatggatattggncggttgtgatgatgtgattggctctaagtgacaacattgttccctgtatagagtgagtggcaagtgcatttataaaattggccatcatggctgttaaattatgagtctagaagtgtgctcttcaaacagttttgggaggtttcctgaagaaagaa

SEQ ID NO: 729017 - DNA, 943 bp, Homo sapiens
  misc_feature (788)..(788): n is a, c, g, or t
gatgtaagtgagattctgaagaaggaagagaagaacagtgttaagtatcctggcaaaggagcattagggttacagatagaattgaagttgctcgtcagctgattgaagataaggagattggcctggattatccaggtaggctcaatgtaatcaggaagggcctttaaagtgagagagggaggcagaagaggaagtcagagcgatgtgctgtgaaatctactaccgtttgctggttttgaaaatggagaaaaagagtgaggaactgagaaacatggatggccttgggaacgtggaaaagggtcactgaaatgggacgacatgaactcaaggaggctatttatgaccatgtcatttgcaacatgaagaaagcttatctggagtgaaagtaaatgagaccaacagagatgagagacccggagaaatcctggttacactgcttgaatcctgtcagtcctatactggagtcctgttaatacaaaataatagtaataatccctctgtttcttatgtttatgccaacttcaacaaaaagaaacttgactaagagacaatataagaatttaatgtgtaattaagaaagaactctccaccacggggaatgtgaaaggtatatgagtcccttttcacgatgcgatgtcatgtcttttaaataagccatactttatgttcaataaaaagagaataaggcaggattcgcaagagaacacaatccctttttaactgctgggaagatacttttagtcattaatgactggacgacaatttgggacacatatatggatattggncggttgtgatgatgtgattggctctaagtgacaacattgttccctgtatagagtgagtggcaagtgcatttataaaattggccatcatggctgttaaattatgagtctagaagtgtgctcttcaaacagttttgggaggtttcctgaagaaagaa

SEQ ID NO: 729018 - DNA, 695 bp, Homo sapiens; identical to SEQ ID NO: 725244

SEQ ID NO: 729019 - DNA, 460 bp, Homo sapiens
aaagtgagagagggaggcagaagaggaagtcagagcgatgtgctgtgaaatctactaccgtttgctggttttgaaaatggagaaaaagagtgaggaactgagaaacatggatggccttgggaacgtggaaaagggtcactgaaatgggacgacatgaactcaaggaggctatttatgaccatgtcatttgcaacatgaagaaagcttatctggagtgaaagtaaatgagaccaacagagatgagagacccggagaaatcctggttacactgcttgaatcctgtcagtcctatactggagtcctgttaatacaaaataattaagaaagaactctccaccacggggaatgtgaaaggtatatgagtcccttttcacgatgcgatgtcatgtcttttaaataagccatactttatgttcaataaaaagagaataagcaggaaaaaaaagtcgacgcggccgcg

SEQ ID NO: 729020 - DNA, 686 bp, Homo sapiens
gatgtaagtgagattctgaagaaggaagagaagaacagtgttaagtatcctggcaaaggagcattagggttacagatagaattgaagttgctcgtcagctgattgaagataaggagattggcctggattatccaggtaggctcaatgtaatcaggaagggcctttaaagtgagagagggaggcagaagaggaagtcagagcgatgtgctgtgaaatctactaccgtttgctggttttgaaaatggagaaaaagagtgaggaactgagaaacatggatggccttgggaacgtggaaaagggtcactgaaatgggacgacatgaactcaaggaggctatttatgaccatgtcatttgcaacatgaagaaagcttatctggagtgaaagtaaatgagaccaacagagatgagagacccggagaaatcctggttacactgcttgaatcctgtcagtcctatactggagtcctgttaatacaaaataatagtaataatccctctgtttcttatgtttatgccaacttcaacaaaaagaaacttgactaagagacaatataagaatttaatgtgtaattaagaaagaactctccaccacggggaatgtgaaaggtatatgagtcccttttcacgatgcgatgtcatgtcttttaaataagccatactttatgttcaataaaaagagaataag

SEQ ID NO: 729021 - DNA, 438 bp, Homo sapiens
  misc_feature (1)..(1): n is a, c, g, or t
  misc_feature (20)..(20): n is a, c, g, or t
  misc_feature (24)..(24): n is a, c, g, or t
ntactactactaaattcgcngccncgtcgacactaccgtttgctggttttgaaaatggagaaaaagagtgaggaactgagaaacatggatggccttgggaacgtggaaaagggtcactgaaatgggacgacatgaactcaaggaggctatttatgaccatgtcatttgcaacatgaagaaagcttatctggagtgaaagtaaatgagaccaacagagatgagagacccggagaaatcctggttacactgcttgaatcctgtcagtcctatactggagtcctgttaatacaaaataattaagaaagaactctccaccacggggaatgtgaaaggtatatgagtcccttttcacgatgcgatgtcatgtcttttaaataagccatactttatgttcaataaaaagagaataagcaggaaaaaaaagtcgacgcggccgcg

SEQ ID NO: 729022 - DNA, 499 bp, Homo sapiens
  misc_feature (1)..(1): n is a, c, g, or t
  misc_feature (20)..(20): n is a, c, g, or t
  misc_feature (24)..(24): n is a, c, g, or t
ntactactactaaattcgcngccncgtcgacactaccgtttgctggttttgaaaatggagaaaaagagtgaggaactgagaaacatggatggccttgggaacgtggaaaagggtcactgaaatgggacgacatgaactcaaggaggctatttatgaccatgtcatttgcaacatgaagaaagcttatctggagtgaaagtaaatgagaccaacagagatgagagacccggagaaatcctggttacactgcttgaatcctgtcagtcctatactggagtcctgttaatacaaaataatagtaataatccctctgtttcttatgtttatgccaacttcaacaaaaagaaacttgactaagagacaatataagaatttaatgtgtaattaagaaagaactctccaccacggggaatgtgaaaggtatatgagtcccttttcacgatgcgatgtcatgtcttttaaataagccatactttatgttcaataaaaagagaataag

SEQ ID NO: 729023 - DNA, 774 bp, Homo sapiens
aaagtgagagagggaggcagaagaggaagtcagagcgatgtgctgtgaaatctactaccgtttgctggttttgaaaatggagaaaaagagtgaggaactgagaaacatggatggccttgggaacgtggaaaagacacatactaacaaaaggccacatgaggacacagtgagaagctggaagtctacaacccagaagagagccctcaacagaacctaaccatgctggtaccctgatctcagacatccagcctccagaagagtgaaaaaatataattcttatttctaagcaacctggtctatggtatttcattatggcagcccaagctaagacagatccctatcctattcaccatgctgcagagccacatgagcctcccttttgttcctcaagctcatcaaatacctcctagccttagaacttgctattccctctaaccagaattctcttccaggtctttccatcctgtaagtcttgtcctttagatcgaaattcacatgtgacctcccctgagaatggtcctctggaaaactatctcaaaagaggtgttcccagttactctctaccttaccccaggttattatctttcccacccacttttgcatatgtgtatcattgcttggatatgtgtgatatggtagggttaggtcctaccaaatccgtgttactgtatcccgggggatacactcaggagagaccgtggcaggatgctagggggggtccccagcggctcggtagggaaccatcaaatcagttgcagggtccggggcaaaatc

SEQ ID NO: 729024 - DNA, 341 bp, Homo sapiens
cggtgggtgtttccttctccggggagagcaggggatcgtggtccccggtggtgggtgtttccttctctaaggtttgctgctgtttccaggcctttctgtggggcctgggtcctgtcctgggccaagccacggggtcatcctcagctgcactgggcgtgccaaccacaaacgagtcacttgctacaagcagcaccatgcagcctcctgtctggacgagaccctgccccccacagactggagacgcaccccgatttcccaggtcacagggggaagtgtggatctgataagggactaaatgtggcgtctttcatatgtttctcttacatattttattttaaaat

SEQ ID NO: 729025 - DNA, 1274 bp, Homo sapiens
ctggtgactttggaaaactcccttaaccagcgtgagcctccatgtcctcctccagagcaggggactgtaaggaccgattttattgtggggtgaaaaaagaaagcgcgaacgcaattccccaccaccacaaattacagtccagtttccccacatgtggaagtaacaggagtcagtcagcacatactgagtacaatggaaaaaccgcccccggaaaacaccaacttcatggccgtattttctcctgttacataagtatgaatgaacgcacctccgccctgccacagctccatacgcctcaccccttacacgcacggtcacttgccccgcgcattcccccaccccgcccccatgccgcctcaagtcctcctagccctgacacacagctgggactatcacgtccaaccggaagtcctggactagctcccacagcacgagaaatctttcctggcgaagcagcagcccctgagctgcctcctctgcataggaatcgccctatctgtgatgtcaccgacagcgcctttcccgtccccatctgctcttccgccccaccctctgccactcggccgaccaaccagctgcgggagcgggcggaggaagtgacacctgactctacctcctttccctcccatccccgtccctggtctctgccaaagaaatatgaccagaaggctttgggggactaaggttggctttatggaaccaataaagtaccatcttggaaaaactggctctagggttcccagacttacagtccttcaaactgaaactggatgacttgacataagcttcagaaaaattaccacaacagcttgtgtgtggcccatctttatggcattcaaactgcaaactaatccaatgcctcttctcacaccagctgaagatactacaagcccagcatctagaaatcttattgatcagctgccctctgggctcagaaactgtctttatagttcgttccaactattaatcttttttaattttatttttatagaaactaaacttcccacattaaaggcctgatagctcacactatccaggaaatatcctctgctaccaagtcccaacagatgattcaactggtccttaatgaataaaaggtgatcaaacaagaaaagagacttatattgtttgaaggaaagatgaatgtctcttctttccttaaacaagaagtagtactaacaaagattccttgcttggccaaactttagtcagatgtctatcttccttgcaaaatccaacttttttttttttatgtggtacaatgtgatgttttg

SEQ ID NO: 729026 - DNA, 444 bp, Homo sapiens
gcccatctttatggcattcaaactgcaaactaatccaatgcctcttctcacaccagctgaagatactacaagcccagcatctagaaatcttattgatcagctgccctctgggctcagaaactgtctttatagttcgttccaactattaatcttttttaattttatttttatagaaactaaacttcccacattaaaggcctgatagctcacactatccaggaaatatcctctgctaccaagtcccaacagatgattcaactggtccttaatgaataaaaggtgatcaaacaagaaaagagacttatattgtttgaaggaaagatgaatgtctcttctttccttaaacaagaagtagtactaacaaagattccttgcttggccaaactttagtcagatgtctatcttccttgcaaaatccaacttttttttttttatgtggtacaa

SEQ ID NO: 729027 - DNA, 329 bp, Homo sapiens
gaggttttattatctgcctgcaatctgcaatagatcctcaatttttctagtttactacaatatttagctacaacactccaaattaatatttcatttttttcctgctattctggcttggaatcactaaaattataaacttttcatttcttgaagtccttcaaactgaaactggatgacttgacataagcttcagaaaaattaccacaacagcttgtgtgtggcccatctttatggcattcaaactgcaaactaatccaatgcctcttctcacaccagctgaagatactacaagcccagcatctagaaatcttattgatcagctgccctct

SEQ ID NO: 729028 - DNA, 602 bp, Homo sapiens; identical to SEQ ID NO: 280221

SEQ ID NO: 729029 - DNA, 1345 bp, Homo sapiens
ataacacgaggagtgcacaggcaagtgcccagttgccagcaattgcttcaaaagcccatgttcttcttttcccccattcttaggcacagccaaaattggtcagaaaggggagtaaagtgggacacgagcttcaaagtagggaaaccaaagaagggagcatccacgtcctctctctccagcttctcccccgcgttcttcgggcgaatccgagggacgggcgctgcgctggggaaagtttgtcccacccgcgtttcgcagctggttgcaaggagaggaggaggagagggagggtcaagctcggagcctgtgaccgcacggatgatcgagccggcgtcgcgcttacctcgcagtcctcgtacttgatattatccgtcaatttccaaagcattttcatggatcggcgtgaacggatatgcccctctcggtctcgcacccaagtggagctactctctggctctttaccaacagcctaatcgcctcattagcatatcaacaatagtccaattgctcgccagtaccacaatctgccgccggccgctccgacacaggtataaaggcctctctacgccgcgaacttgcttctagagcgcactccagcctgcgaactgataaaaccttcctcgagctccgccgcgaggccctgccccaacaccccctctcttaccccaattccgccacattccccttcctttctttctccgcttccttttctccagagatgccttctgcaaagcccggcactgctcaaggtccaagcgccacgcctggggcccagcttctagcacttctcccttaaccctgctaccacgatccgagctgcccttttggccccgtgcaattttattagaaatcattatccctttcgcaattaaacataaccaccaaaccaagaccggcgaagtcactccaggattttttcccaacaagggatcgcctccgctcgaggcagccaccccctcgggccgcagcgccttgggagttttattggctttgagctttcccccaggttggagattctgccaagcggctccggtggctctgctggggtttgcaatcccttaattgcagcgtgtaaaataaaagttgtaccctgaagaggttacttgacagctccaggggttaaacaatttttctcctgtttgtgtgaagctagggccaactgacagttcaaattggtgttcaggctaaggtttcctgggtgcaacgtggacacgaatacagaactcctatggaactgcacacccgcttctgaagttgagcctaaaaacagacgtgtgtgtgcctgcaagtctagataccgtctcgtgcgtgcatcaaaataaatcaccgggaaccgaaatttagc

SEQ ID NO: 729030 - DNA, 1313 bp, Homo sapiens; identical to SEQ ID NO: 280223

SEQ ID NO: 729031 - DNA, 1094 bp, Homo sapiens
gcacagccaaaattggtcagaaaggggagtaaagtgggacacgagcttcaaagtagggaaaccaaagaagggagcatccacgtcctctctctccagcttctcccccgcgttcttcgggcgaatccgagggacgggcgctgcgctggggaaagtttgtcccacccgcgtttcgcagctggttgcaaggagaggaggaggagagggagggtcaagctcggagcctgtgaccgcacggatgatcgagccggcgtcgcgcttacctcgcagtcctcgtacttgatattatccgtcaatttccaaagcattttcatggatcggcgtgaacggatatgcccctctcggtctcgcacccaagtggagctactctctggctctttaccaacagcctaatcgcctcattagcatatcaacaatagtccaattgctcgccagtaccacaatctgccgccggccgctccgacacagagatgccttctgcaaagcccggcactgctcaaggtccaagcgccacgcctggggcccagcttctagcacttctcccttaaccctgctaccacgatccgagctgcccttttggccccgtgcaattttattagaaatcattatccctttcgcaattaaacataaccaccaaaccaagaccggcgaagtcactccaggattttttcccaacaagggatcgcctccgctcgaggcagccaccccctcgggccgcagcgccttgggagttttattggctttgagctttcccccaggttggagattctgccaagcggctccggtggctctgctggggtttgcaatcccttaattgcagcgtgtaaaataaaagttgtaccctgaagaggttacttgacagctccaggggttaaacaatttttctcctgtttgtgtgaagctagggccaactgacagttcaaattggtgttcaggctaaggtttcctgggtgcaacgtggacacgaatacagaactcctatggaactgcacacccgcttctgaagttgagcctaaaaacagacgtgtgtgtgcctgcaagtctagataccgtctcgtgcgtgcatcaaaataaatcaccgggaaccgaaatttagc

SEQ ID NO: 729032 - DNA, 695 bp, Homo sapiens
gtttttatttcacatttgactttttgttacctttgtgtcttcagagtacagtgtacgttaagacatatatcgattttcttctcagtagttgaccaattgcctcaatactcttttctttccaacaacagttctttattaagatggaaactaccctggttagtcctatggtgaaatattctgcatacaaaggatactaatggaatgatgagtaacatatttaccaagttgtcaggccccaagagcaagggaagggtgaagtcagtgtggtgtacatgaggcagatccctacctgggaaggtgaagaggggattgggcagggaggtgagtacagcaggcgctcacaaagcggtcagctgtgggatgggaatggtcaactctgaagctacgggacttggagagagcctcagctgttggatgaaagagcgaaaacagatgcagtagttttcaaaccaagttccatggaggcattttaggggctttcctgggaaagcatgaagagctggaagaggtttatagccctctcctctctttccaccagaaatataaatgctttttctttctgtttcaacatgagattttatttgaaaaaatgatttcagtgtttttgtaataacttatttattgtagacatttttaagtacatgaaaatagcaagaataatataataaattctcattcttcaccaatgataattt

SEQ ID NO: 729033 - DNA, 2899 bp, Homo sapiens; identical to SEQ ID NO: 364887

SEQ ID NO: 729034 - DNA, 3874 bp, Homo sapiens; identical to SEQ ID NO: 364886
  misc_feature (3006)..(3006): n is a, c, g, or t

SEQ ID NO: 729035 - DNA, 1914 bp, Homo sapiens
gaagggtgatgagacctcagtgagaggaaaggagaggaagagctggagggggtgaggaagtaaggggagggaggcagagggttctgcttggtctccaggctaggaggcggtgcctggaggatacaggaacggggatcctctgatcaaggctggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccaggcaatgagaccatctgcccaccaaatatctacatcgagtgtgcagaccacacactggactccctgggtgggggccctgagggcccgtgcttctgccccaccccctgcaacctgacacgctatgggaaagagatctccatggtcaggatccccaacaggggctcagcccggtacctggcgaggaagtacaaccgcaacgagacctacatacgggagaacttcctggtcctagatgtcttctttgaggccctgacctctgaagccatggagcagcgagcagcctatggcctgtcagccctgctgggagacctcgggggacagatgggcctgttcattggggccagcatcctcacgttgctggagatcctcgactacatctatgaggtgtcctgggatcgactgaagcgggtatggaggcgtcccaagacccccctgcggacctccactgggggcatctccactttggggcttcaggagctgaaggaacagagtccctgcccgagcctgggccgagcggagggtgggggggtcagcagtctgctccccaatcaccaccacccccacggtcccccaggaggtctctttgaagattttgcttgctaggacggtgctgtgactgaaaggacccaggagtctgggacccctcctgggatccccagcacattctcctgctcctgggagaggcctgggggcggtgctcactgggagggccaggactcagttcctgctctcatcctcccctgccctgatgtcagctgctttgcacaaaggtccttcttgtccacaccccttatccccaggctggtgccccgggagggctggagaccaggccatgggccctcacggagaggaagggaaggaaggagagggagggggaggatagagcccatcccagccggggagggggagccctctgtacatttgtaaatatttagggaaagccgggtggggggaggggatacagatgtagaaggtgggtagggctacaggggtgggtgatttagggacagccagggtcccagccccaatgtcagcaggatagggagagccccaggactcaggagtgctgggctggtcctacttcctgcccctctccaggcccagctcccctcttggcagggggagaggatggcccagcaggcctggcccagctcccagttccccctgcaccagccccacccctagagtcccttctatagggagggggcaggagaccttccagacttcggctgagcttggagggtgggaagggagccttctcagtcctctctccctccagtctgattttataaagtgctgacgagattgggaataaagaggcataaag

SEQ ID NO: 729036 - DNA, 1496 bp, Homo sapiens
gaagggtgatgagacctcagtgagaggaaaggagaggaagagctggagggggtgaggaagtaaggggagggaggcagagggttctgcttggtctccaggctaggaggcggtgcctggaggatacaggaacggggatcctctgatcaaggctggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccaggcaatgagaccatctgcccaccaaatatctacatcgagtgtgcagaccacacactgggtccgtgctgcctaccctttcctacctctccatcagcctcttcatgtctctgtccactcttctcctcactgtcttggatcctcccctcccaatctcttcctggagggttcttcctgggggttgagccttagcccatacttcagtggggtcggggagaggtctgcggacctctgcaggtacagacacttgggtaagtggaggcagcagggtggggggttgcagagaagccaggactgggagtgaaggtctgggcttctcatcttggttcagccaatgagctcacccactttgagaaagtgaaatgacttctctcttggtctcaggaaaaatgcattgctggctatcggtgtgggtaaggcaaaccccatctgtccacagatcttgcctgatctgcagttcatccatctatccatccattcatcgattcgcgcattctccagacctttacagcctgtgctgggtactggaggtgagagtgggggcgacagccctgcccttggagagcttacaccccggcagggctgtggacagccattcccacacagcccgtcaactcctggagaggggagcctcgggtgtgctgcaaggccccaaggaggggtgtgcagccctagcctgggaaggtagggaggattcctagaggaagggacacattagctgaggcttgatgggtgtataagagtcaggtgcaaagggggacatacactgaagacctgtggccagaaagagcatgctgtgtccggggcactgaaaggtctgtgtggctgcagggcagagaacaggggagggagtagaaagagtagaggagggaggccaggcacggtggctcacaagtgtagacccagcacttt

SEQ ID NO: 729037 - DNA, 586 bp, Homo sapiens
gactggcagattattgcaaaaagggcacggggcagagggactatgttgtgagcctgcgaaagaagtttgtgtggggactgtgggcagtgaatgcgttgggaacaatatggaaaactgggagctgccttggaatctacagggccgggctgaagaaaagaagaatggtattcatgcagttcccattttacagatgaaaacaagaggactttttctgtgaagtcaagaaagtggttacaatggtactttcagcctgtccgaattatgtattgcccctcccctttttattaataacattgaagtgtgatgggacaaccactgaagccgtctgttgaaacctgctgggactttttagccattctcttcaacataaagaatgggtgtttttggagggggtgagaggaatggggaaatgttgtcaaagagtacaatgttttagttgagacaggaggaatatattttgttgagatctacagcacagcatggtgactgtagttaacaatgaagtattgtgtatttcaaaattgctaagacaataaatttcaaatgttctcaccacaaaaaagataggttttgaggtgatgaatct

SEQ ID NO: 729038 - DNA, 643 bp, Homo sapiens
gactggcagattattgcaaaaagggcacggggcagagggactatgttgtgagcctgcgaaagaagtttgtgtggggactgtgggcagtgaatgcgttgggaacaatatggaaaactgggagctgccttggaatctacagggccgggacccactcgagccatccacactttccccagcctcctccaaaacagcacactttccggctgaagaaaagaagaatggtattcatgcagttcccattttacagatgaaaacaagaggactttttctgtgaagtcaagaaagtggttacaatggtactttcagcctgtccgaattatgtattgcccctcccctttttattaataacattgaagtgtgatgggacaaccactgaagccgtctgttgaaacctgctgggactttttagccattctcttcaacataaagaatgggtgtttttggagggggtgagaggaatggggaaatgttgtcaaagagtacaatgttttagttgagacaggaggaatatattttgttgagatctacagcacagcatggtgactgtagttaacaatgaagtattgtgtatttcaaaattgctaagacaataaatttcaaatgttctcaccacaaaaaagataggttttgaggtgatgaatct

SEQ ID NO: 729039 - DNA, 1628 bp, Homo sapiens; identical to SEQ ID NO: 336258

SEQ ID NO: 729040 - DNA, 341 bp, Homo sapiens
ttatcttttcatctctctaatcattgagaaaaagagtacaaaaagccagattttgcagttccctattttgtattccaggttgaagagtgctctggctgtagagggtccccacgatctgtcatctagtaactcaccagatacataagatattttgcctgctatgaagccattggagaatcaggtccagctgtgtcctacagatttataccctcactttggatgcactgtgaatcttgaaacaagtatgtaaatagaatccagcccctctctgccacagcctcagagcaggattggtaactccaaaagacaccaggacacatcctaattttcttaaattttat

SEQ ID NO: 729041 - DNA, 489 bp, Homo sapiens; identical to SEQ ID NO: 136342
  misc_feature (6)..(6): n is a, c, g, or t

SEQ ID NO: 729042 - DNA, 251 bp, Homo sapiens
ccttgaagggatctagcatatctccaatatacccagaggataacaatctccaaatgtgattatgaaacctgtttctggtaatggagctcagaggactaggtggaacgaacagagccctcagaaataatgccacatatctacaactatctgatctttgacaaacctgacaaaaacaagaaatagggaaaggattccctatttaataaatggtgctgagaaaactggctagccatatatagaaagctgaaact

SEQ ID NO: 729043 - DNA, 479 bp, Homo sapiens
ccttgaagggatctagcatatctccaatatacccagaggataacaatctccaaatgtgattatgaaacctgtttctggtaatggagctcagaggactaggtggaacgaactacaaaaccctgtcagagtggtgtgaggatagagaaaaacagaaattttccactcaaaatgagcaaacttaattctaaaacagaagaaaaaagtctaatgctaagaaagtcagccaacaaaattaacagttagagcagggattctttccaaatgaaaatctttttacagagcaattaagacaaagacatttaaataagtacgctaaaaacattcaaagagataaatgaagatacagcttttaaaagaatgataaaacaatgccaggaagaaatgaaacaaatctaatagattataaaaaagaataaattagactggtcattgacatttttaaaaaaccaataaataagaaaaactgtagactggataca

SEQ ID NO: 729044 - DNA, 1013 bp, Homo sapiens
  misc_feature (6)..(6): n is a, c, g, or t
  misc_feature (162)..(162): n is a, c, g, or t
  misc_feature (173)..(173): n is a, c, g, or t
  misc_feature (224)..(224): n is a, c, g, or t
  misc_feature (319)..(319): n is a, c, g, or t
  misc_feature (328)..(328): n is a, c, g, or t
  misc_feature (330)..(331): n is a, c, g, or t
  misc_feature (338)..(338): n is a, c, g, or t
  misc_feature (348)..(348): n is a, c, g, or t
  misc_feature (358)..(358): n is a, c, g, or t
  misc_feature (360)..(361): n is a, c, g, or t
  misc_feature (364)..(364): n is a, c, g, or t
  misc_feature (368)..(369): n is a, c, g, or t
  misc_feature (372)..(374): n is a, c, g, or t
  misc_feature (376)..(378): n is a, c, g, or t
  misc_feature (381)..(381): n is a, c, g, or t
  misc_feature (384)..(384): n is a, c, g, or t
  misc_feature (389)..(389): n is a, c, g, or t
  misc_feature (396)..(397): n is a, c, g, or t
  misc_feature (404)..(404): n is a, c, g, or t
  misc_feature (411)..(411): n is a, c, g, or t
  misc_feature (415)..(416): n is a, c, g, or t
  misc_feature (421)..(421): n is a, c, g, or t
  misc_feature (428)..(428): n is a, c, g, or t
  misc_feature (440)..(440): n is a, c, g, or t
  misc_feature (456)..(456): n is a, c, g, or t
  misc_feature (459)..(459): n is a, c, g, or t
  misc_feature (466)..(466): n is a, c, g, or t
  misc_feature (469)..(470): n is a, c, g, or t
  misc_feature (479)..(479): n is a, c, g, or t
  misc_feature (484)..(485): n is a, c, g, or t
  misc_feature (487)..(487): n is a, c, g, or t
  misc_feature (495)..(495): n is a, c, g, or t
  misc_feature (498)..(498): n is a, c, g, or t
  misc_feature (503)..(503): n is a, c, g, or t
  misc_feature (505)..(505): n is a, c, g, or t
  misc_feature (540)..(540): n is a, c, g, or t
  misc_feature (596)..(596): n is a, c, g, or t
  misc_feature (603)..(603): n is a, c, g, or t
  misc_feature (672)..(672): n is a, c, g, or t
  misc_feature (865)..(865): n is a, c, g, or t
  misc_feature (874)..(874): n is a, c, g, or t
  misc_feature (879)..(879): n is a, c, g, or t
  misc_feature (883)..(883): n is a, c, g, or t
tagacnccaacgtgggcagcacagagatgggccacctccccaggccgtggctcccacacaccccaattagctgaattcgcgtgtggcagagggaggaaaaggaggcaaacgtgggctgggcaatggcctcacataggaaacagggtcttcctggagatttgntgatggagatntcaagcaggtggcctctggacgtcaccgttgccctgcatggtggccccagngcagcctctatgaacaacctcgtttccaaaccacagcccacagccggagagtccaggaaaacttgcgcactcagagcagaagggtaggagtcctntagacaacntnnagccgcnccagtcgccnatagacactngnngtnaccnngcnnncnnncancancagtncacagtnnccagcantaacccncccnnagaanataaccngctcattcactncctcccagaagacgcntgntagcaantannacaggcgtncaccnncncccaaatnacncaccnanacacacgggctgagcagaccgccccgtggatgganacaaagagctcttctgaccatatccttcttaacacccgctggcatctcctttcgcncctcccntcctaacctactgacccaccttttgattttagcgcacctgtgattgataggccttccaaagagtcccangctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagangcactctgngtcgntganctgaggtcggctctgcgatccatacgtggccgcaccccctcagcacgtgctgtgtcgcatgggtcaccgaacagtgtactctgttcctgacatatcggtataaaacaataaacttttaatggtaaaaaaa

SEQ ID NO: 729045 - DNA, 459 bp, Homo sapiens
  misc_feature (39)..(39): n is a, c, g, or t
  misc_feature (61)..(61): n is a, c, g, or t
gcttcagagaaccagcctctttcacgccatgcccgcccncgcctcccttcttccctcttcnctttccctgcccagccctcccttccttcctttgccggcaaggcagggacccacagtggttgcctgcctccgggagggaaggagagggagggtgggtgggtgggagggggccttcctcccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccaccctcaccccgcccctggtcccactcctgcccccgccctacctccgccccaccccatcatctgtggacactggagtctggaataaatgctgtttgtcacatcaacacca

SEQ ID NO: 729046 - DNA, 354 bp, Homo sapiens
ggcggcgcgggtgagaggcgacctgcacccgcctgattgcctccccgcagctgctgctggctgaggccgagcgtgccgtggtgctccagtacctgagcgcgctgatgcaaggccgcctggtgtgccgcggagccgacgagaggacccaggcggccgagcgcctgcggcacgatgctgcccagcttcagcagcttttcctcagtttggtgagagcttcttgggcgggcagacgggcgagagtctcagtggctgggtgggagagaggtggctcgcgccggcctcctgcctgccctcggggtcctgcgcccgagccctgctgctcgcagaataaaccacggctgccggaaaaaagag

SEQ ID NO: 729047 - DNA, 339 bp, Homo sapiens
ctgcgcgccggtgctgctcgccctgagggagctgctaaacctccgcgaccccgcgctgctgggcctggaggtggctggcctgcggcaacaatttcccgacgtgagcgaggaccacgtctccgccctcttgggcctgcgcggggacttgtcccgggagcagcacctggccgcgctcagctccctgcaggctgcgctgccgccgtcgccccgcgcgagccgccgcgtcctcttcagcctagtgcccgcgcccgcgctcgcgccggcctcctgcctgccctcggggtcctgcgcccgagccctgctgctcgcagaataaaccacggctgccggaaaaaagag

SEQ ID NO: 729048 - DNA, 2710 bp, Homo sapiens
  misc_feature (1012)..(1012): n is a, c, g, or t
  misc_feature (1014)..(1014): n is a, c, g, or t
agggaatacaaggaaaaggtgacagaaaagcaagagagggatccgaggagtgccgaccagagaggcagttcatgtagcctcattagtaaagcccccaggggctgtgactgtcctgcgcgggcttccaagtccacctgagagttctgatgctgtgctgaccccatggcacatcaggggcagcgagcctgctgtccacactggctgggagaagcagcagccaggcaagagaacaacaaacaggggcaggcagccacccaccaagaggacatgtggaaccaggcagcacgccatttggaaagcaagtctatatgggagtggtcactatcatggaaaggaaaaagaatgggaaaacctgagatttaagaaagacccaatgctgttctagaagcatcttcagaaagagcaataaagcttctttggggaagtcacaggacacagactctccagggtggaagggatcttgaagagcacagaggccaagtcctcatccatctctcgacttccttcatgactcatctgaagacggctggattggtctatgtctgtaccctaccctcaccccacaatcccagtccaccctatctcagaacaatttcaaatgcaggggaggatcagagatgaagatgttactccaaaagtatacatgcaaagatgttctggaagtgctacttcttaacttgtctggtcttatagtctgtggttgaaagagtcctccatggagaagtctactgccgaagtccactgattttcactgccgtatgatattccatcgtgtggcacgtggaacaatcaggatcatatttcaacatgagatccccacgttgatgtctcagtcttgggtagacatggtagggctggtaggaagtggtctaatgacttccattcctctgttggaacatttgggttgcttttgggtgttttgttattaaaaacactgctgctgctatcattcttttttgtacagtttctttggattccaatccataaaagcctagcatggaattgttagccnanctaggaagtgaggagcgtctctgcccggcagcccatcgtctgagatgtggggagcacctctgccccgccgccctgtctgggatgtgaggagcgcctctgctgggcgcaaccctgtctgggaggtgaggagcgtctctgcccggccgccccatctgagaagtgaggaaaccctctgcctggcaaccgccccgtctgagaagtgaggagcccctccgtccggcagccaccccgtctgggaagtgaggagcgtctccgcccggcagccgccccgtccgggagggaggtgggggggtcagccccccgcctggccagccgccccatccaggaggtgaggggtgcctctgcccggccgcccctactgggaagtgaggacccctctgcccggccagccgccccgtccgggagggaggtgggggggtcagccccccgcccggccagccgccccatccgggagaaggaagtgttcctctgctaaatacccctgaaaccaaaaatgaaccagccaaccaacccaccaaacaatgcaccagccaactgacccatcaaacaatggacgagccaaccaacccaccaaacaatgcaccagccaactgacccatcaaacaatggaccagccaaccaacccaccaaacaatgcaccagccaactgacccatcaaacaatggaccagccaaccaacccactgaacaatggaccggccaactgacccatcaaacaatggaccagccaaccaacccaccaaacaatggaccaaccaaccaacccaccaaacaatggaccagccaactgacccatcaaacaatggaccaaacaaccgacccaccaaacaatggaccaaccaaccaacccaccaaacaatggaccagccaactgacccatcaaacaatggaccagccaaccaacccactgaacaatggaccagccaaccgacccacagaacaactgaccagccaaccagccccccaaacaatggaccagccaaccaacctactgaacaatagaccagccattcaacctaccaaacaatggaccagccaatcaacccaccgaacaacgaaccagtcaaccaacctactgaacaatggaccagccaagcaatccaccaagcaatggaccaaccaaccaacccaccaagcaatggaccaaccaacctacccaccaaacaacggaccagccaactgacccatcaaacaatgcaccagccaactgacccatcaaacaatgcaccagccaactgacccatgaaacaatggaccagccaaccaacccactgaacaatgaaccagccaaccaacccaccaaacaatggaccagccaaccgacccaccaaacaatggaccagccaaccaacccactgaacaatggaccagccaaccgacccacagaacaactgaccagccaaccagccccccaaacaatggaccagccaaccaacctactgaacaatagaccagccattcaacccaccaaacaatggaccagccaatcaacccactgaacaacgaaccaggcaaccaacccactgaacaatggaccatccaatcaacctactgaacaatggaccagccaagcaatccaccaagcaatggaccaaccaaccaaccaacccaccaaacaatggaccaaccaaccaacccaccaaacaatggaccagccaaccaacccacctaaaaatggaccagccaaccaacctacc

SEQ ID NO: 729049 - DNA, 810 bp, Homo sapiens; identical to SEQ ID NO: 728317

SEQ ID NO: 729050 - DNA, 549 bp, Homo sapiens
accaagaatcaatactacaactgcaggagctccttcatcttaaattcggtgtagccacagaaatacttctcaaagtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggcaagaatgaatctttccaaatttaatgtggcgtgcatttaaaatgttagcaattattaaatgttatataatttaatattatatacactgta

SEQ ID NO: 729051 - DNA, 1784 bp, Homo sapiens
accaagaatcaatactacaactgcaggagctccttcatcttaaattcggtgtagccacagaaatacttctcaaacaagctagtactttggcagatctggacagtggaaatatggaaaaagtcattaaagatgaaaatgttactctgtatgtgtgggcaaacctcaagaagaatccaaggcacagaagtgttagattctctgaaacacaaattggatttgagattccaaggatattagcaacaagtgacattgctgtacgactcctgcatacccactatgatcatgtttctgcactgcaccctgtttcaacaccatcaaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtccacttgaggttcatgagaatgtaatcttttttgaggatcctgtggttgtaaggtgggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaaggtgagggaacaccttactgaagaatgtactgagaatcctaattgggcccttttaatgtttagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgc

SEQ ID NO: 729052 - DNA, 471 bp, Homo sapiens; identical to SEQ ID NO: 288418

SEQ ID NO: 729053 - DNA, 974 bp, Homo sapiens
accaagaatcaatactacaactgcaggagctccttcatcttaaattcggtgtagccacagaaatacttctcaaagtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaaggtgagggaacaccttactgaagaatgtactgagaatcctaattgggcccttttaatgtttagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgc

SEQ ID NO: 729054 - DNA, 537 bp, Homo sapiens; identical to SEQ ID NO: 288423

SEQ ID NO: 729055 - DNA, 1909 bp, Homo sapiens; identical to SEQ ID NO: 161289

SEQ ID NO: 729056 - DNA, 1864 bp, Homo sapiens
gacagcctccaccagagtcgcccacctttctggaagctgcagggctctccatccaggatccagaagcattgaaggggaccagccgctgaagggattctcagtcccatctgactccccatgaggctcctggctttcctgagtctgctggccttggtgctgcaggagacagggacagcttctctcccaaggaaggagaggaagaggagagaggagcagatgcccagggaaggcgattcctttgaagttctgcctctgcggaatgatgtcctgaacccagacaactatggtgaagtcattgacctgagcaactatgaggagctcacagattatggggaccaactccccgaggttaaggtgactagcctcgctcctgcaaccagcatcagtcccgccaagagcactacggctccagggacaccctcgtcaaaccccacgatgaccagacctactacagcagggctgctactgagttcccagcccaaccatggtctgcccacctgcctggtctgcgtgtgcctcggttcctctgtgtattgcgatgacattgacctagaggacattcctcctcttcctcggaggactgcctacctgtatgcacgcttcaaccgcatcagccgtatcagggccgaagacttcaaagggctgacaaagttgaagaggattgacctctccaacaacctcatttcctccatcgataatgatgccttccgcctgctacatgccctccaggacctcatcctcccagagaaccagttggaagctctgcccgtgctgcccagtggcattgagttcctggatgtccgcctaaatcggctccagagctcggggatacagcctgcagccttcagggcaatggagaagctgcagttcctttacctgtcagacaacctgctggattctatcccggggcctttgcccctgagcctgcgctctgtacacctgcagaataacctgatagagaccatgcagagagacgtcttctgtgaccccgaggagcacaaacacacccgcaggcagctggaagacatccgcctggatggcaaccccatcaacctcagcctcttccccagcgcctacttctgcctgcctcggctccccatcggccgcttcacgtagctcggagcccttccactcctcccaggtcatctcttggaccagcgggcatcacattctccagcagccgccatctcacacgcctccctcctgtggccgccggcagcatggacaaaggtctccatgcagggggaggaggcctgcttctttccccacagctctcacgtctcccttctccctgcgggtgacaaagaagcccaaggaccacctccttcctgcctcattgtaataaaattccccacactgaggccttcttgtcttcaacctggcctgtccagcccttccagatatggccaaacccatggcctggatgggcttgtgtacttcctttcaaatgagcccacacagaacgccctgctctccccttcctcccctctgcactccttctgcctcctttttctctattctccttctgtgctcaggcaccacagcaaatagctttttgtttcctcctggcactaccagtcccagccctgccttcaggaattcttttctctctctctctctttttttaaaagactgggtctcactaggttacctaggctggttttgaactcttgggctcaaatgttcacctgccttagcctcctgagttcctgggattacagatgtgtgccactgtaccgactccagaattattttcttttgtgtctaacacacagttcagacacaggagggagtggaagtgtttcttgttatggcatctgtagaggaactgtgatgcaagggagtgagcactggaatgagaatc

SEQ ID NO: 729057 - DNA, 1421 bp, Homo sapiens
gacagcctccaccagagtcgcccacctttctggaagctgcagggctctccatccaggatccagaagcattgaaggggaccagccgctgaagggattctcagtcccatctgactccccatgaggctcctggctttcctgagtctgctggccttggtgctgcaggagacagggacagcttctctcccaaggaaggagaggaagaggagagaggagcagatgcccagggaaggcgattcctttgaagttctgcctctgcggaatgatgtcctgaacccagacaactatggtgaagtcattgacctgagcaactatgaggagctcacagattatggggaccaactccccgaggttaaggtgactagcctcgctcctgcaaccagcatcagtcccgccaagagcactacggctccagggacaccctcgtcaaaccccacgatgaccagacctactacagcagggctgctactgagttcccagcccaaccatggtctgcccacctgcctggtctgcgtgtgcctcggttcctctgtgtattgcgatgacattgacctagaggacattcctcctcttcctcggaggactgcctacctgtatgcacgcttcaaccgcatcagccgtatcagggccgaagacttcaaagggctgacaaagttgaagaggattgacctctccaacaacctcatttcctccatcgataatgatgccttccgcctgctacatgccctccaggacctcatcctcccagagaaccagttggaagctctgcccgtgctgcccagtggcattgagttcctggatgtccgcctaaatcggctccagagctcggggatacagcctgcagccttcagggcaatggagaagctgcagttcctttacctgtcagacaacctgctggattctatcccggggcctttgcccctgagcctgcgctctgtacacctgcagaataacctgatagagaccatgcagagagacgtcttctgtgaccccgaggagcacaaacacacccgcaggcagctggaagacatccgcctggatggcaaccccatcaacctcagcctcttccccagcgcctacttctgcctgcctcggctccccatcggccgcttcacgtagctcggagcccttccactcctcccaggtcatctcttggaccagcgggcatcacattctccagcagccgccatctcacacgcctccctcctgtggccgccggcagcatggacaaaggtctccatgcagggggaggaggcctgcttctttccccacagctctcacgtctcccttctccctgcgggtgacaaagaagcccaaggaccacctccttcctgcctcattgtactgcgggtgacaaagaagcccaaggaccacctccttcctgcctcattgtaataaaattccccacactgaaaaaaaaagaa

SEQ ID NO: 729058 - DNA, 460 bp, Homo sapiens
  misc_feature (31)..(31): n is a, c, g, or t
gtaagaagtggggcagcgaggagcggaaganagcatgcccttcaaaaagggtgccgcctttgagctggtcttcatagtcctggctgagcactacaaggtggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctggtcccggacattgccatcaacagctgaacagcctgcccaccatggaaggacccccaaccttcaacccgcctgtgccatatttcgggaggctgcaaggaggggctcacagctcgaagaaccatcatcatcaagggctatgtgcctcccacaggcaagagctttgctaatcaacttcaaaggtgggctcctcaggggacata

SEQ ID NO: 729059 - DNA, 475 bp, Homo sapiens; identical to SEQ ID NO: 626530

SEQ ID NO: 729060 - DNA, 171 bp, Homo sapiens
cccgggcacatcgtggagcgtgacgagtagtacggtggctgtaacttggtaatcctttttataactgttggctgtgtgttcttgtactgctggagacccacctgcaagtggatggggatctgcaacttcaatcaatcaacttcatcggaggccagcccctccggccccagg

SEQ ID NO: 729061 - DNA, 283 bp, Homo sapiens
ctgccacgcacgactgaacacagacagcagccgcctcgccatgaagctgctgatggtcctcatgctggcggccctcctcctgcactgctatgcagattctggctgcaaactcctggaggacatggttgaaaagaccatcaattccgacatatctatacctgaatacaaagagcttcttcaagagttcatagacagtgatgccgctgcagaggctatggggaaattcaagcagtgtttcctcaaccagtcacatagaactctgaaaaactttggactgatgatg

SEQ ID NO: 729062 - DNA, 1097 bp, Homo sapiens
accgtccgggcacgagccccgcccgagctcaccgcccctgctcccctctccgaccctttgagccgtggccgttgccagatgtccacaatgggaaacgaggccagttacccggcggagatgtgctcccactttgacaatgatgaaattaaaaggctgggcaggaggtttaagaagttggacttggacaaatcagggtctctgagcgtggaggagttcatgtccctgccggagctgcgccacaacccgttggtgcggcgagtgatcgacgtcttcgacaccgacggtgatggagaagtggacttcaaggaattcatcctggggacctcccagttcagcgtcaagggcgacgaggagcagaagttgaggtttgcgttcagcatttacgacatggataaagatggctacatttccaacggggagctcttccaggtgctgaagatgatggtgggcaacaacctgacggactggcagctccagcagctggtcgacaaaaccatcatcatcctggacaaggatggcgatgggaagatatcctttgaggaattcagtgctgtggtcagagacctggagatccacaagaagctggtcctcatcgtatgagcctttttcttacaagcaccacccaacaacttctgctttcttccctatctctttcaagatttgctcaagacgtccaactgtctctctgacttatctggaagtatttctttttgtgaagccatatgtcctaacaggagcttcatcaccaactcagtgctattaattctccttctctgaatgactcagggtaccctatagggggaagagcaagtcaaatgagcatagtggggaaagaaaaggaaatggcttttataaacatcttttactttgttttgattcaaagaccaaactagaactttaaaagttcaaaaataagaaagtatacatttttgctgttatttctcatcattttgtatatgggaggaaatttataatttgcatgggtgttaggtgaactgttttcatttgcttgtgttcagatatcttgccagattgttaacttcctattgtagcaacagggacaaatatatttgtctttgctgggcaaaaagtaatca

SEQ ID NO: 729063 - DNA, 345 bp, Homo sapiens; identical to SEQ ID NO: 337939

SEQ ID NO: 729064 - DNA, 517 bp, Homo sapiens
aggttgaccacctgtttcatgcagcttagggtcagaagaatctgtagctctgtcaagaagacgcagggctacagataggaaacaggagggaataatccagccagaaattatcttgcccaaccacagagggcatcatctacattctgctgggatccataccagaggaggacagaaacagaaaataggatcgggactggaaactagagctgtggttgtcttctggatggatcagaatgctctagatcaatggaacgtggcagctccaattccagtcatcgtaacgcgtgtcctccaagccctcggaactgtggctgtggctctgggggctctaggagctgcctactacatcactgaatccttgtgaacaagcccctaggcccacagtctggcagacctccaccagccccaggagttgataggtgatggcgctgggagaagatgttcagaatatctcaaaagccaagtccagaagatccagtttccatcaaagggacctctcttgtcaccaaaatttaaa

SEQ ID NO: 729065 - DNA, 1336 bp, Homo sapiens
ggtccagctggaggcccaagccaggctcctagggcagagggcaaacggcccctccaggagggagccgggagattacgcagctccatgtaggtccacgtttaggttgggaggatctaccatgaagaaggtcaagaagaaaagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcaggaggtgcttttaatgtgctgataaaccaacctcaggaaggtattatgtacagaagattcccaaggctgctgttgctgaaagagacttgggctactgccagggaactagaaacgtgctgagaagaggactgcaatgactgctttcaaaaaacaccagaataaatacatacgtagtgtaagcaagcgaccactgttgtatcaaaagccctttgttgtatctgttggtggcggaggcagccagcggttaactgaggttctactgagctctgtggaccacagagttgtcttctcaagtttgcttctagggacaaattactacaggtggaatctccacactggctctgtgacccaaaaagtaagggctattatgacagagggagcaaagggaagcccttggaccctccccagtcccttcaacaaaatagcaaatctagaggaacactgcgtccctgctgggaacacagatgttgatatcactgtgaatgagtcaaaaggggtgggtgtgtgtgtgtgtgtgtgtgcgcacgcgcgcatgtggaggcagtgggtgattcccctcacagctctacgtaagtctcccgtcttctggccagtgcagaatggtggctcctggaggggtggacagcagcacattgtctgcatcttgctcgtgggctctgtgctgggtggaccttagccacctcaccatcctgcaggacatcgtgctggtccactgcactgaccgtatcaggcctaggacttgaagccatcctgttaccagtagcttggatttccttctaaaggcaatctattatttgacctattttaaatattttatttaataatttatgtcctatctcaatataaaacaatttaaggaagatgttgggttatacaattt

SEQ ID NO: 729066 - DNA, 582 bp, Homo sapiens
ggtccagctggaggcccaagccaggctcctagggcagagggcaaacggcccctccaggagggagccgggagattacgcagctccatgtaggtccacgtttaggttgggaggatctaccatgaagaaggtcaagaagaaaagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagacctccaccagccccaggagttgataggtgatggcgctgggagaagatgttcagaatatctcaaaagccaagtccagaagatccagtttccatcaaagggacctctcttgtcaccaaaatttaaa

SEQ ID NO: 729067 - DNA, 479 bp, Homo sapiens
ctagccctgaatccacaccacagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagacctccaccagccccaggagttgataggtgatggcgctgggagaagatgttcagaatatctcaaaagccaagtccagaagatccagtttccatcaaagggacctctcttgtcaccaaaatttaaa

SEQ ID NO: 729068 - DNA, 833 bp, Homo sapiens
ggtccagctggaggcccaagccaggctcctagggcagagggcaaacggcccctccaggagggagccgggagattacgcagctccatgtaggtccacgtttaggttgggaggatctaccatgaagaaggtcaagaagaaaaggtcagaggccagacgccaccgagactccacctcccagcatgctagctccaattccacctctcagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagacctccaccagccccaggagttgataggtgatggcgctgggagaagatgttcagaatatctcaaaagccaagtccagaagatccagtttccatcaaagggacctctcttgtcaccaaaatttaaa

SEQ ID NO: 729069 - DNA, 857 bp, Homo sapiens
ggtccagctggaggcccaagccaggctcctagggcagagggcaaacggcccctccaggagggagccgggagattacgcagctccatgtaggtccacgtttaggttgggaggatctaccatgaagaaggtcaagaagaaaaggtcagaggccagacgccaccgagactccacctcccagcatgctagctccaattccacctctcagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcaggaggtgcttttaatgtgctgataaaccaacctcaggaaggtattatgtacagaagattcccaaggctgctgttgctgaaagagacttgggctactgccagggaactagaaacgtgctgagaagaggactgcaatgactgctttcaaaaa

SEQ ID NO: 729070 - DNA, 399 bp, Homo sapiens
ctagccctgaatccacaccacagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagatccagtttccatcaaagggacctctcttgtcaccaaaatttaaa

SEQ ID NO: 729071 - DNA, 952 bp, Homo sapiens
ggtccagctggaggcccaagccaggctcctagggcagagggcaaacggcccctccaggagggagccgggagattacgcagctccatgtaggtccacgtttaggttgggaggatctaccatgaagaaggtcaagaagaaaagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagaccccctcaatatcctcctcagatttgccctgcacttcttgttccatgcttggggtcctaagaacaagccatctgatgcctctactatcattacctctattgggacccagaaaccaataccccaaaatatggtgcatggacatgctgaactgaagaagatgcctcaagggtcatccctaaaggcaaaaacagaacttccaaagtatctttctgtgacaacattaggttcaggcttgaagtccctgatttcgccatcaaagtcagatccaggggggacgatgctattcagaaacgtgctgagaagaggactgcaatgactgctttcaaaaaacaccagaataaatacatacgtagtgtaagcaagcgaccactgttgtatcaaaagccctttgttgtatctgttggtggcggaggcagccagcggttaactgaggttctactgagctctgtggaccacagagttgtcttctcaagtttgcttctagggacaaatta

SEQ ID NO: 729072 - DNA, 1203 bp, Homo sapiens
ggtccagctggaggcccaagccaggctcctagggcagagggcaaacggcccctccaggagggagccgggagattacgcagctccatgtaggtccacgtttaggttgggaggatctaccatgaagaaggtcaagaagaaaaggtcagaggccagacgccaccgagactccacctcccagcatgctagctccaattccacctctcagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagaccccctcaatatcctcctcagatttgccctgcacttcttgttccatgcttggggtcctaagaacaagccatctgatgcctctactatcattacctctattgggacccagaaaccaataccccaaaatatggtgcatggacatgctgaactgaagaagatgcctcaagggtcatccctaaaggcaaaaacagaacttccaaagtatctttctgtgacaacattaggttcaggcttgaagtccctgatttcgccatcaaagtcagatccaggggggacgatgctattcagaaacgtgctgagaagaggactgcaatgactgctttcaaaaaacaccagaataaatacatacgtagtgtaagcaagcgaccactgttgtatcaaaagccctttgttgtatctgttggtggcggaggcagccagcggttaactgaggttctactgagctctgtggaccacagagttgtcttctcaagtttgcttctagggacaaatta

SEQ ID NO: 729073 - DNA, 272 bp, Homo sapiens; identical to SEQ ID NO: 337946

SEQ ID NO: 729074 - DNA, 328 bp, Homo sapiens; identical to SEQ ID NO: 337947

SEQ ID NO: 729075 - DNA, 576 bp, Homo sapiens
gtagttcttgctgccaccaccactgtcattcccccaggtataggaaggtacactgtgtcttccgattcttggagccagctctgctgtccagacctcctgaagccaggtgtccaggcacccagcacctcctgccaattcatacagaattcaattccccacctggaagggctttcagaagctgacctgcccaacccctggatttcaggcaaactgagaagattggagagggccaaggatttgtcactgagcaaggaggaagccaaagacttagagggcagagaaggatgtaatcaaaatcttcgtcatctccggcttccgaagctcccttccaaagtgccctcaagggcctggaacactctcagtgacagaggcaagagccccatcttgccccagtgctgcccatcaaaatggacccctaaatcctggcccagcctcccagcgcagatctctccttcctcctgtagccccaactaatgtctgtctggaatttgaggggccctggtctggcacactgtggatgcttagttaatgtatggtgactgactaatgtgtggccccaggcctgccccccacctc

SEQ ID NO: 729076 - DNA, 470 bp, Homo sapiens; identical to SEQ ID NO: 163192

SEQ ID NO: 729077 - DNA, 509 bp, Homo sapiens
  misc_feature (17)..(17): n is a, c, g, or t
  misc_feature (39)..(39): n is a, c, g, or t
  misc_feature (498)..(499): n is a, c, g, or t
cagccctgacgcttccntggggccacttccttctttgtntcctagcaacggcgggtagcgttgttgacatcccgggaggctgtgccgccggcctgagcccagagtttcgcggcctccgcgatggcagaggtggaggaaaccttaaagaggatccagagtcataaaggggttattggaactatggttgtaaatgcagaaggtattcccatccgaacaaccttggacaactcaacaactgttcaatatgcaggccttcttcatcacctgacaatgaaagccaaaagcacagttcgtgatattgatcctcagaacgacctgacttttcttaggatcagatcaaagaaacatgaaatcatggtagctccagataaggaatatcttctgatcgtcattcagaatccatgtgaatagacctgcgatggccaaggctgtttaagcgacactgggttggaaacacttggctctctcatgagtattaaaattctatttccttcctannggaattcaat

SEQ ID NO: 729078 - DNA, 422 bp, Homo sapiens
  misc_feature (411)..(412): n is a, c, g, or t
ttgtaaatgcagaagttctggaggttagaagttgaaatcaagatgtccgaaggctcatgctgtctctgaagactctgtgggaggaccattccttacctcttcctagcttctggtattcccatccgaacaaccttggacaactcaacaactgttcaatatgcaggccttcttcatcacctgacaatgaaagccaaaagcacagttcgtgatattgatcctcagaacgacctgacttttcttaggatcagatcaaagaaacatgaaatcatggtagctccagataaggaatatcttctgatcgtcattcagaatccatgtgaatagacctgcgatggccaaggctgtttaagcgacactgggttggaaacacttggctctctcatgagtattaaaattctatttccttcctannggaattcaat

SEQ ID NO: 729079 - DNA, 417 bp, Homo sapiens
  misc_feature (406)..(407): n is a, c, g, or t
caccctggctacacatccaatcacttggaggacattttaaaattttttccattcctgggactgcaccccaaaccaatgaaatcagaatctctgaggccctaggaaatgggtattttctaaagactgaacaggtaattcatacgtgcagatagggtgggaaaccatctgtctgcacaaggtccctgtgatgttttgaagaaaaaagaagactagttgaaatattccttgattaaatttaaattaagggtgaattgattttatccatctctccatagataaggaatatcttctgatcgtcattcagaatccatgtgaatagacctgcgatggccaaggctgtttaagcgacactgggttggaaacacttggctctctcatgagtattaaaattctatttccttcctannggaattcaat

SEQ ID NO: 729080 - DNA, 722 bp, Homo sapiens
caaaccctgttctgtgctgtgtacgatgagtaagcttcccaagttaaaattattgctccacaccacagatttcagattccaagtggaacagaagtccaaagttgctgtttataaacttctaagggtcgattgtacctttcaatggtgtccaccctgtgttgacatacagcaaaaccgaagggctcttgaaacttctaaccactttctgaattacagcgaagaatattctttgcatggtatcaaagttctacaatgtctcagtaattttacatattgaaaaaagtcattgatttccatattcagtcctctgcgctgtcttctcatttcaagtagtctcatgttccatgtattattacgttatttgaggaattaaaaaaaaaaaaaaagaactggggaatctccaagagctggcgggaatattggctttgagaaaggaaccttagaattcaaacgtaatgttttacctaaaaaggagtccagtttccaacacttgggctgggaacgacaggctatggttgcccaggatctgaagtacagaggaaattgcttgtccttctggtgggagagtttgtctctagaggatcaggaggatcaggagggtcaggagaagggcagggtgtggccgggaggaaggggcatggttagagatttcttttcttgatcattttcatcccagttcagcactgagttcagatttcccttccttccttccttccttccat

SEQ ID NO: 729081 - DNA, 1029 bp, Homo sapiens
actcgagtgggtgcgcatgcgcaagaaggtgcctgcgggactggagcagagcgggctgcgagggtcttcccagcgcaggcgggttttccagtgttacttgcggctgggcgtgggggactagctgcctttctggcagcaggcaggaagccgcaaaaagtttctgagcccccgaacctgtagcggacgtggaaaaagaacgcccctcctcaagtgtctggctgaaagatgccacccagggaagggaactcgggctagctaaggaggccattcttgatgttgcttctagatctcatgtcatcaccgagccctcagctgctggtggcagctgctcagcagacccttggcatgggaaagagacggagtccaccccaagccatctgccttcacttagctggagaggtgctggctgtggcccggggactgaagccagctgtgctctatgattgcaactgtgcaggggcatcagagctccagagctatctggaggagctgaaggggcttggcttcctgacttttggacttcacatccttgagattggagaaaacagcctgattgtcagtcctgagcatgtatgtcagcacttggagcaggtgctgcttggtaccatagcctttgtggatgtttccagctgccagcgtcacccttctgtctgctccctggaccagcttcaggacttgaaggccctcgtggctgagatcatcacacatttgcaggggctgcagagggacttatctctagcagtctcctacagcaggctccattcctcagactggaatctgtgtactgtatttgggatcctcctgggctatcctgttccctatacctttcacctgaaccagggagatgacaactgcttagctctgactccactacgagtattcactgcccggatctcatggttgctaggtcaacccccaatcctgctctattcttttagtgtcccagagagtttgttcccaggcctgagggacattctaaacacctgggagaaggacctcagaacccgatttaggactcagaatgacttt

SEQ ID NO: 729082 - DNA, 1114 bp, Homo sapiens; identical to SEQ ID NO: 398002

SEQ ID NO: 729083 - DNA, 1255 bp, Homo sapiens
attatccagcacagagaagcaaacaccagaagcttctctccaactttcagtttttctctaaacttccagtccttctcatactgtgtcctggttataatagttgctgggaccttattctattctgaatccccagcccctaaagaaggcttggtactgacgtgtacagcgtagttacccagtgactttggggaaggcaggaagagtgtggaaaggacaggaggaaggaagggaggggccgtggctccgagctgcctagaaagcggctccagggagccagggcaccgtgagcctggtggttggcagctggagccacgtcggagggggaagtgtcgcagcattctctgcaggcatcacagacctgaggcagtggcctccggagggcactggacagaaacagccatccaagtggctgagtggagggaccctgctcaagtgcagctgcagtggccggggtttccctcaggtagggatcggggcgccttgtcgccgccagccacgtgtggcgtcccggtacagtcagcagagtgcagggtgcgggcaccaggaaagggggcgcaggggaactcccgcgggcctcgcgtttgcaaacttctcgcctgggcaggaggcggtcgtgggaaagaaggtggaagagcgagctttttggaactgtgcacgggacagattggacgcacacccctcgggaggcgcgaaggcatggaaaatttgaagcatattatcacccttggccaggtcatccacaaacggtgtgaagagatgaaatactgcaagaaacagtgccggcgcctgggccaccgcgtcctcggcctgatcaagcctctggagatgctccaggaccaaggaaagaggagcgtgccctctgagaagttaaccacagccatgaaccgcttcaaggctgccctggaggaggctaatggggagatagaaaagttcagcaatagatccaatatctgcaggtttctaacagcaagccaggacaaaatactcttcaaggacgtgaacaggaagctgagtgatgtctggaaggagctctcgctgttacttcaggttgagcaacgcatgcctgtttcacccataagccaaggagcgtcctgggcacaggaagatcagcaggatgcagacgaagacaggcgagctttccagatgctaagaagagataatgaaaaaatagaagcttcactgagacgattagaaatcaacatgaaagaaatcaaggaaactttgaggcagtgtaagttatcatgtgccctgctgt

SEQ ID NO: 729084 - DNA, 1356 bp, Homo sapiens
gttcttttcctggctagtcaaagcacaccttacgtacattctgaagccgtctcttatatgattcatttttttcactgtagataagacttttatggatggattgtttttctcaaataatattatcgctttgtgactaaagtaaagattattaattcctgaggcaagaagatataaaagctccagaaacgttgactgggaccactggagacactgaagaaggcaggggcccttagagtcttggttgccaaacagatttgcagatcaaggagaacccaggagtttcaaagaagcgctagtaaggtctctgagatccttgcactagctacatcctcagggtaggaggaagatggcttccagaagcatgcggctgctcctattgctgagctgcctggccaaaacaggagtcctgggtgatatcatcatgagacccagctgtgctcctggatggttttaccacaagtccaattgctatggttacttcaggaagctgaggaactggtctgatgccgagctcgagtgtcagtcttacggaaacggagcccacctggcatctatcctgagtttaaaggaagccagcaccatagcagagtacataagtggctatcagagaagccagccgatatggattggcctgcacgacccacagaagaggcagcagtggcagtggattgatggggccatgtatctgtacagatcctggtctggcaagtccatgggtgggaacaagcactgtgctgagatgagctccaataacaactttttaacttggagcagcaacgaatgcaacaagcgccaacacttcctgtgcaagtaccgaccatagagcaagaatcaagattctgctaactcctgcacagccccgtcctcttcctttctgctagcctggctaaatctgctcattatttcagaggggaaacctagcaaactaagagtgataagggccctactacactggcttttttaggcttagagacagaaactttagcattggcccagtagtggcttctagctctaaatgtttgccccgccatccctttccacagtatccttcttccctcctcccctgtctctggctgtctcgagcagtctagaagagtgcatctccagcctatgaaacagctgggtctttggccataagaagtaaagatttgaagacagaaggaagaaactcaggagtaagcttctagaccccttcagcttctacacccttctgccctctctccattgcctgcaccccaccccagccactcaactcctgcttgtttttcctttggccataggaaggtttaccagtagaatccttgctaggttgatgtgggccatacattcctttaataaaccattgtgtacataaga

SEQ ID NO: 729085 - DNA, 1423 bp, Homo sapiens; identical to SEQ ID NO: 339566

SEQ ID NO: 729086 - DNA, 1206 bp, Homo sapiens
aaccttttcacctgtctgttctggcatgcttctaatgatgtcagagtcacctggatcaatgataggaaggcaggggcccttagagtcttggttgccaaacagatttgcagatcaaggagaacccaggagtttcaaagaagcgctagtaaggtctctgagatccttgcactagctacatcctcagggtaggaggaagatggcttccagaagcatgcggctgctcctattgctgagctgcctggccaaaacaggagtcctgggtgatatcatcatgagacccagctgtgctcctggatggttttaccacaagtccaattgctatggttacttcaggaagctgaggaactggtctgatgccgagctcgagtgtcagtcttacggaaacggagcccacctggcatctatcctgagtttaaaggaagccagcaccatagcagagtacataagtggctatcagagaagccagccgatatggattggcctgcacgacccacagaagaggcagcagtggcagtggattgatggggccatgtatctgtacagatcctggtctggcaagtccatgggtgggaacaagcactgtgctgagatgagctccaataacaactttttaacttggagcagcaacgaatgcaacaagcgccaacacttcctgtgcaagtaccgaccatagagcaagaatcaagattctgctaactcctgcacagccccgtcctcttcctttctgctagcctggctaaatctgctcattatttcagaggggaaacctagcaaactaagagtgataagggccctactacactggcttttttaggcttagagacagaaactttagcattggcccagtagtggcttctagctctaaatgtttgccccgccatccctttccacagtatccttcttccctcctcccctgtctctggctgtctcgagcagtctagaagagtgcatctccagcctatgaaacagctgggtctttggccataagaagtaaagatttgaagacagaaggaagaaactcaggagtaagcttctagaccccttcagcttctacacccttctgccctctctccattgcctgcaccccaccccagccactcaactcctgcttgtttttcctttggccataggaaggtttaccagtagaatccttgctaggttgatgtgggccatacattcctttaataaaccattgtgtacataaga

SEQ ID NO: 729087 - DNA, 1273 bp, Homo sapiens; identical to SEQ ID NO: 339564

SEQ ID NO: 729088 - DNA, 766 bp, Homo sapiens
gttcttttcctggctagtcaaagcacaccttacgtacattctgaagccgtctcttatatgattcatttttttcactgtagataagacttttatggatggattgtttttctcaaataatattatcgctttgtgactaaagtaaagattattaattcctgaggcaagaagatataaaagctccagaaacgttgactgggaccactggagacactgaagaaggcaggggcccttagagtcttggttgccaaacagatttgcagatcaaggagaacccaggagtttcaaagaagcgctagtaaggtctctgagatccttgcactagctacatcctcagggtaggaggaagatggcttccagaagcatgcggctgctcctattgctgagctgcctggccaaaacaggagtcctgggtgatatcatcatgagacccagctgtgctcctggatggttttaccacaagtccaattgctatggttacttcaggaagctgaggaactggtctgatgccgagctcgagtgtcagtcttacggaaacggagcccacctggcatctatcctgagtttaaaggaagccagcaccatagcagagtacataagtggctatcagagaagccagccgatatggattggcctgcacgacccacagaagcccagccactcaactcctgcttgtttttcctttggccataggaaggtttaccagtagaatccttgctaggttgatgtgggccatacattcctttaataaaccattgtgtacataaga

SEQ ID NO: 729089 - DNA, 616 bp, Homo sapiens
aaccttttcacctgtctgttctggcatgcttctaatgatgtcagagtcacctggatcaatgataggaaggcaggggcccttagagtcttggttgccaaacagatttgcagatcaaggagaacccaggagtttcaaagaagcgctagtaaggtctctgagatccttgcactagctacatcctcagggtaggaggaagatggcttccagaagcatgcggctgctcctattgctgagctgcctggccaaaacaggagtcctgggtgatatcatcatgagacccagctgtgctcctggatggttttaccacaagtccaattgctatggttacttcaggaagctgaggaactggtctgatgccgagctcgagtgtcagtcttacggaaacggagcccacctggcatctatcctgagtttaaaggaagccagcaccatagcagagtacataagtggctatcagagaagccagccgatatggattggcctgcacgacccacagaagcccagccactcaactcctgcttgtttttcctttggccataggaaggtttaccagtagaatccttgctaggttgatgtgggccatacattcctttaataaaccattgtgtacataaga

SEQ ID NO: 729090 - DNA, 455 bp, Homo sapiens
caggagcttaagttacagcgtcaggacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaa

SEQ ID NO: 729091 - DNA, 530 bp, Homo sapiens
  misc_feature (52)..(52): n is a, c, g, or t
  misc_feature (55)..(55): n is a, c, g, or t
  misc_feature (173)..(173): n is a, c, g, or t
  misc_feature (370)..(371): n is a, c, g, or t
  misc_feature (382)..(382): n is a, c, g, or t
atgggcagtccatcacttttgatgccattcaggaggcatgtgccagagcagncgncgcattgtgtcccaaggaatccagaggaaaatgaggccattgcaagcttcgtgaagaagtacaacacatatgcctatgtaggcctgactgagggtcccagccctggagacttccgctnctcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagttnncagcgtcaggntcacttggtctgtgagatgctagaactccctttcaacagaattcacttgtgggctattagagctggaggcacccttagccacttcattccccttttccagactggtgtcactcaggaatcaactagaccatatacgatcactgcccta

SEQ ID NO: 729092 - DNA, 1650 bp, Homo sapiens
  misc_feature (52)..(52): n is a, c, g, or t
  misc_feature (55)..(55): n is a, c, g, or t
  misc_feature (173)..(173): n is a, c, g, or t
  misc_feature (370)..(371): n is a, c, g, or t
  misc_feature (382)..(382): n is a, c, g, or t
  misc_feature (565)..(565): n is a, c, g, or t
  misc_feature (570)..(570): n is a, c, g, or t
  misc_feature (579)..(579): n is a, c, g, or t
  misc_feature (594)..(594): n is a, c, g, or t
  misc_feature (650)..(650): n is a, c, g, or t
  misc_feature (812)..(813): n is a, c, g, or t
atgggcagtccatcacttttgatgccattcaggaggcatgtgccagagcagncgncgcattgtgtcccaaggaatccagaggaaaatgaggccattgcaagcttcgtgaagaagtacaacacatatgcctatgtaggcctgactgagggtcccagccctggagacttccgctnctcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagttnncagcgtcaggntcacttggtctgtgagatgctagaactccctttcaacagaattcacttgtgggctattagagctggaggcacccttagccacttcattcccctgatgggccctgactcttccccataatcactgaccagccttgacactccccttgcaaaccatcccagcactgcaccccaggcagccactcntagcnttggccttngacatgagatggagncctccttattccccatctggtccagttccttcacttacagatggcagcagtgaggncttggggtagaaggatcctccaaagtcacacaaagtgcctgcctcctggtcccctcagctctgcctctgcagcccactgcctgcccagtgccatcaggatgagcagtcccggccaagcataatgacagagagaggcagatttcggggaagccctgactgtgnngagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctggagacagccagcctaggcctctagggtgacctagagccgccttcagatgtgacccgagtaactttcaactgatgaacaaatctgcaccctacttcagatctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaa

SEQ ID NO: 729093 - DNA, 1664 bp, Homo sapiens
  misc_feature (52)..(52): n is a, c, g, or t
  misc_feature (55)..(55): n is a, c, g, or t
  misc_feature (173)..(173): n is a, c, g, or t
  misc_feature (370)..(371): n is a, c, g, or t
  misc_feature (382)..(382): n is a, c, g, or t
  misc_feature (565)..(565): n is a, c, g, or t
  misc_feature (570)..(570): n is a, c, g, or t
  misc_feature (579)..(579): n is a, c, g, or t
  misc_feature (594)..(594): n is a, c, g, or t
  misc_feature (650)..(650): n is a, c, g, or t
  misc_feature (812)..(813): n is a, c, g, or t
atgggcagtccatcacttttgatgccattcaggaggcatgtgccagagcagncgncgcattgtgtcccaaggaatccagaggaaaatgaggccattgcaagcttcgtgaagaagtacaacacatatgcctatgtaggcctgactgagggtcccagccctggagacttccgctnctcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagttnncagcgtcaggntcacttggtctgtgagatgctagaactccctttcaacagaattcacttgtgggctattagagctggaggcacccttagccacttcattcccctgatgggccctgactcttccccataatcactgaccagccttgacactccccttgcaaaccatcccagcactgcaccccaggcagccactcntagcnttggccttngacatgagatggagncctccttattccccatctggtccagttccttcacttacagatggcagcagtgaggncttggggtagaaggatcctccaaagtcacacaaagtgcctgcctcctggtcccctcagctctgcctctgcagcccactgcctgcccagtgccatcaggatgagcagtcccggccaagcataatgacagagagaggcagatttcggggaagccctgactgtgnngagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctggagacagccagcctaggcctctagggtatagatgccccccacgtgcatgacattgaccctgtgtagacttgctggcttatggatagtagatttgtacgggtcttgagacctcgggtggggcattcagatgagcgggttatttttaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaa

SEQ ID NO: 729094 - DNA, 1374 bp, Homo sapiens
agtcaaagaattttaaaaacagggaactttgtaactgtgaaatactctccaggatttaaaaggctgtggagctccagataaagaatcgtttatctttcttctgaagaaattcctttggttacaagtttaccccataaacggcaacacactcacctccatccaagacagactcaaggtggaggaagcgtggaaatgtgcttccggacaaagctctcagtatcctgggtgccattgtttcttctactcagccgtgttttttctactgagacagacaaaccctcagcccaggacagcagaagccgtgggagttcaggccaaccggcagacctgctacaggttctctctgctggtgaccacccaccccacaaccactcaagaagcctcatcaaaacattgttggagaaaactgggtgcccacggaggagaaacggaatgcaaggagattgcaatctgtgctttgaaccagatgcactattactaatagctggaggaaattttgaagatcagcttagagaagaagtggtccagagagtttctcttctccttctctattacattattcatcaggaagagatctgttcttcaaagctcaacatgagtaataaagagtataaattttacctacacagcctactgagcctcaggcaggatgaagattcctctttcctttcacagaatgagacagaagatatcttggctttcaccaggcagtactttgacacttctcaaagccagtgtatggaaaccaaaacgctgcagaaaaaatctggaatagtgagcagtgaaggtgctaatgaaagtacgcttcctcagttggcagccatgatcattactttgtccctccagggtgtttgtctgggacaaggaaacttgccttccccagactactttacagaatatattttcagttccttgaatcgtacgaatacactccgcctatcagaggagccttactctgtggccagcaccaccacaggtccatggggagagctgccacactactgccaatgttcccttaaggcccaagggctcttgaatcaacttctggtgaatgctgcctaccctaggactcacccttcaggtcagtgggctcccctaggcccaggacaggtccagaaatcccatccaagggccaagtcctggaatctcaggccccccaccccaagagtctgcttggacagcattgagttcaatgcctcaaaattgccatgcccccctactgtcagcacccagagatgctctctgcaccacactgctgctactggggaggtgggagaggggtgacatcagagattcaagactgttttttctgcctcttcagtgcctatttcagtaatatgaagttaaaaccagtcaggcattttctgataggaa

SEQ ID NO: 729095 - DNA, 990 bp, Homo sapiens
agtcaaagaattttaaaaacagggaactttgtaactgtgaaatactctccaggatttaaaaggctgtggagctccagataaagaatcgtttatctttcttctgaagaaattcctttggttacaagtttaccccataaacggcaacacactcacctccatccaagacagactcaaggtggaggaagcgtggaaatgtgcttccggacaaagctctcagtatcctgggtgccattgtttcttctactcagccgtgttttttctactgagacagacaaaccctcagcccaggacagcagaagccgtgggagttcaggccaaccggcagacctgctacaggttctctctgctggtgaccacccaccccacaaccactcaagaagcctcatcaaaacattgttggagaaaactgggtgcccacggaggagaaacggaatgcaaggagattgcaatctgtgctttgaaccagatgcactattactaatagctggaggaaattttgaagatcagcttagagaagaagtggtccagagagtttctcttctccttctctattacattattcatcaggaagagatctgttcttcaaagctcaacatgagtaataaagagtataaattttacctacacagcctactgagcctcaggcaggatgaagattcctctttcctttcacagaatgagacagaagatatcttggctttcaccaggcagtactttgacacttctcaaagccagtgtatggaaaccaaaacgctgcagaaaaaatctggaatagtgagcagtgaaggtgctaatgaaagtacgcttcctcagttggcagccatgatcattactttgtccctccagggtgtttgtctgggacaaggaaacttgccttccccagactactttacagaatatattttcagttccttgaatcgtacgaatacactccgcctatcagaactagaccaactcctcaacactctctggaccagaagtacttgtatc

SEQ ID NO: 729096 - DNA, 886 bp, Homo sapiens; identical to SEQ ID NO: 176867

SEQ ID NO: 729097 - DNA, 618 bp, Homo sapiens
  misc_feature (377)..(377): n is a, c, g, or t
  misc_feature (428)..(428): n is a, c, g, or t
  misc_feature (468)..(468): n is a, c, g, or t
tgacatctggtcggaccatgtctaaagagttgaactgtgtgcaggtatgagcccttggttctgccagtgtctggggagttgagcctgggcatgggtgtgagaccctgggtctgtccatatctgaggaggtaggatctggtatgagtatgaggatctgggtgtgtccgtgtctgaggaggtgggccctggcacaggtatgaggcctggggtctgtccgtgtctgaggaggtgggccctggcgcaggtatgaggccctgggtgtgtccgtgtctgaggaggtgggccctggcacaggtatgaggtcctgggtctgctggtgtctgcagagacagggcccgacatctcagggaagaccacggtaagctcttcagtttgtnttgtggctgtggtcagtcatctgtagtctgccctgttggtcttcccatgtnttgccagcacctgcctgctgccttgcttcctggaggtggnttgggccagggccctccgagacgcccctgtgcaagaccagggacagggtttccggcaggaggtggggggcggggtgtgccggccctccctcagcaccttgtcctgtctctcctagtgggtgggaggacgctactgctgtgtcagaccatc

SEQ ID NO: 729098 - DNA, 1680 bp, Homo sapiens; identical to SEQ ID NO: 181813

SEQ ID NO: 729099 - DNA, 1382 bp, Homo sapiens
  misc_feature (852)..(852): n is a, c, g, or t
  misc_feature (856)..(856): n is a, c, g, or t
agcggagttgagctgaatgaatacctccgaagccgctttgttctccagatgtgaatagctccactataccagcctcgtcttccttccgggggacaacgtgggtcagggcacagagagatatttaatgtcaccctcttggggctttcatgggactccctctgccacattttttggaggttgggaaagttgctagaggcttcagaactccagcctaatggatcccaaactcgggagaatggctgcgtccctgctggctgtgctgctgctgctgctgctggagcgcggcatgttctcctcaccctccccgcccccggcgctgttagagaaagtcttccagtacattgacctccatcaggatgaatttgtgcagacgctgaaggagtgggtggccatcgagagcgactctgtccagcctgtgcctcgcttcagacaagagctcttcagaatgatggccgtggctgcggacacgctgcagcgcctgggggcccgtgtggcctcggtggacatgggtcctcagcagctgcccgatggtcagagtcttccaatacctcccgtcatcctggccgaactggggagcgatcccacgaaaggcaccgtgtgcttctacggccacttggacgtgcagcctgctgaccggggcgatgggtggctcacggacccctatgtgctgacggaggtagacgggaaactttatggacgaggagcgaccgacaacaaaggccctgtcttggcttggatcaatgctgtgagcgccttcagagccctggagcaagatcttcctgtgaatatcaaattcatcattgaggggatggaagaggctggctctgttgccctggaggaacttgtggaaanaganaaggaccgattcttctctggtgtggactacattgtaatttcagataacctgtggatcagccaaaggaagccagcaatcacttatggaacccggggaacagtacttcatggtggaggtgaaatgcgagaccaggatttcactcaggaacctttggtggcatcttcatgaaccaatggctgatctggttgctcttctcggtagcctggtagactcgtctggtcatatcctggtccctggaatctatgatgaagtggttcctcttacagaagaggaaataaatacatacaaagccatccatctagacctagaagaataccggaatagcagccgggttgagaaatttctgttcgatactaaggaggagattctaatgcactctggaggtaccatctctttctattcatgggatcgagggcgcgtttggatgagcctggaataaaagagtcatacctgggcgagttataggaaaatgttcaatccggctagtccgtcacataaatgtgtctgaggtggaaaaaagggtgat

SEQ ID NO: 729100 - DNA, 946 bp, Homo sapiens
  misc_feature (699)..(699): n is a, c, g, or t
  misc_feature (746)..(746): n is a, c, g, or t
  misc_feature (748)..(748): n is a, c, g, or t
  misc_feature (841)..(841): n is a, c, g, or t
  misc_feature (845)..(845): n is a, c, g, or t
agcggagttgagctgaatgaatacctccgaagccgctttgttctccagatgtgaatagctccactataccagcctcgtcttccttccgggggacaacgtgggtcagggcacagagagatatttaatgtcaccctcttggggctttcatgggactccctctgccacattttttggaggttgggaaagttgctagaggcttcagaactccagcctaatggatcccaaactcgggagaatggctgcgtccctgctggctgtgctgctgctgctgctgctggagcgcggcatgttctcctcaccctccccgcccccggcgctgttagagaaagtcttccagtacattgacctccatcaggatgaatttgtgcagacgctgaaggagtgggtggccatcgagagcgactctgtccagcctgtgcctcgcttcagacaagagctcttcagaatgatggccgtggctgcggacacgctgcagcgcctgggggcccgtgtggcctcggtggacatgggtcctcagcagctgcccgatggtcagagtcttccaatacctcccgtcatcctggccgaactggggagcgatcccacgaaaggcaccgtgtgcttctacggccacttggacgtgcagcctgctgaccggggcgatgggtggctcacggacccctatgtgctgacggaggtagacgggaaccttatgacgangagcgaccgacacaaggccctgcttgcttcgacaacgcgcgggcgcntnagagccttgagcagatcttcctgtgaatatcaaattcatcattgaggggatggaagaggctggctctgttgccctggaggaacttgtggaaanaganaaggaccgattcttctctggtgtggactacattgtaatttcagataacctgtggatcagccaaaggaagccagcaatcacttatggaacccggggaacagt

SEQ ID NO: 729101 - DNA, 117 bp, Homo sapiens
gcgtggtgaagcgctacggacccatggaggagcccctggtgatagagaaggacctgccccactatttctagctccacaagtgtgtggccccgtcccgaaactgagacagggtaccga

SEQ ID NO: 729102 - DNA, 656 bp, Homo sapiens
gaagaacactatcatcttgtaaacaagtgctgcgaaggataggaatgcagctacaccagcgatgccctggaccctcccctgaagaacgtgtccagcaacgcagagtgccctgcttgttatgaatctaatggaacttcctgttgtgggaagccctggaaatgctatgaagaagaacagtgtgtctttctagttgcagaacttaagaatgacattgagtctaagagtctcgtgctgaaaggctgttccaacgtcagtaacgccacctgtcagttcctgtctggtgaaaacaagactcttggaggagtcatctttcgaaagtttgagtgtgcaaatgtaaacagcttaacccccacgtctgcaccaaccacttcccacaacgtgggctccaaagcttccctctacctcttggcccttgccagcctccttcttcggggactgctgccctgaggtcctggggctgcactttgcccagcaccccatttctgcttctctgaggtccagagcaccccctgcggtgctgacaccctctttccctgctctgccccgtttaactgcccagtaagtgggagtcacaggtctccaggcaatgccgacagctgccttgttcttcattattaaagcactggttcattcactgcccaaaaaaaaaaaacatt

SEQ ID NO: 729103 - DNA, 498 bp, Homo sapiens
gaagaacactatcatcttgtaaacaagtgctgcgaaggataggaatgcagctacaccagcgatgccctggaccctcccctgaagaacgtgtccagcaacgcagagtgccctgcttgttatgaatctaatggaacttcctgttgtgggaagccctggaaatgctatgaagaagaacagtgtgtctttctagttgcagaacttaagaatgacattgagtctaagagtctcgtgctgaaaggctgttccaacgtcagtaacgccacctgtcagttcctgtctggtgaaaacaagactcttggaggagtcatctttcgaaagtttgagtgtgcaaatgtaaacagcttaacccccacgtctgcaccaaccacttcccacaacgtgggctccaaagcttccctctacctcttggcccttgccagcctccttcttcggggactggcagcccctaggacctccagggcacgcaagtcccccgaagaaaggaggcctggcaagagg

SEQ ID NO: 729104 - DNA, 593 bp, Homo sapiens
cggcacgagatccttgtaaacttgacttgtggaggcaaagggaagaagtgcctgccagagaaccctactgagctgctgctcacccccaagaggctggcctctctggtcagtccttctcacacgtcctccaactgcctggtcataaccatcatggaggtgcagagagagagctccccgtccctgagctccactcctgtggtagaattttataggcctgcgagtttcgactctgtcaccactgtgtcacacaactggactgtgtggaactgcacgtccctgctgtttcagacatccatccgggtgttagtgtggttgctaggtttgctctacttcagctccttacccttaggaatctacttactggtgtctaagaaagtcacccttggggtcgtctttgtcagcctggtcccttcgagcctcgttattcttatggtgtatggtttttgccagtgtgtttgtcatgaatttctagactgtatggcacctccttcttaactgatatgcaaaataagaaattggacacacattgccctgtttgagtgtgaagttagataatttataatttattttcttttatgttctttatgattagt

SEQ ID NO: 729105 - DNA, 1711 bp, Homo sapiens
tcagtgcccatccttgggctccaagctccctcccttccatctggtggcagccttgagtgaggggattccatctggtgcccccagaacttaggcagcatcttcaggaccatcaggttcctcacatgagtgctaggatcaacccatacttaagttgggacccgggaagaaccatgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcaggccgactccaggccaagaacagccgagtccctggacactgagccaggaagctcctccttgcacgtgccttacagctggaccagggcgccctggatgtttatcacccagcgcctatcacggctgaatcgcgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacgccagggcagggatgaaaatgaccacatccatttggatggcacccaacatagtgaccccagcagctga

SEQ ID NO: 729106 - DNA, 974 bp, Homo sapiens
tcagtgcccatccttgggctccaagctccctcccttccatctggtggcagccttgagtgaggggattccatctggtgcccccagaacttaggcagcatcttcaggaccatcaggttcctcacatgagtgctaggatcaacccatacttaagttgggacccgggaagaaccatgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccagtgtggagagggggacctctaga

SEQ ID NO: 729107 - DNA, 1109 bp, Homo sapiens
tcccggcgccgtactgtacgtagagtggaagactcctcagagtatgaagcggctgtggttggtgcaggcacgaataggagcagtagactgaagggcacccacaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaaacctccccagcgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacgccagggcagggatgaaaatgaccacatccatttggatggcacccaacatagtgaccccagcagctga

SEQ ID NO: 729108 - DNA, 901 bp, Homo sapiens
  misc_feature (33)..(33): n is a, c, g, or t
  misc_feature (36)..(36): n is a, c, g, or t
gtcgagttctgtaccctctctccacactggtanatnaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagccagtgtggagagagggtaccaactcgagtcgtatatgtat

SEQ ID NO: 729109 - DNA, 1142 bp, Homo sapiens
tacatatacgaactcgagttggtaccaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaaacctccccagcgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacgccagggcagggatgaaaatgaccacatccatttggatggcacccaacatagtgaccccagcagctga

SEQ ID NO: 729110 - DNA, 1228 bp, Homo sapiens
tcagtgcccatccttgggctccaagctccctcccttccatctggtggcagccttgagtgaggggattccatctggtgcccccagaacttaggcagcatcttcaggaccatcaggttcctcacatgagtgctaggatcaacccatacttaagttgggacccgggaagaaccatgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagccagtgtggagagagggtaccaactcgagtcgtatatgtat

SEQ ID NO: 729111 - DNA, 520 bp, Homo sapiens
tcagtgcccatccttgggctccaagctccctcccttccatctggtggcagccttgagtgaggggattccatctggtgcccccagaacttaggcagcatcttcaggaccatcaggttcctcacatgagtgctaggatcaacccatacttaagttgggacccgggaagaaccatgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgttagccctggagtctactgcctccggtacctaatcgagtcgtatcatgta

SEQ ID NO: 729112 - DNA, 116 bp, Homo sapiens; identical to SEQ ID NO: 107084

SEQ ID NO: 729113 - DNA, 1520 bp, Homo sapiens
agcgggaaggagatcctatcagtggggagagtgtgaggggagagggagagcctgcagggcaggcgctgaggatcacgcatcctgtgactctcccctgtcccccgccaccctctgaaccactggccaccatggctacttcaaagttgcccgtggtgcctggggaggaggaaaacaccatccttatggccaaggaaaggctggaggccctgcgcacagcctttgagtcgggtgacctcccccaggccgcctctcacctccaggagctgctggcctccacggaaagcatccgcctggaggtgggcgtcacgggcgagtcgggcgcgggcaagtcctccctcatcaatgccctgcgtggcctggaggccgaggaccctggcgcggctctcacgggcgtcatggagaccacgatgcaaccgtcgccctatccacacccacagttccctgacgtgaccctctgggacctgccaggagccggctctccaggctgcccggctgacaagtacctaaagcaggtagacttcagccgctatgacttcttcctgctggtctccccccgccgctgcggggccgtcgagacccgcctggccgctgagatcctgtgccagggcaagaagttctactttgtgcgcaccaaggtggacgaggacctggcggccacgcgcacccagcggccgtcgggcttcagagaggccgctgtcctgcaggagatccgagaccactgtgccgagcggctgcgggaggccggcgtggctgaccctcgcatcttcctggtgtccaacctctcgccggcccgctacgactttcccacgctggtgtccacctgggagcacgacctgccctcccaccggcgccacgctggcctgctgtcgctccccgacatctcgctggaggccttgcagaagaagaaggccatgcttcaagagcaagtcctcaagaccgccctggtgttgggcgtcatccaggccctgccggtcccagggctggcggccgcctacgatgatgcgttgctcatccactcactgcgtggctaccaccgcagctttggtctggacgacgactcgctggccaagctggccgagcaggtgggcaaacaggcaggtgacctgcgctcggtcatccgctccccactggccaacgaggtctcgcctgagactgtcctgcggctctattcccagtcgtccgacggcgccatgcgggtggcccgcgcctttgagaggggcatccctgtgtttgggacgctggtggctggcggcatcagctttggcgctgtctacaccatgctccagggctgcctcaacgagatggctgaggacgcccagcgtgtccgcatcaaggccctggaggatgacgagccgcagccggaggtcagcttggaagtggccagtgacaatggcgtggaaaaggggggctccggggagggaggtggggaggaagccccactctcaacctgcaggaagctcggcctccttcttaagtacattctggacagctggaagaaacacgactcagaagagaaataa

SEQ ID NO: 729114 - DNA, 1633 bp, Homo sapiens
agcgggaaggagatcctatcagtggggagagtgtgaggggagagggagagcctgcagggcaggaaaaagagagctgtgggcttccagggcgactcccttcacatccgtggtatctgtctctccctgccccatgccaaggcccaggaggtgtgaatggctcccttctcctctgcaggcgctgaggatcacgcatcctgtgactctcccctgtcccccgccaccctctgaaccactggccaccatggctacttcaaagttgcccgtggtgcctggggaggaggaaaacaccatccttatggccaaggaaaggctggaggccctgcgcacagcctttgagtcgggtgacctcccccaggccgcctctcacctccaggagctgctggcctccacggaaagcatccgcctggaggtgggcgtcacgggcgagtcgggcgcgggcaagtcctccctcatcaatgccctgcgtggcctggaggccgaggaccctggcgcggctctcacgggcgtcatggagaccacgatgcaaccgtcgccctatccacacccacagttccctgacgtgaccctctgggacctgccaggagccggctctccaggctgcccggctgacaagtacctaaagcaggtagacttcagccgctatgacttcttcctgctggtctccccccgccgctgcggggccgtcgagacccgcctggccgctgagatcctgtgccagggcaagaagttctactttgtgcgcaccaaggtggacgaggacctggcggccacgcgcacccagcggccgtcgggcttcagagaggccgctgtcctgcaggagatccgagaccactgtgccgagcggctgcgggaggccggcgtggctgaccctcgcatcttcctggtgtccaacctctcgccggcccgctacgactttcccacgctggtgtccacctgggagcacgacctgccctcccaccggcgccacgctggcctgctgtcgctccccgacatctcgctggaggccttgcagaagaagaaggccatgcttcaagagcaagtcctcaagaccgccctggtgttgggcgtcatccaggccctgccggtcccagggctggcggccgcctacgatgatgcgttgctcatccactcactgcgtggctaccaccgcagctttggtctggacgacgactcgctggccaagctggccgagcaggtgggcaaacaggcaggtgacctgcgctcggtcatccgctccccactggccaacgaggtctcgcctgagactgtcctgcggctctattcccagtcgtccgacggcgccatgcgggtggcccgcgcctttgagaggggcatccctgtgtttgggacgctggtggctggcggcatcagctttggcgctgtctacaccatgctccagggctgcctcaacgagatggctgaggacgcccagcgtgtccgcatcaaggccctggaggatgacgagccgcagccggaggtcagcttggaagtggccagtgacaatggcgtggaaaaggggggctccggggagggaggtggggaggaagccccactctcaacctgcaggaagctcggcctccttcttaagtacattctggacagctggaagaaacacgactcagaagagaaataa

SEQ ID NO: 729115 - DNA, 406 bp, Homo sapiens
gcgctgaggatcacgcatcctgtgactctcccctgtcccccgccaccctctgaaccactggccaccatggctacttcaaagttgcccgtggtgcctggggaggaggaaaacaccatccttatggccaaggaaaggctggaggccctgcgcacagcctttgagtcgggtgacctcccccaggccgcctctcacctccaggagctgctggcctccacggaaagcatccgcctggaggtgggcgtcacgggcgagtcgggcgcgggcaagtcctccctcatcaatgccctgcgtggcctggaggccgaggaccctggcgcggctctcacgggcgtcatggagaccacgatgcaaccgcccccctgcctcacccacaaactaagtcttaacaaaatccaaattaccaaca

SEQ ID NO: 729116 - DNA, 654 bp, Homo sapiens; identical to SEQ ID NO: 285945

SEQ ID NO: 729117 - DNA, 574 bp, Homo sapiens
cttcttgggccctggtacgtgcttgcggtggcctcccgggaaaagggctttgccatggagaaggacatgaagaacgtcgtgggggtggtggtgaccctcactccagaaaacaacctgcggacgctgtcctctcagcacgggctgggagggtgtgaccagagtgtcatggacctgataaagcgaaactccggatgggtgtttgagaatccctcaataggcgtgctggagctctgggtgctggccaccaacttcagagactatgccatcatcttcactcagctggagttcggggacgagcccttcaacaccgtggagctgtacagtctgacggagacagccagccaggaggccatggggctcttcaccaagtggagcaggagcctgggcttcctgtcacagtagcaggcccagctgcagaaggacctcacctgtgctcacaagatccttctgtgagtgctgcgtccccagtagggatggcgcccacagggtcctgtgacctcggccagtgtccacccacctcgctcagcggctcccggggcccagcaccagctcagaataaagcgattccacagca

SEQ ID NO: 729118 - DNA, 148 bp, Homo sapiens
gaagaacgtcgtgggggtggtggtgaccctcactccagaaaacaacctgcggacgctgtcctctcagcacgggtgagtgggcgggtcctgccaggccttcccgcaggcaggactgtggctcagccacatcatgtactttgcacatctg

SEQ ID NO: 729119 - DNA, 426 bp, Homo sapiens
caggcgagtcttgtgggtggggccctggggtgctggggggctcagtcctttttcacagccagtcttgcctccccttctagtcacctgtgctcacaagatccttctggtaagccgccatcctgagcctcaccctgggctctcttgggggaagggggtgggggaggccaccctacgcacagtgggtgggaggaccctctgcccaagcccacggggttcatggctccactgtctctaaggcagctgagggtgtggaggagcctccatggtgggctgggccccctcacactcctcttggttttcagtgagtgctgcgtccccagtagggatggcgcccacagggtcctgtgacctcggccagtgtccacccacctcgctcagcggctcccggggcccagcaccagctcagaataaagcgattccacagca

SEQ ID NO: 729120 - DNA, 567 bp, Homo sapiens
tcgaaggggccgaagaactcggcggcgaaggtgaccacgtcctccggctggcgcacagcaggaagagcaggaagtcggagatgagcgcgtgggcttcggggtgctgccgcagatagctggcgtggccgagccggagctcctcctggcaggggacagagcccgagcctcagccggacgggacccccgcgccccaggagcccccagccgctcgctccaaggagagctaaggggcgctggagccttctagcccctacgggtgtgcatttcaatcaggcatcttggtgatgatgcagcaccctggggagcccacctgtattctcttggccaggtgcctggagtgcaacacaacatgtgagagtgagaatcttcccagaccgcctgctatggactgaattgtctctctaacccccagtgtggtggtatttggagaaaggccatgtgaggacacattgagaaggcacttgtctgcaagctaggaagacagccctcaccagaaaccaaccctgatggcaccatgatcttggacttcctgccttccagcaaatatatttctcttgaagccaccca

SEQ ID NO: 729121 - DNA, 1368 bp, Homo sapiens
  misc_feature (66)..(66): n is a, c, g, or t
atggccacagcaggaaatccctggggctggttcctggggtacctcatccttggtgtcgcaggatcnctcgtctctggtagctgcagccaaatcataaacggcgaggactgcagcccgcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaactctggggactgggaacccatgaaattgacccccaaatacatcctgcggaaggaattcaggaatatctgttcccagcccctcctccctcaggcccaggagtccaggcccccagcccctcctccctcaaaccaagggtacagatccccagcccctcctccctcagacccaggagtccagaccccccagcccctcctccctcagacccaggagtccagcccctcctccctcagacccaggagtccagaccccccagcccctcctccctcagacccaggagtccagcccctcctccctcagacccaggagtccagaccccccagcccctcctccctcagacccaggggtccaggcccccaacccctcctccctcagactcagaggtccaggcccccaacccctccttccccagacccagaggtccaggtcccagcccctcctccctcagacccagcggtccaatgccacctagactctccctgtacacagtgcccccttgtggcacgttgacccaaccttaccagttggtttttcattttttgtccctttcccctagatccagaaataaatcccctagatccagaaataaagtctaagagaagcgc

SEQ ID NO: 729122 - DNA, 1812 bp, Homo sapiens
  misc_feature (66)..(66): n is a, c, g, or t
atggccacagcaggaaatccctggggctggttcctggggtacctcatccttggtgtcgcaggatcnctcgtctctggtagctgcagccaaatcataaacggcgaggactgcagcccgcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaactctggggactgggaacccatgaaattgacccccaaatacatcctgcggaaggaattcaggaatatctgttcccagcccctcctccctcaggcccaggagtccaggcccccagcccctcctccctcaaaccaagggtacagatccccagcccctcctccctcagacccaggagtccagaccccccagcccctcctccctcagacccaggagtccagcccctcctccctcagacccaggagtccagaccccccagcccctcctccctcagacccaggagtccagcccctcctccctcagacccaggagtccagaccccccagcccctcctccctcagacccaggggtccaggcccccaacccctcctccctcagactcagaggtccaggcccccaacccctccttccccagacccagaggtccaggtcccagcccctcctccctcagacccagcggtccaatgccacctagactctccctgtacacagtgcccccttgtggcacgttgacccaaccttaccagttggtttttcattttttgtccctttcccctagatccagaaataaagtctaagagaagcgcaggttctgtttgtagtgtcctccttgcttccccttccattcaagagattccagcaaatggctttccctccatgggtcgcatttccctatctgggaaatgcgagctttgaccaggagggccacagagtttcagagggaggggccattccctggatagttaagagaaaccagtgccatggatgttgtccagtttctgaaaagtcaggtcagcaaatggtaaccgtagagattttcttgcttagtttaactattcagctttagttgatctatattcatttttgtcttcttaactgcatttcaagaatttttaatttgcatgtgtctcagaagttggctgctgcagctagagtctagtggggagaattgtggcgagggctactgtgagtgacagcaacagagaccaaggagtagaaagagggaagtttgaggggcacaatggggcaactgaggggcaaggagatgggag

SEQ ID NO: 729123 - DNA, 1230 bp, Homo sapiens
  misc_feature (5)..(5): n is a, c, g, or t
gatcnctcgtctctggtagctgcagccaaatcataaacggcgaggactgcagcccgcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaacccctcctccctcagacccagcggtccaatgccacctagactctccctgtacacagtgcccccttgtggcacgttgacccaaccttaccagttggtttttcattttttgtccctttcccctagatccagaaataaagtctaagagaagcgcaggttctgtttgtagtgtcctccttgcttccccttccattcaagagattccagcaaatggctttccctccatgggtcgcatttccctatctgggaaatgcgagctttgaccaggagggccacagagtttcagagggaggggccattccctggatagttaagagaaaccagtgccatggatgttgtccagtttctgaaaagtcaggtcagcaaatggtaaccgtagagattttcttgcttagtttaactattcagctttagttgatctatattcatttttgtcttcttaactgcatttcaagaatttttaatttgcatgtgtctcagaagttggctgctgcagctagagtctagtggggagaattgtggcgagggctactgtgagtgacagcaacagagaccaaggagtagaaagagggaagtttgaggggcacaatggggcaactgaggggcaaggagatgggag

SEQ ID NO: 729124 - DNA, 1046 bp, Homo sapiens
tgtccttcctttgagcagccactgagagggagaaggagttgcagagatcaggaaggagaggatttatttccagttttctggcagtttttcctcactctttcggagacctaggatgggttaggagagggcatggcaaaggcagaggtggctctgctagaggaggccgcaggtccgcaggccgaacctggggagccagccatgtctggcctgaggccctgctttgaggagaagataaagccttgaggagccttttgggccgatctgggaacccagcaagactagattagcctgactgatgacagacctgggatgaggatgagggcagttaagtatttgtttaatcttgctttgtcttttcaaacagcgatttagtaatcctgtttgaggctgcagtgtggcaatgctttccagaggatggagtcctttttgtttgttttgaaaaaatagagataaggtttcactatgttgcctaggctggtctcatactcggcctcaagccatcctcctgcctgggcctcccaaagtgttgggattacaggcgtgagccatggtgccagactggagtccttttattaaaattaactgccctgctcagctttctgctgggccaccccagagccaatccttggttcttgggcccaaggctggacccaggggttgcaggaaacagtctgtagcatccaagtggggcctgtcgtacccactccagtgtgtaggtgcagaacgctctttgggggatttctctgctgggccaccttactccagggatccctcagttttcaaaacaaagcaagagggcaaggaagaatggagaaacagctcagtgttgactctcttccccctggtgagtgctgtgctggggcctctgtgcacatcataccacttcccccttgaatcagccccacaaggcagggtgagagatgaggactcagggtgcaaggaggtctcacagcttggaaatggatcaggacagctctgattctccaaggccaaggtcttctctatatcatgaggcagcccaaaaatgtgtttctacacatattctg

SEQ ID NO: 729125 - DNA, 2824 bp, Homo sapiens; identical to SEQ ID NO: 288696

SEQ ID NO: 729126 - DNA, 2803 bp, Homo sapiens
ggagccagtcttgggcgctggagggcctgtcctgaccatggtccctgcctggctgtggctgctttgtgtctccgtcccccaggctctccccaaggcccagcctgcagagctgtctgtggaagttccagaaaactatggtggaaatttccctttatacctgaccaagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggggagcaccagccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccaggtacactggagtgggggtgatgtgcactatcacctggagagccatcccccgggaccctttgaagtgaatgcagagggaaacctctacgtgaccagagagctggacagagaagcccaggctgagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccaggtactgaagtgactagactgtcagcagaggatgcagatgcccccggctcccccaattcccacgttgtgtatcagctcctgagccctgagcctgaggatggggtagaggggagagccttccaggtggaccccacttcaggcagtgtgacgctgggggtgctcccactccgagcaggccagaacatcctgcttctggtgctggccatggacctggcaggcgcagagggtggcttcagcagcacgtgtgaagtcgaagtcgcagtcacagatatcaatgatcacgcccctgagttcatcacttcccagattgggcctataagcctccctgaggatgtggagcccgggactctggtggccatgctaacagccattgatgctgacctcgagcccgccttccgcctcatggattttgccattgagaggggagacacagaagggacttttggcctggattgggagccagactctgggcatgttagactcagactctgcaagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacacctacacggtgcttgtggaggcccaggatacagatgagccgagactgagcgcttctgcacccctggtgatccacttcctaaaggcccctcctgccccagccctgactcttgcccctgtgccctcccaatacctctgcacaccccgccaagaccatggcttgatcgtgagtggacccagcaaggaccccgatctggccagtgggcacggtccctacagcttcacccttggtcccaaccccacggtgcaacgggattggcgcctccagactctcaatggttcccatgcctacctcaccttggccctgcattgggtggagccacgtgaacacataatccccgtggtggtcagccacaatgcccagatgtggcagctcctggttcgagtgatcgtgtgtcgctgcaacgtggaggggcagtgcatgcgcaaggtgggccgcatgaagggcatgcccacgaagctgtcggcagtgggcatccttgtaggcaccctggtagcaataggaatcttcctcatcctcattttcacccactggaccatgtcaaggaagaaggacccggatcaaccagcagacagcgtgcccctgaaggcgactgtctgaatggcccaggcagctctagctgggagcttggcctctggctccatctgagtcccctgggagagagcccagcacccaagatccagcaggggacaggacagagtagaagcccctccatctgccctggggtggaggcaccatcaccatcaccaggcatgtctgcagagcctggacaccaactttatggactgcccatgggagtgctccaaatgtcagggtgtttgcccaataataaagccccagagaactgggctgggccctatgggattggtaaaactg

SEQ ID NO: 729127 - DNA, 713 bp, Homo sapiens
gcttcagcagcacgtgtgaagtcgaagtcgcagtcacagatatcaatgatcacgcccctgagttcatcacttcccagattgggcctataagcctccctgaggatgtggagcccgggactctggtggccatgctaacagccattgatgctgacctcgagcccgccttccgcctcatggattttgccattgagaggggagacacagaagggacttttggcctggattgggagccagactctgggcatgttagactcagactctgcaagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacaccaactttatggactgcccatgggagtgctccaaatgtcagggtgtttgcccaataataaagccccagagaactgggctgggccctatgggattggtaaaactg

SEQ ID NO: 729128 - DNA, 802 bp, Homo sapiens
ttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggggagcaccagccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccag

SEQ ID NO: 729129 - DNA, 1191 bp, Homo sapiens
gcttcagcagcacgtgtgaagtcgaagtcgcagtcacagatatcaatgatcacgccccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacacctacacggtgcttgtggaggcccaggatacagatgagccgagactgagcgcttctgcacccctggtgatccacttcctaaaggcccctcctgccccagccctgactcttgcccctgtgccctcccaatacctctgcacaccccgccaagaccatggcttgatcgtgagtggacccagcaaggaccccgatctggccagtgggcacggtccctacagcttcacccttggtcccaaccccacggtgcaacgggattggcgcctccagactctcaatggttcccatgcctacctcaccttggccctgcattgggtggagccacgtgaacacataatccccgtggtggtcagccacaatgcccagatgtggcagctcctggttcgagtgatcgtgtgtcgctgcaacgtggaggggcagtgcatgcgcaaggtgggccgcatgaagggcatgcccacgaagctgtcggcagtgggcatccttgtaggcaccctggtagcaataggaatcttcctcatcctcattttcacccactggaccatgtcaaggaagaaggacccggatcaaccagcagacagcgtgcccctgaaggcgactgtctgaatggcccaggcagctctagctgggagcttggcctctggctccatctgagtcccctgggagagagcccagcacccaagatccagcaggggacaggacagagtagaagcccctccatctgccctggggtggaggcaccatcaccatcaccaggcatgtctgcagagcctggacaccaactttatggactgcccatgggagtgctccaaatgtcagggtgtttgcccaataataaagccccagagaactgggctgggccctatgggattggtaaaactg

SEQ ID NO: 729130 - DNA, 420 bp, Homo sapiens
gcttcagcagcacgtgtgaagtcgaagtcgcagtcacagatatcaatgatcacgccccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacaccaactttatggactgcccatgggagtgctccaaatgtcagggtgtttgcccaataataaagccccagagaactgggctgggccctatgggattggtaaaactg

SEQ ID NO: 729131 - DNA, 1912 bp, Homo sapiens
tgtctaggttcagcctactagggagatctgacacacatctgcactgatcaccgagtaaactgtttcacgttagacctgtaacccaaggagatgtgtatagagctgaaactgaagaaattcctaaaatattccagatactatatgcaaatgaaggtgaatgtagaaaagatgtagagatggaaccagtacaagaagctgaaaaaactaatttccaaaatcacaaaggccatgagtttattcctacactctaccactttcctgccaattgtgatgcctgtgccaaacctctctggcatgtttttaagccaccccctgccctagagtgtcaaagacgccatgttaagtgccacagagatcacttagataagaaagaggacttaatttgtccatgtaaagtaagttatgatgtaacatcagcaagagatatgctgctgttagcatgttctcaggatgaacaaaaaaaatgggtaactcatttagtaaagaaaatccctaagaatccaccatctggttttgttcgtgcttccccttgaacgctttctacaagatccactgcaaatcagtctttccggaaagtggtcaaaaatacatctggaaaaactagttaaccatgtgaccgagtgccttgtggaatcgtgtgggatgctacctgataaaccaggcttctttaaccatgcagagcagacaggctgtttctttgacacaaatatcacaggcttcagggtgctgcctttttggatttataagaaaatggctgtcagtcgtgatagaacagagttttcctcatatgagtaagaggaagggactttcactttcaagtggaacggccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatggtggacttgatggagaaattaaatatctttcattatgctttacaaaatactgtatatgtttcagcaagtttggggaatgggagaggacgaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtccgtgagtttttcattgataattggtttaatttaaaatatttagaggtttgttggactttcataaattgagtacaatctttgcatcaaactacctgctacaataatgactttataaaactgcaaaaaatgtagaaggttgcaccaatataaaaaggaaatatggcaatacatccatgatgttttccagttaacataggaattaccagataaatactgttaaactcttgtccggtaacaagagttgattcatatggacagtatgatttattgtttctttttttaaccaaatacctcctcagtaatttataatggctttgcagtaatgtctatcagataagaagcactggaaaaccgatcgtctctaggatgatatgcatgtttcaagtggtattgaaagccgcactgatggatatgtaataataaacatatctgttattaatata

SEQ ID NO: 729132 - DNA, 2010 bp, Homo sapiens
taaactgtttcacgttagacctgtaacccaaggagatgtgtatagagctgaaactgaagaaattcctaaaatattccagatactatatgcaaatgaaggtgaatgtagaaaagatgtagagatggaaccagtacaagaagctgaaaaaactaatttccaaaatcacaaaggccatgagtttattcctacactctaccactttcctgccaattgtgatgcctgtgccaaacctctctggcatgtttttaagccaccccctgccctagagtgtcaaagacgccatgttaagtgccacagagatcacttagataagaaagaggacttaatttgtccatgtaaagtaagttatgatgtaacatcagcaagagatatgctgctgttagcatgttctcaggatgaacaaaaaaaatgggtaactcatttagtaaagaaaatccctaagaatccaccatctggttttgttcgtgcttccccttgaacgctttctacaagatccactgcaaatcagtctttccggaaagtggtcaaaaatacatctggaaaaactagttaaccatgtgaccgagtgccttgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttatcgcgggtttgcctacaggtagattagattaattattactatgtaatgcaagtacagttgggggaaagcttaggtagatatattttttttaaaaggtgctgcctttttggatttataagaaaatggctgtcagtcgtgatagaacagagttttcctcatatgagtaagaggaagggactttcactttcaagtggaacggccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatggtggacttgatggagaaattaaatatctttcattatgctttacaaaatactgtatatgtttcagcaagtttggggaatgggagaggacgaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtccgtgagtttttcattgataattggtttaatttaaaatatttagaggtttgttggactttcataaattgagtacaatctttgcatcaaactacctgctacaataatgactttataaaactgcaaaaaatgtagaaggttgcaccaatataaaaaggaaatatggcaatacatccatgatgttttccagttaacataggaattaccagataaatactgttaaactcttgtccggtaacaagagttgattcatatggacagtatgatttattgtttctttttttaaccaaatacctcctcagtaatttataatggctttgcagtaatgtctatcagataagaagcactggaaaaccgatcgtctctaggatgatatgcatgtttcaagtggtattgaaagccgcactgatggatatgtaataataaacatatctgttattaatata

SEQ ID NO: 729133 - DNA, 724 bp, Homo sapiens
gtatgtaaagataatgtatatttacctttcctcctaatgtttgtttctcgtatttttaaactgagtgcatttcttaaattagtttttcccccctccctcaacagttaaccatgtgaccgagtgccttgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttatcgcgggtttgcctacaggtagattagattaattattactatgtaatgcaagtacagttgggggaaagcttaggtagatatattttttttaaaaggtgctgcctttttggatttataagaaaatggctgtcagtcgtgatagaacagagttttcctcatatgagtaagaggaagggactttcactttcaagtggaacggccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatggtggacttgatggagaaattaaatatctttcattatgcttt

SEQ ID NO: 729134 - DNA, 414 bp, Homo sapiens
tgttaggcctgtggttaaaagatgagttttgctagttgtcctgaggtccccaaggatagagctttagcctctgtgtaccctgcatatatagtttcattctgaacaaaactgctcccatctgaaaaccatattttgaccagattgtccaagggctgatcctttaagtcttcccatctggcataaatttggttaagtatctcacaacatgaatgtgttgagtcatcctctcctggtaatggcagtaaggaggctgggatgagggtggagcaccactcaactgttacctgtgggatttctaacaacacttgatactttagcaatctgttgtcagtgagccattgtggcacttttatgtccagtaaggggcttatttgttggacatcaggagctggattgattgtatcatggtgattt

SEQ ID NO: 729135 - DNA, 506 bp, Homo sapiens
ctgtgggatttctaacaacacttgatactttagcaatctgttgtcagtgagccattgtggcacttttatgtccagtaaggggcttatttgttggacatcaggagctggattgattgtatcatggtgattttgaggacctcctccagtaggagggcttgtgcagccactaccttgaggcagtgtggccacctgtgtgctactgggtctaggttctttaaaaagtaacctacaggacatttgattgacccaacagtttgagttaggactcctaaggctacaccttggcttttggtgatgaaaagctaaaacagtttgcttagtatgggtagcccaagggctggggcttatgagagagcagtctttagctgcctaaaggcttgctcctgatctttttcccagagaagtgagtccctatcagtcccttcttttagatgtctggactagatgttggattcccagttgtcttgtgggggaggagattagcaggtcattcacatactgtagga

SEQ ID NO: 729136 - DNA, 281 bp, Homo sapiens
gaagtgagtccctatcagtcccttcttttagagtctaatataaggacttaacaatcccaccataacccagtctaaagtctgcaatatcctgtgatccctagaaaggcctgatgctgattttgggtggctgggataggtattttaaggatggcctgtatccgttctggggagaacttatgttctcgagggatcaggattatccccacgtattggacctcttgtctgagaagctgtgccttggccttggatgctttgtaccctctgtctgcaagaaaatgtag

SEQ ID NO: 729137 - DNA, 555 bp, Homo sapiens
catttaagcatctgctaactctactaggtaagtgttatcatccttattttatataaaaggaaactgaggctcaaaaaagttaagtgaatagacttgttacagccatgtttgcttccactcaaccctagtatgagtttgttgttgtggaaagaatttatctggaatgtcttggtgcaaattagctgttttggtcaattttatttcttcaacaaatatgaatgatttatgtggcaggcacttgtgtaggcactggggatatgggatgaataggacagacacagtcctgctctcaagaaggttatctccatcacgtgagccagacataaagcaaacaattatctaagtacattttgattatattaatagttctgattagtgttatttatttattctgtgttcctaagtcccaatggtttgaaactgactgatgataaataatagaactgtaaaatttataacaataaatttgttacagaaaaggtcttattttttaacagtgtaagtactctggtttattccagaggctactaaaaattagaacatatgaggctatgg

SEQ ID NO: 729138 - DNA, 474 bp, Homo sapiens
attcatcatactactctgatccaagtgagacccacactgggtcagctccatcaaggagaagaacattccacccacgtttggattctggaatatcatccttgcttccatcagattcttgtaagtacctcacttggcacaaggtagacatgacgttcaaggaagtcaactgcgttgcccaagagtaagagaaggaatctctgaagaagagcaacttttcagacaggtagagtgtgccttgctcccaaggaaaagagttcttgaaaaaaacaaatgggaaacatggctacaagaaaactgggaagactgcaagaaattgatggcaaaatatggaaataaaaaaattaagttgacttttaggaatgcagtttacaagagcaatgcgaccactgagagtggtagcaatgtattttacaccaaagttgcctgatattaaaagtgaaaataaaatattcagtatctttgaagcacaccaaa

SEQ ID NO: 729139 - DNA, 439 bp, Homo sapiens
agaatttgaacatttcatttcagggtttgggggatccttaccaagttgaaaattttaacagaattcttagaagactaattcgagttgaaaccctctgggattgctagagaaccccttttacagggagctgctatttgcttcagcaggcagaatgcgtaggtggagtgagctttggtggcaatgagaggggccaacagaggtcctcaggagtgaattagatgaaggaaattgagcatccacaaaaaggaaagagtattctcctgtttgccaaacttaaaaatgctggatggaatcttgaagctaccagaagattgcttatcaccagaaaccaatattttttcaaaaatatgccttgtatcctaatgcagtctgtatagaaagaaagcaatcatcattgttgctaaaagctaataaacacaggacatgcatgattaaatat

SEQ ID NO: 729140 - DNA, 1255 bp, Homo sapiens
attcatcatactactctgatccaagtgagacccacactgggtcagctccatcaaggagaagaacattccacccacgtttggattctggaatatcatccttgcttccatcagattcttgtaagtacctcacttggcacaaggtagacatgacgttcaaggaagtcaactgcgttgcccaagagtaagagaaggcaaaaacatgctaactgacaagaaaatcatgggttttatacaaggataacaagtgctgggttgcttagctatgaggaaggctaggctcactgcataccagaagatgtacagcgttggagaattcagggatttttatcaacaatcaaactatatttgtggaaattttgtgcataagtgccaaagatggctgacatcggaccacattctatttaactcaactgaatgacaccaagctctcatcctaaaacttatagttacatccacccttctgaaatatttaattattctccaatacactggaggtaataggtataaaaagaatgagcatgtgcaacttagtatctcatatctaattttgtgtcccaagttcattcttcccctgaatgtcccatgtctaccaggtgcaggattatctggatgggtcagttcaaaacaatttcagggaataaattgtgtaggggactcaattttctgagacagaaacataatgtgaataactcctttgttagaaaataatttcagtgacagaaagcctttcagttcataaagaaaacttacatatcaacaagcctagctcctcactagtcccagtgaatgcttacatcaatcagctctacaatatccagtaaaggactttccaattcgcctttgaataaactgaggtattggaaacatctaaaaaatggtttttaattcttcctaatcttcagggagttcttccttatattgagctgatatctgccctctgtaactttcaactaattattcaaatctctcaagtgattataattaattccatcttataaggaatttttctcagcttccagcctcttgaaaatactctgatattttctctaatattcaagtggaaatgtaaatgggtaacgtaagagtctgtggggttaggagggtggaggaaaggtaagggaaagctaatgagaaataaccaaagcaagaaaaagaattttattttcttcaagttctttgtacatccaaagtggaagattcctaaaataaattccccataccacattttaaaaattaggttagcaagcttactttt

SEQ ID NO: 729141 - DNA, 1266 bp, Homo sapiens
gttagtggataattcactggtggacttaagtgccataagattgccaagggattgctagagaaccccttttacagggagctgctatttgcttcagcaggcagaatgcgtaggtggagtgagctttggtggcaatgagaggggccaacagaggtcctcaggagtgaattagatgaaggaaattgagcatccacaaaaaggaaaggcaaaaacatgctaactgacaagaaaatcatgggttttatacaaggataacaagtgctgggttgcttagctatgaggaaggctaggctcactgcataccagaagatgtacagcgttggagaattcagggatttttatcaacaatcaaactatatttgtggaaattttgtgcataagtgccaaagatggctgacatcggaccacattctatttaactcaactgaatgacaccaagctctcatcctaaaacttatagttacatccacccttctgaaatatttaattattctccaatacactggaggtaataggtataaaaagaatgagcatgtgcaacttagtatctcatatctaattttgtgtcccaagttcattcttcccctgaatgtcccatgtctaccaggtgcaggattatctggatgggtcagttcaaaacaatttcagggaataaattgtgtaggggactcaattttctgagacagaaacataatgtgaataactcctttgttagaaaataatttcagtgacagaaagcctttcagttcataaagaaaacttacatatcaacaagcctagctcctcactagtcccagtgaatgcttacatcaatcagctctacaatatccagtaaaggactttccaattcgcctttgaataaactgaggtattggaaacatctaaaaaatggtttttaattcttcctaatcttcagggagttcttccttatattgagctgatatctgccctctgtaactttcaactaattattcaaatctctcaagtgattataattaattccatcttataaggaatttttctcagcttccagcctcttgaaaatactctgatattttctctaatattcaagtggaaatgtaaatgggtaacgtaagagtctgtggggttaggagggtggaggaaaggtaagggaaagctaatgagaaataaccaaagcaagaaaaagaattttattttcttcaagttctttgtacatccaaagtggaagattcctaaaataaattccccataccacattttaaaaattaggttagcaagcttactttt

SEQ ID NO: 729142 - DNA, 378 bp, Homo sapiens; identical to SEQ ID NO: 130952

SEQ ID NO: 729143 - DNA, 1702 bp, Homo sapiens
agcggttgaggcgcgtgtggaagcgcttccgggcggtagcacgctgtgttggcggcggctccccgcttgcctcagctgcagcagcgggaagctcggtggcaagcccttgtagtcctgtgcgatggcgtctcgatatgacagggcgatcactgtcttctccccagacggacacctttttcaagttgaatatgcccaggaagcggtgaagaaaggatccaccgcggtttcgaggacttactgctgatgctagagtagtaataaacagagcccgtgtggagtgccagagccataagcttacggttgaggacccagtcactgtagaatacataactcgcttcatagcaactttaaagcagaaatatacccaaagcaatggacgaagaccttttggtatttctgccttaattgtaggttttgatgatgatggtatctcaagattgtatcagacagatccttctggtacttatcatgcttggaaggcaaatgcaataggccgaagtgctaaaactgttcgagaatttctagaaaagaattacacagaagatgccatagcaagtgacagtgaagctatcaagttagcaataaaagctttgctagaagttgtccagtctggtggaagaaacattgaacttgctataataagaagaaatcaacctttgaagatgtttagtgcaaaagaagttgaattatatgtaactgaaatagaaaaggaaaaggaagaagcagagaagaaaaaatcaaagaaatctgtctaattcttaggatgaccactgggaggtcttaatgttttgttttattgtactgcctgaggttgtttagtgaaattttagaggaaaacagttattttgcagcattacatgcagtacttgtgtgatgttttgagaatgccagatctgtggctgtcttcattctattacatagtcaaacataggtttatgtgaagattttctttgaaaggggatttcagtaattgttgagagcagtcataattccacataagcctgagactctataatttgtccagtgtcttacttaccttcatatatgcaaatataattttaaaaaattttttaattaaaaaaatttaataatttggtgatgtttgaatattgactgtcagttaaggacatagctattccaaataaactaaatataatattgagctgcatttctcaaagaatgacaaaagcatccttatactgatgagttcttaaaattttgtcagagccttcttcattttacaatattttgttatttttattttacctttttcattttacaatatttcgttatttttattttacctttttcattttacaagttgcaatatattgtttcgttcatggaacaaatataggctgaattcaaacatgcaattaaagcatgggaagagcttctaagggcatcttaacaggatgctacatgaaaataaggaaagaaattaatacatatcacttttagtttagatttttattttatctcaagtatgtccagtgtgttcggtttgttacatattccatgaaatatctgagtgtgtattttatgattggtattatggaaggcttattgggggaacaagaaaaatataaaaagtgatctctgcccacggaaaggatttaatccaaatggtccacaagaggaatgtgcttaattcctacagtgagtttatatttttgaaaataaaagctagtaaatattcaaa

SEQ ID NO: 729144 - DNA, 1829 bp, Homo sapiens
agcggttgaggcgcgtgtggaagcgcttccgggcggtagcacgctgtgttggcggcggctccccgcttgcctcagctgcagcagcgggaagctcggtggcaagcccttgtagtcctgtgcgatggcgtctcgatatgacagggcgatcactgtcttctccccagacggacacctttttcaagttgaatatgcccaggaagcggtgaagaaaggatccaccgcggtgtcggaattcgaggtaccaatatagttgttcttggggtagaaaaaaaatctgttgccaagcttcaagatgaaagaactgtgaggaaaatttgtgcccttgatgaccatgtctgcatggcttttgcagttcgaggacttactgctgatgctagagtagtaataaacagagcccgtgtggagtgccagagccataagcttacggttgaggacccagtcactgtagaatacataactcgcttcatagcaactttaaagcagaaatatacccaaagcaatggacgaagaccttttggtatttctgccttaattgtaggttttgatgatgatggtatctcaagattgtatcagacagatccttctggtacttatcatgcttggaaggcaaatgcaataggccgaagtgctaaaactgttcgagaatttctagaaaagaattacacagaagatgccatagcaagtgacagtgaagctatcaagttagcaataaaagctttgctagaagttgtccagtctggtggaagaaacattgaacttgctataataagaagaaatcaacctttgaagatgtttagtgcaaaagaagttgaattatatgtaactgaaatagaaaaggaaaaggaagaagcagagaagaaaaaatcaaagaaatctgtctaattcttaggatgaccactgggaggtcttaatgttttgttttattgtactgcctgaggttgtttagtgaaattttagaggaaaacagttattttgcagcattacatgcagtacttgtgtgatgttttgagaatgccagatctgtggctgtcttcattctattacatagtcaaacataggtttatgtgaagattttctttgaaaggggatttcagtaattgttgagagcagtcataattccacataagcctgagactctataatttgtccagtgtcttacttaccttcatatatgcaaatataattttaaaaaattttttaattaaaaaaatttaataatttggtgatgtttgaatattgactgtcagttaaggacatagctattccaaataaactaaatataatattgagctgcatttctcaaagaatgacaaaagcatccttatactgatgagttcttaaaattttgtcagagccttcttcattttacaatattttgttatttttattttacctttttcattttacaatatttcgttatttttattttacctttttcattttacaagttgcaatatattgtttcgttcatggaacaaatataggctgaattcaaacatgcaattaaagcatgggaagagcttctaagggcatcttaacaggatgctacatgaaaataaggaaagaaattaatacatatcacttttagtttagatttttattttatctcaagtatgtccagtgtgttcggtttgttacatattccatgaaatatctgagtgtgtattttatgattggtattatggaaggcttattgggggaacaagaaaaatataaaaagtgatctctgcccacggaaaggatttaatccaaatggtccacaagaggaatgtgcttaattcctacagtgagtttatatttttgaaaataaaagctagtaaatattcaaa

SEQ ID NO: 729145 - DNA, 1894 bp, Homo sapiens
agcggttgaggcgcgtgtggaagcgcttccgggcggtagcacgctgtgttggcggcggctccccgcttgcctcagctgcagcagcgggaagctcggtggcaagcccttgtagtcctgtgcgatggcgtctcgatatgacagggcgatcactgtcttctccccagacggacacctttttcaagttgaatatgcccaggaagcggtgaagaaaggatccaccgcggttatcatgtttctctgattgttcacgattcttgtggcctggcatggatgtctgcacatttgaaaaagtcggaattcgaggtaccaatatagttgttcttggggtagaaaaaaaatctgttgccaagcttcaagatgaaagaactgtgaggaaaatttgtgcccttgatgaccatgtctgcatggcttttgcagttcgaggacttactgctgatgctagagtagtaataaacagagcccgtgtggagtgccagagccataagcttacggttgaggacccagtcactgtagaatacataactcgcttcatagcaactttaaagcagaaatatacccaaagcaatggacgaagaccttttggtatttctgccttaattgtaggttttgatgatgatggtatctcaagattgtatcagacagatccttctggtacttatcatgcttggaaggcaaatgcaataggccgaagtgctaaaactgttcgagaatttctagaaaagaattacacagaagatgccatagcaagtgacagtgaagctatcaagttagcaataaaagctttgctagaagttgtccagtctggtggaagaaacattgaacttgctataataagaagaaatcaacctttgaagatgtttagtgcaaaagaagttgaattatatgtaactgaaatagaaaaggaaaaggaagaagcagagaagaaaaaatcaaagaaatctgtctaattcttaggatgaccactgggaggtcttaatgttttgttttattgtactgcctgaggttgtttagtgaaattttagaggaaaacagttattttgcagcattacatgcagtacttgtgtgatgttttgagaatgccagatctgtggctgtcttcattctattacatagtcaaacataggtttatgtgaagattttctttgaaaggggatttcagtaattgttgagagcagtcataattccacataagcctgagactctataatttgtccagtgtcttacttaccttcatatatgcaaatataattttaaaaaattttttaattaaaaaaatttaataatttggtgatgtttgaatattgactgtcagttaaggacatagctattccaaataaactaaatataatattgagctgcatttctcaaagaatgacaaaagcatccttatactgatgagttcttaaaattttgtcagagccttcttcattttacaatattttgttatttttattttacctttttcattttacaatatttcgttatttttattttacctttttcattttacaagttgcaatatattgtttcgttcatggaacaaatataggctgaattcaaacatgcaattaaagcatgggaagagcttctaagggcatcttaacaggatgctacatgaaaataaggaaagaaattaatacatatcacttttagtttagatttttattttatctcaagtatgtccagtgtgttcggtttgttacatattccatgaaatatctgagtgtgtattttatgattggtattatggaaggcttattgggggaacaagaaaaatataaaaagtgatctctgcccacggaaaggatttaatccaaatggtccacaagaggaatgtgcttaattcctacagtgagtttatatttttgaaaataaaagctagtaaatattcaaa

SEQ ID NO: 729146 - DNA, 1666 bp, Homo sapiens
ccagaaccagccgttgtcccctggcaaaaagaggcccagggctgagccctgggcaagtgtctcccgacatcgctacccctcctccctttattagtttccctttcccaacagaaaccatttccttctgccaccaaaactaggttgcatccaaaagtttttcacaagcttaaaaaagaaaaacgaaaaattgacaagtattacacagaagagcccacaaaagcttcagcaacaccaagggcgaagaagcagcgtcagatccaggtctgcaggacacaccaaagaactcctccaagtcacacaagggagaaaattaacttcattggcttctatcaggaaagctattttttttttcctcttctttcctgcaagtttcccaaaccccatgactctgatttccaggtcagagactaaggttttatttttcttactctgtatactttatatgtggagagtccctgaaggaacactgtgatgggctgattactgtgagccagttgtgggccagacctggcctcaggtgctgcaaagggaattcagtcacccctgtgcagtgatctgtgagccccaagtcagatccaactttttcctgatagacagcaccctcctcctccctaccaagaaatagcagggttggaggtagtgacccaatattcaagaggtttgaaattctacatgagatatttctgagttaactcctaaatagcagtttccttaatcatgtggaaaataagaacacttactaaagagaccattggtttaagagaaatggaaacttatgtccacgtaaaaacctgtaaatgaatgttcacagcagccttttcataatagccaaaaagggaaagcaatccacacgtccatcaaccaatgaatggataaacttaacgtgggatatacgtgtaatggaatgctatttggtgaagaaagaaatgaaatattaatacatgcgttaacaaggatggaccttaaaatatcatgctaagtaagagaagcctgtcacaaaagaatatgtattgtaccattctacttatatgaaattcctagaataggcaattctatagggacagaaactagactagtgattggctagagcttggggagagtttggggagcctggaggatgacagcaaagtggtgcagagtttctttttaggttgattaaatgttgtaaaattaattgtagtgatggttgtgcaactttgtgattttgttaaaaaccattgcattttgccctttaaatggatgaattgcacaatgtgtgaattagacataagtttatttacataattaatatctatttattgatatataactcatatatcaataaatatatactatataaaataattttatatttatataaaatgtgaattatatataaatacataaataaaactgctaaaaactaaaaaatatatactttaaaaaaaggctgttcgtttctttcacattttctgagcacaatcactttgggataaatgtgtccaggcttaaaaagccagattttatgggctaactaaaatggaaatgtgaaaaactgtgtttttttccataggaggagagagtctgatttgcaggtacgtgcatacccacagcagtcatacttgtaattcttggaaactttgctgaaagttttttcctagcctgaaatcattaaaatatgttgaaa

SEQ ID NO: 729147 - DNA, 1319 bp, Homo sapiens; identical to SEQ ID NO: 143637

SEQ ID NO: 729148 - DNA, 691 bp, Homo sapiens
acactgctgcaaaactgatctttctaaacacaggtcagctcatgtcactcacctcctcagaaatcttcagtagctcttcattaaccaacagggggttcctaactccccgtcttggcattggaggacctttccctgcctgatccccgcgatcatcttttcctgcaatatttactcaggccagtgctcaccccttctttaaaatgctggtgctggctcaagagaggcaaacagccatctctctcattcttatcttccctgtcaagacttcacataggtggactgatgctagactatgatgatgagtctccagtgaaagtttctaagtagaactctctcagggtttctagaagcatttttgtttaagaaaatattgtggggggagcgggatttttaaatggtggagctcatggtaaacaaaattatgtgtgcaaaatgttaatagagcctttctaatattcttgtgattaactctggtgacagttggctgagtgttcttgtttctgcaacgcctgtctttggaaatgtgatagggggcttattgagcagactgcaactggaaatgaggaatgttgacttgaagtctgtaattcacttatacttttctctaaatcctagactgagtcactcaatgtgagataagtactgcacataaaatgcaatggatttcacgttatacagtggagtgggtaag

SEQ ID NO: 729149 - DNA, 1683 bp, Homo sapiens; identical to SEQ ID NO: 141844

SEQ ID NO: 729150 - DNA, 616 bp, Homo sapiens
aaagaaagagaccgtgtcgcccaaccaaaaaagtcatttaacaagatagtcaggatactaccaaccacactgcccaccacaagaattcacctaaagaagtctgttccaaggacactgcttcactggactgcaagaagaactatacatgattgttcagataaatttgaggatttacatgacatgacctcatttacacaccttaaaaaagtaaaatcaagatcaaggcttttaggaaaaagctcagatgatatccataaccatgccagacactctgcaagaccatatactgctccggaggttaacaagcaacgagaaagctacagtggaaagtttacaagtcgtcgaatggtttcatcaggcttagttcatataaatgataaaacatcagattatgaaatgcataaaatgcggccaaaaaaaattaaaagaggatattgaaaaatgttcgctcatttgtgatattataaaacatgtttaactcagaatgatatgtgaggccagcagtcagaatatcacttctccattaacaaaatggtttggagatctcttcttttgtgtgacagaagtcagcaaccaaatttcatcttgttagaaccattttgttttgattaaaatg

SEQ ID NO: 729151 - DNA, 569 bp, Homo sapiens
gtgtgttatagaaatgcagtattttgaggcaaacttctggagtactaaatctgaattggaaaggactgataacatctctttcaactcatagctgattcaggattgttcagataaatttgaggatttacatgacatgacctcatttacacaccttaaaaaagtaaaatcaagatcaaggcttttaggaaaaagctcagatgatatccataaccatgccagacactctgcaagaccatatactgctccggaggttaacaagcaacgagaaagctacagtggaaagtttacaagtcgtcgaatggtttcatcaggcttagttcatataaatgataaaacatcagattatgaaatgcataaaatgcggccaaaaaaaattaaaagaggatattgaaaaatgttcgctcatttgtgatattataaaacatgtttaactcagaatgatatgtgaggccagcagtcagaatatcacttctccattaacaaaatggtttggagatctcttcttttgtgtgacagaagtcagcaaccaaatttcatcttgttagaaccattttgttttgattaaaatg

SEQ ID NO: 729152 - DNA, 2073 bp, Homo sapiens
  misc_feature (27)..(27): n is a, c, g, or t
  misc_feature (611)..(611): n is a, c, g, or t
  misc_feature (1093)..(1093): n is a, c, g, or t
aggcgattgggtaccgggccttcctcngcccagcgtccgctgtcctcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaagaaaagcaacatagtggggtttctgtcaatctgtcctcggctgcccttctcatttgttgatgggaccttgaaagcaagcttgctaggtgccctctgtggctccagcctttaccggaagtgtggtgcatgtttttaacttcagggaagcggtatcctgtcactggggtatgggatgagcatggagaagaggcaccagccacgattccttcctaagcatctcctgttctgactgctcatgaattgaagaaactgacccttgtgttcactctgcttcctctgattgtttctatcatggtttccaaaaattgccatgggaacatgtcaaagggccacttttggagactctgctccaggaagaactagtccccatagctcccctatcccccaccataccacagacatgctgtgacttagagaactacacanacatccttgggacctagatgctggaggaatgacttaatttgatgcagaaactccatcacccaagggagtacctctcactgtaaacagtgctgtgcttgctctgaaggattaagcaagaagtcccaacagaagcaatgcaccagtcctgctatgggaatgaaactgcgaagcctaggagatgggtgaagtccctttctggagacctttaatgagtacttcaaagcactcgacacagatgcagcaaatagggcatcacacatacacaggcattaatactcacgggcatatagatgctgacatgtgtacactgacttacgcccttcccacagctacagataagggctcgcaaagttggcctcagagacacatcaggaaccaaggtggaccagcaggtgccgagcctgtgtatctgcttggaggagacgttccaatgtgctgccttgttcagagatggtgtagttgcaagaaacagaaacccaccncaatttctcaggcaaaaagggagttaattataaggacataagagcacaaagttccagtgcaagagatacatccaggctgcacaagctccgggagtggggcctggcaagccaaaagaaaccaaagtttgtcttgccttctgttcctctttctgaagccacatagccttttatgactgtgtatctttgcatcgcttttgttttctttttatgtctctgaagccagcttttcctgttcactcatcccttgattaaatatggacattctagcttcacatcacttcctaattcagggaccaacagagactggttagcatgttgctatcccacctccaaattgcatcagggaatttgattttgctgcttgggtcagggtccagtagtctgggccaggggactgggaccatctagcacatagccaaaggggctgacctaatggggcaggtctgacacaaatggggtcatttcttggacagacatcccaagggccactatgatagtagcttctctaaaagacgggttcctgagaagaattgcattctgtttcccagtgagttagcggagtcatacttactacatcccaaggcaggtggcatggtagaaacaggcctgaaagagaggtcaggttctaaccttctcccctctctgaggctcagctgctcccttctgtagaataaaaggggttggtctgtaacaagattttcaaaaatttatagtagtgaaactttacaattcgacttggacaaccagagattaaaagcaaatagattcttgttgatgtcaggtggggagcttagctctcccattctgtgattccttcctctgaaggccctcaaagcaactccataataactcacagagctgccagagccgatgttttggagcaccctgagacatatgaactctaatataacttccaggagaaagtacataggattccacttagagccaatctcagctgtctatctgtctagctacctgtc

SEQ ID NO: 729153 - DNA, 211 bp, Homo sapiens
  misc_feature (20)..(20): n is a, c, g, or t
  misc_feature (22)..(22): n is a, c, g, or t
  misc_feature (85)..(85): n is a, c, g, or t
ctcgtgcaatttcgggcagntngtacattctggattctcctcttgagtaaaaggactcagccaactatgaagttttttgtttttnctttaatcttggctctcatgctttccatgactggagctgattcacatgcaaagagacatcatgggtataaaagaaaattccatgaaaagcatcattcacatcaaggctatagatcaaattaactgt

SEQ ID NO: 729154 - DNA, 538 bp, Homo sapiens; identical to SEQ ID NO: 17232

SEQ ID NO: 729155 - DNA, 495 bp, Homo sapiens
tgcttactggcaggcactgtgctaggcactgaggagacaggacaggcacggttctgttatggagctcgctgcctttaggagcaagcaaagaaagtgctgcataaacaaagctcaagataaatctagaggtggaaggggctcacttgctatggctgacatcccttacaggtaaaggtggggaagggggagagctccaggtgtggatcaaagaagccaagaacttgacggctgccaaagcaggagggacttcagacagctttgtcaagggatacctccttcccatgaggaacaaggccagtaaacgtaaaactcctgtgatgaagaagaccctgaatcctcactacaaccatacatttgtctacaatggtgtgaggctggaagatctacagcatatgtgcctggaactgactgtgtgggaccgggagcccctggccagcaatgacttcctgggaggggtcaggctgggtgttggcactggtgagatcccctccccca

SEQ ID NO: 729156 - DNA, 279 bp, Homo sapiens
ctgcatctccccgccacccgctcgtccccttctctttctgccaccctcctttccttcctccctcgctccactccactccctccctcttttctcagtaccctcctctttactctccgagttaactgagagccgacctgacatctccaacattttcaccctcttcccccacccccatcaccgagaatggagtcagggtttccggagagaccgaactctgctctcagcacctttcccagccgctgttgctaaactgacctcggaggacgagaggggaaggag

SEQ ID NO: 729157 - DNA, 828 bp, Homo sapiens
cttgttctcatggtggctacatggaagtatgctagacctcctacaggtttaggctcagaactggcagaatgtcacttctgctgcattctattaaaaacacgtcacaaggctagcccagattcaagtgggtgtagaaatagactattctacttgatgactgatactcttgatatagccaatgtagggtggggatctaggacaaagggtgttgtaggaatctgcactggcactgaaggggcacaaggagaacttgggactcagttgactaataccagtaaagatgtcatctggccaatttgtgtgaaaaaagagaataattctcatccaaaccgcctgtctctggaaataagaaaagctctgagggtctccaaagttaccagaggaaggctgaattttatgagtctagtcctcaactctaaccaaagtaaaggaaactggaaagacacacgctttttcagtcattaatagaaagttgtccagaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggaggctcctgccatacgccagacagttttgtagacacgaaggatccagagattagcaacacctttaccatttttggtgacagttaagcacccatctaagaagttttctttgggtttccggagagaccgaactctgctctcagcacctttcccagccgctgttgctaaactgacctcggaggacgagaggggaaggag

SEQ ID NO: 729158 - DNA, 416 bp, Homo sapiens
ataccagtaaagatgtcatctggccaatttgtgtgaaaaaagagaataattctcatccaaaccgcctgtctctggaaataagaaaagctctgagggtctccaaagttaccagaggaaggctgaattttatgaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggaggctcctgccatacgccagacagttttgtagacacgaaggatccagagattagcaacacctttaccatttttggtgacagttaagcacccatctaagaagttttctttggtgagtgccaaaaagtgtaactc

SEQ ID NO: 729159 - DNA, 656 bp, Homo sapiens; identical to SEQ ID NO: 61429

SEQ ID NO: 729160 - DNA, 3281 bp, Homo sapiens; identical to SEQ ID NO: 49148

SEQ ID NO: 729161 - DNA, 1086 bp, Homo sapiens
cttttttcaccctgatttctaattattttattgaaacaactataaaatgtatggtttctccaggaagatatctgctttttaaaacaacaaacaagaacaacaacacaaaactggtaatgatttggagtaatcatgcgggcatattgagtctgggtagtgtttcgctggtggtagagtggttgagacttcctgggaggactttttccgccttcactcctacagatttaagattctttatttttaggccgggcatggtgactcacctgaggtgaggagttcgagactagcctggccaacatggcaaaaccctgtctctactaaaagtacaaaaattagccaggcgtggtggtgcatgcctataatcccagctactcgggaggctgaggcaggagaatcgcttgaacccaggaggcagaggttgcagtaagccaaggtcacaccactgcactccagcctaggtgacagggcgagactctgtctctcaaaaaaaaaaaaaaaaaaatttctttgaaacagggtctctaatatgttgcccaagctgatctcaaactcgtggctcaactggattctcccgtttcaaccttgagtagctggggacgacagatacttgctactggcacccagctaggttaaggttctgtatactctgtctttctaaagcaattccctggaaattttctcaacatgggttataactgaatgcttgggaaggggaggggcagccccttcaacaggaaaggggactgccaaatcttaaatgccagtcaagattctcctgaagctagcagggttctccggtacgagcattagctgcctgtgtgagaattgaccagatggggggttttacggcccccccgaatgagacacgccaaacaatgtcccctatcccttgggcgtgcgccgcgggaaaggacataaggggggtttgcggacaatacacttacaagccggcccgccggacaccacagggggttgggcgtcaccaacacgatgcgcgcgggagaacaaggtgacagccgacgcagaagtaaacccccggcacaaatcaagcaagcggcacataccatcttgtgcacgccacactga

SEQ ID NO: 729162 - DNA, 818 bp, Homo sapiens
caggagagcgacatcttcctgagctcctgtccatgcctgccatacctgccagcttcagacatttagggaaaaggggcagcatgtggggaatgccccccgccttccacaaatccttttgctgacccaggaagttctgggagttgccgtttttcatcaaaacgtttgggggcttccaagttgtttgtgagatctgaaaacttaactttgcccaatatcctggttggggaccgtgagaaatatctgtcccatttagatctctggggccactgatgggatgccctgggaagatccttggctgccgctttctctccccacagcctcaaggccaccctaccgtcatatatatcactcaggcgtagaagaaaagacacatattttataaaatctttttaataaaaggaagttccaagaagaatttttaagaactacctctaggtgtgcctccacgctggccctagctttcccattgctgttccattgctgagacaaactggaaggctccctttctgtttgaagttttatgacttgtagtcaggctttgctgttcgtcacagtgtcattttccattcaggtaccatcacctggtcccatcaacaggtctagtatgtagctcactgataacagaggaagatgtgtctcctcccaccctcttcctaatggtcattatgcctttctccatctattgtctctttcaccccttcccctctcccttgggctctgatgaaaaattgttgactgcagtttcggaagtttgatctgagaaccaaccatagaatgtttcagttctaggaaataaaaccagttgattaaagcaaaaa

SEQ ID NO: 729163 - DNA, 566 bp, Homo sapiens
caatttcagatacagacatcaaggatgcagtcgacccagagtccactcagcggccaaacccattccgtcgacaaagcattgtcttagatcccatgttacaggagggtacctttaacagccagagggcaaccttcataagagactggtccaacaagatgcctgacatggcttacgaacgcaagctaaagagcctcatggagaaaagcaccgaacctaagatggaaaccatgaggatgttgaagccagaggaggtgctgagctgccgatacctgaggttatccaaggagaacattcggaccttgctcaagttgtgcaaggatgcaggaatgaatgtggatatccacccccacatggtcgaagaggacatagatgctaaaaaggtgttcaccggaatacccagcatggccctctaaatagctcctctcgccaccaccttcaggctccttctgtcatgggacccttcacctccagatgccatcctctggcacactacaagtggtccttccaacttagtgcatccctttagaaagtaagcaatcagaaaacaagcctcggctgtgtgatca

SEQ ID NO: 729164 - DNA, 495 bp, Homo sapiens
caccccggcaccagtcgcccgcatcgcggctctcgctaagatcggccctaagagagaatggaaggctgtttcctagaaaggagcattggtggcggctgctgggaagacacggggaatggaacgggcctttgcttccgcagcacaaagcgtcacgaggtggggaggaggaaaggccggcgactatctacaccgccgcctgcagcttttactgggagcgctgagcgccagcctggaggtgcacgtgttgcagtgaggagccctgaaacatgcgtgttttactgcacaagatgtgcccttgaatggagtctaggccagtcggggtcaccaaaaaaaatccaccaaaaaacacccaagaagggagaagcggtcaccccccacgtgctggaatgacagctttttacttgctaggcagttggaccttttccgaattttctacaatgcacatagatttgtacttacatctttaaattaaaacccacgcaactccgaaaaata

SEQ ID NO: 729165 - DNA, 969 bp, Homo sapiens
aggtgattttctgagtgtgactcctctgttcctggcaccctgtgcatccttagccatagcttacaagagaacagctggttgtgatggcaggaggccctcccaacaccaaggcggagatggaaatgtccctggcagaagaactgaatcatggacgccaaggggaaaaccaagagcacctggtgatagcagaaatgatggagcttggatctcggtcccggggtgcctcccagaagaagcagaagttggaacaaaaagctgctggctctgcttcagccaaacgagtttggaatatgactgccacccgacccaagaaaatgcaacccagggacagatgcagtggcgcagactagcctggaagagttcaatgtactggagatggaagtcatgagaagacagctgtatgcagtcaaccggcgtctgcgcgccctggaggaacagggcgccacctggcgccacagggagaccctgatcatcgccgtgctggtgtcggccagcattgccaacctgtggctgtggatgaaccagtgatcgccccagcgcggctccgtattggagccctccctgcttccccttctttctttcctctttccccaggccgccactgcccttgcccctttcatctcccagcagccctcaggagcgtcaggatcattttcaactctggttaggcctcctacctggggaggccaggtcactgcactgggaggtcctggctgctgcgaagctggaggaggactgcgtgggctgagatgccaccctttgaagggtgaacagcatggcggcatctgggccccacagtaacacctagtggcaaccttgccttcctgacctcagcggcccttctgttccatcctctgtgggcaggggtgtggctttgttttcctccctcgtttgcttccacctcgtgcacagcgctctgcacagacaacacgctcaataaaagttcagccatagcagcaaaaacctgtg

SEQ ID NO: 729166 - DNA, 1076 bp, Homo sapiens
aggtgattttctgagtgtgactcctctgttcctggcaccctgtgcatccttagccatagcttacaagagaacagctggttgtgatggcaggaggccctcccaacaccaaggcggagatggaaatgtccctggcagaagaactgaatcatggacgccaaggggaaaaccaagagcacctggtgatagcagaaatgatggagcttggatctcggtcccggggtgcctcccagaagaagcagaagttggaacaaaaagctgctggctctgcttcagccaaacgagtttggaatatgactgccacccgacccaagaaaatggggtcccagctgccaaagcccagaatgctgagagaatcaggccatggggatgcccatctccaggagtacgctggcaatttccaaggcatacgtttccattatgatcgcaacccagggacagatgcagtggcgcagactagcctggaagagttcaatgtactggagatggaagtcatgagaagacagctgtatgcagtcaaccggcgtctgcgcgccctggaggaacagggcgccacctggcgccacagggagaccctgatcatcgccgtgctggtgtcggccagcattgccaacctgtggctgtggatgaaccagtgatcgccccagcgcggctccgtattggagccctccctgcttccccttctttctttcctctttccccaggccgccactgcccttgcccctttcatctcccagcagccctcaggagcgtcaggatcattttcaactctggttaggcctcctacctggggaggccaggtcactgcactgggaggtcctggctgctgcgaagctggaggaggactgcgtgggctgagatgccaccctttgaagggtgaacagcatggcggcatctgggccccacagtaacacctagtggcaaccttgccttcctgacctcagcggcccttctgttccatcctctgtgggcaggggtgtggctttgttttcctccctcgtttgcttccacctcgtgcacagcgctctgcacagacaacacgctcaataaaagttcagccatagcagcaaaaacctgtg

SEQ ID NO: 729167 - DNA, 1029 bp, Homo sapiens
aggtgattttctgagtgtgactcctctgttcctggcaccctgtgcatccttagccatagcttacaagagaacagctggttgtgatggcaggaggccctcccaacaccaaggcggagatggaaatgtccctggcagaagaactgaatcatggacgccaaggggaaaaccaagagcacctggtgatagcagaaatgatggagcttggatctcggtcccggggtgcctcccagaagaagcagaagttggaacaaaaagctgctggctctgcttcagccaaacgagtttggaatatgactgccacccgacccaagaaaatgggatgcccatctccaggagtacgctggcaatttccaaggcatacgtttccattatgatcgcaacccagggacagatgcagtggcgcagactagcctggaagagttcaatgtactggagatggaagtcatgagaagacagctgtatgcagtcaaccggcgtctgcgcgccctggaggaacagggcgccacctggcgccacagggagaccctgatcatcgccgtgctggtgtcggccagcattgccaacctgtggctgtggatgaaccagtgatcgccccagcgcggctccgtattggagccctccctgcttccccttctttctttcctctttccccaggccgccactgcccttgcccctttcatctcccagcagccctcaggagcgtcaggatcattttcaactctggttaggcctcctacctggggaggccaggtcactgcactgggaggtcctggctgctgcgaagctggaggaggactgcgtgggctgagatgccaccctttgaagggtgaacagcatggcggcatctgggccccacagtaacacctagtggcaaccttgccttcctgacctcagcggcccttctgttccatcctctgtgggcaggggtgtggctttgttttcctccctcgtttgcttccacctcgtgcacagcgctctgcacagacaacacgctcaataaaagttcagccatagcagcaaaaacctgtg

SEQ ID NO: 729168 - DNA, 505 bp, Homo sapiens
agtctgcctgtccttcaggaaatgccagaggaaaaagattctttggctgagctgatgctctcagtgtcaatagctccagccctatgcaatctccattcttccaccctcatctctatttcacaggttgctgtaaagagaagaaaattcttattgtaatctttattcaagccaagtcttgataccctggggctgtgggagaggaatggcaagccatggaagaatagaggagccagaaagatgggaatagaaagtctgtgctaagtaccaggcaggactggtcttcaaccttgatgtcttatgctactgtagttaattttgttcactaccagctatttatttgcaaacgttcgtggttcaacattctgcttaaagtatggacagttatcttcttcatcgatgtgtggacatatgtttctattcctctccttaaatcctccctccatcctgagaccactctttcttaatgttctaattttaaataaatgcatgtaaatgtatgtaaaaa

SEQ ID NO: 729169 - DNA, 743 bp, Homo sapiens
gcttgcgtgaatgatcacttgctgattcgaggtaggcatgatgaaggagggtttagaggagacacagacacaatgaactgacctagatagaaagccttagtatactcagctaggaatagtgattctgaggacacactgtgacatgattatgccattacatgtatggtagtgatggggatgatagaaggaagaacttatggcatattttcacccccccaaaaatcagttaaatattgggacactaaccatccaggtctagaaaagtcacatgccatagccatggtattgcacatcattcatcttgcattctttgagaataagaagatcagtaaatagttcagaagtgggaagctttgtccaggcctctgtgtgaacccaatattttgtttcgaaatagaacaagtaagttcattgctatagcataacacaaaatttgcttaagtggtggtcagcaaatccttgaatgctgcttaatgtgacgaggttggtaaaatcctttgtgcaacactcttactccctgaatgttttgctgtgctggggcctgtgcatgccaggcaaggccaagatggctcaaagagcaaccagccacctctgcagcctgccacctcctgctggcaagatttgtttttgcatcctgtgaagagccaaggaggcaccagggcataagtctactcacttatatctgtctggaacataacgcttgtttgtttttacaacaaataaaattgatcttgaataaaaac

SEQ ID NO: 729170 - DNA, 488 bp, Homo sapiens
tctttcattagtttttcattcagttgtatttatttaatttttatttcattttccagacctaagtcagtgttagtctaccactgtacatctggtaacctcaatccctgcaaccggggcaaaatgggtttccaggtcttggcaacctttgaaattccaattccatttgagagagctttgacgaggccatatgctgatttcaccaccagcaacttcagaacccagtactggaatgccatcagccagcaggcccctgccatcatctatgacttctatctgtggctcactggaaggaaacccaggcaaggccaagatggctcaaagagcaaccagccacctctgcagcctgccacctcctgctggcaagatttgtttttgcatcctgtgaagagccaaggaggcaccagggcataagtctactcacttatatctgtctggaacataacgcttgtttgtttttacaacaaataaaattgatcttgaataaaaac

SEQ ID NO: 729171 - DNA, 511 bp, Homo sapiens
gtttccaggtcttggcaacctttgaaattccaattccatttgagagagctttgacgaggccatatgctgatttcaccaccagcaacttcagaacccagtactggaatgccatcagccagcaggcccctgccatcatctatgacttctatctgtggctcactggaaggaaacccagtttttctcaaaatctgaggagctgctacggaaagcacaccagatctcatgtgttgaaacgtgaacatgctcaccacagaccaaggacgttcaacctgtcaatccccaggatttccaagccaggggtttcatctcttacttgtggaaaatttgttcatttgattatgaaccaatcagcttttcattgtgtcaaaatcaaatctagatagtgaaactgatattttatctttattgttatcttaaatatatcttggcttaaagagacataagtggctcttccccactataccagataacaagttgcaaataaatcattcagtagtaaagttcaaagaaa

SEQ ID NO: 729172 - DNA, 485 bp, Homo sapiens
gtttccaggtcttggcaacctttgaaattccaattccatttgagagagctttgacgaggccatatgctgatttcaccaccagcaacttcagaacccagtactggaatgccatcagccagcaggcccctgccatcatctatgacttctatctgtggctcactggaaggaaacccaggtgagaagctgagtcaatggctttgagaatgtcactgcatatgggagattgaggccccaaagtctttagggcttccttcagccaaagattaaaggagacaactgaatctgacccatatatacagattgaacacacctactctgaaaatccaaaatctgaaattctccaaaatccaaaagttttgagtgctgacatgatgccacaagtggaaaattccgcacatcttacctcatgtgatgggtcacagtcaaaacacattcaaaactttgtttcatgcataaaattatttaaaatattgtataagattacc

SEQ ID NO: 729173 - DNA, 1533 bp, Homo sapiens; identical to SEQ ID NO: 51260

SEQ ID NO: 729174 - DNA, 1219 bp, Homo sapiens
agcaaaaatgtaaaattggatgcacagaaaagtgactcaaagtgcttaatgactagaagaaatctaggagcagcaagaagcctcagtgtatgggcgctgttcatcctctggtgctgaagcagccaagagacccaagtctgcctggctgcctcttaggatatgacagcagagccagtggcctctactagatcctgtacaacctcacaaaacacccagacatcgggagtgctgccagcctgtgatgcaagagtcctaatcctgaagacattgaatgacctgtcattctgctgtttttaccaaaaaggatcatgaggatcagagaggaaaagtcacttgcccaaagtcacacagctgaacagtggtggagttcaactttgaccatgggctgtctggccccaaggtgtatgcttgcttctctcccaagagactcctttcttatcaggctcaaatgaatgaaaggaggatgttaaagttcctagaagctttaattgaatgaaagttcctagtagatctgtacctactaaaaaccacacttctgaagctacgtggccaccagaagacacagctagtctgccatgtaaaaaaggaaaggtggcgtgtgccctgaaggcgcaggggtgagaggcagggaaatggagaccccaacagccagcatcagtggccctcatcacagccctccaggagatatcaaaggagacaacgccattattgacgagatcactcccaagcggattggagattgtcccaatacttagacctatagcaaggccttgggagaaatggtggtgcagcaggagagcaggaacctaaccattgccatcctaaggccctccattgtgcggagcaacgtcgcaccagcttttcctgggttgggttgataatctaaatggatgtagctgactcattattgcggtatgtatagggatgaggaagtaactgtaatgtagtggaggaatagtaagaaaattcttagtgctggcttagcttcattgatccaaaaacataaatgctactttactatcaattgaagcatattatttcaattattctggttataatatggaggcaggatgaaattgtttttattcttttagaattttttttatcaggaaaacagaggtaaagtgctatcaattactatttaagagttctattttgaaaagtgagaattaaggatttttcttttctttttaaaaaaaacttttttaaaaattaaaaa

SEQ ID NO: 729175 - DNA, 1529 bp, Homo sapiens
tggtgccagcactagcccccatgtcggtctcagagaaccttctccccacctctgagttattctctcagtgtatcgaagatatcagtcaactatcttctggattgcattgatgctattgagaaggcagcctgcagtctaaaagtcatggttttaaaggcggaacacaccaggagccccagcgcaaccctcccctccaatgtgccttcatgccggtccctgtcatccagcgaagacggccccagtggcccttccagcctcgcagatggaggcctagcccacaacttacaggatagtgtcaggcaccgcatcctctacctctcagagcagctgagagtggagaaggccagtcgggatggcaacactgtgagctacctcaagctggtatccaaagcagaccggcaccaggtgccgcacatccagcaggcctttgagaaggtgaaccagcgcgcctctgccaccatcgcccagatcgagcacaggctccaccagtgtcaccagcagctccaggagctggaggaaggctgcaggcccgagggcttactgctgatggcagaaagcgacccagccaactgcgagccacccagtgagaaggccctgctttcagagccccccgagccaggtggggaagacgggccggtcaacctgcctcatgccagcaggcccttcatcttggagagtcgcttccagagcttacagcaggggacgtgcttagagacagaggatgtggcccagcaacaaaacctgctgttgcagaaggtaaaggcagagctggaagaagccaagaggttccacatcagcctccaggagtcctatcacagcctaaaggagaggtctctgactgacctgcagctgttgctggagtcccttcaggaggagaagtgtaggcaagcattgatggaagaacaggtgaatggtcgcctgcagggacagctgaatgagatttacaacctcaaacacaatctggcctgcagcgaagagagaatggcctatctatcctatgagagagccaaggaaatatgggagatcacggagaccttcaagagccgaatatccaagctggagatgctacagcaagtcacccaactggaggcagcggagcacctccaaagccgtcccccgcagatgttgttcaagttcctgagtccgcgcctctcactggcaaccgtcctcttggtctttgtctccaccttgtgtgcctgcccctcgtcactgatcagctcacgcctgtgcacctgcaccatgctgatgctgatcgggcttggggtcctggcctggcagaggtggcgcgccatccctgccacagactggcaggaatgggtcccctccaggtgtagactgtactccaaggactctgggcctccagcagatggaccttaaggggccaggagggccacctgccttagcttgctagctccctccctcctcctgggtgctgagggcatccagcaagcccctccacagctcttgcttgccgattatgtaaccaccagcctggtgaaatggatatagacgcccacctgcctcacact

SEQ ID NO: 729176 - DNA, 1228 bp, Homo sapiens
aggcatctcgaacccttggcccccatggaccccctgaggcgctccccctctccctgcctgtcctcgcagccctccagccccagcaccccaccctgcgagatgcttggtcctgtgggcattgaggctgtgctggaccagctgaagatcaaggctatgaagatggggtttgagttcaacatcatggtggtggggcaaagcgggctgggcaagtccacgatggtgaacacgctgttcaagtccaaagtgtggaagtcaaacccaccgggcttgggggtgcccacaccccagacgctgcagctgcattcactgacccatgtcatagaggagaagggtgtgaagctgaagctgacggtgacggacacgcccggcttcggggaccagatcaacaatgacaactgctgggaccccatcctgggctacatcaacgagcaatacgagcagtacctgcaggaggagatcctcatcacccgccagcgccacatcccagacacccgggtgcactgctgcgtgtactttgtaccacccactgggcactgcctgcgggccctggacattgagttcctgcagcggcttgtgccggactgtgaatgtggtgcccgtgattgcagggccgacagcctgaccatggaggagcgagaggccttcaggcgcaggagcagaacctgaggacccactgcatcgacgtctacccccagatgtgctttgacgaggacatcaatgacaaaatcctcaacagcaagttacgggaccgaatcccttttgccgtggtaggggctgaccaagagcacctggtgaacgggaggtgtgtcctgggccggaagaccaagtggggcatcattgaagtggagaacatggcgcactgtgaatttcctctcctgagagacctgcttatccgctcccacctccaagacctgaaggacataacccacaacatccactatgagaactaccgcgtcatcagactcaatgaaagccacctgctgccccgcgggcccggctgggtgaacctggccccggcctccccaggacagctgaccaccccccggaccttcaaggtctgcaggggggcccatgacgattctgatgatgagttctgaccaccggcggatcccggggctgctgggcttcctgagtccccagcggctctcaacacacacctatgtaccagagcatctattaaatgtgagccttgctttttatgaaaagctgtgctttgaaaacaaaaaca

SEQ ID NO: 729177 - DNA, 1014 bp, Homo sapiens
aggcatctcgaacccttggcccccatggaccccctgaggcgctccccctctccctgcctgtcctcgcagccctccagccccagcaccccaccctgcgagatgcttggtcctgtgggcattgaggctgtgctggaccagctgaagatcaaggctatgaagatggggtttgagttcaacatcatggtggtggggcaaagcgggctgggcaagtccacgatggtgaacacgctgttcaagtccaaagtgtggaagtcaaacccaccgggcttgggggtgcccacaccccagacgctgcagctgcattcactgacccatgtcatagaggagaagggtgtgaagctgaagctgacggtgacggacacgcccggcttcggggaccagatcaacaatgacaactgctgggaccccatcctgggctacatcaacgagcaatacgagcaagcagaacctgaggacccactgcatcgacgtctacccccagatgtgctttgacgaggacatcaatgacaaaatcctcaacagcaagttacgggaccgaatcccttttgccgtggtaggggctgaccaagagcacctggtgaacgggaggtgtgtcctgggccggaagaccaagtggggcatcattgaagtggagaacatggcgcactgtgaatttcctctcctgagagacctgcttatccgctcccacctccaagacctgaaggacataacccacaacatccactatgagaactaccgcgtcatcagactcaatgaaagccacctgctgccccgcgggcccggctgggtgaacctggccccggcctccccaggacagctgaccaccccccggaccttcaaggtctgcaggggggcccatgacgattctgatgatgagttctgaccaccggcggatcccggggctgctgggcttcctgagtccccagcggctctcaacacacacctatgtaccagagcatctattaaatgtgagccttgctttttatgaaaagctgtgctttgaaaacaaaaaca

SEQ ID NO: 729178 - DNA, 540 bp, Homo sapiens
tttttctatctcttcagtgcctctttcaacaatgaagatcaaaccaggttttgtgcaaatatctgctgagtgaactacttatttgaaaatacatcattggttaatattcccttttgctcattgaaatctcaaagactacagaccccgcacaagacattctgacattcccgtctttgaaatgaatgacagcaatgataaatatggctcacctccagagatacagatctcacaacttcatatttttaatataaattattaatctgaggtgtggtgcaattccattagatgaaagagatctacatattcagaagcacatgattcttcccccttccatgattccagtggccaataggtaatcagaacttctctgttcagctaaaagacagaaaaagagcatatgaaagacgtattttcccagaagtgctcatcctgataactgtgtacagcactactgctcatattccattggccaatatttaggtagataacttcactaactacaaggtatgctgggaaataaagtccagatatgtgtgacat

SEQ ID NO: 729179 - DNA, 789 bp, Homo sapiens
tttttctatctcttcagtgcctctttcaacaatgaagatcaaaccaggttttgtgcaaatatctgctgagtgaactacttatttgaaaatacatcattggttaatattcccttttgctcattgaaatctcaaagactacagaccccgcacaagacattctgacattcccgtctttgaaatgaatgacagcaatgataaatatggctcacctccagagatacagatctcacaacttcatatttttaatataaattattaatctgaggtgtggtgcaattccattagatgaaagagatctacatattcagaagcacatgattcttcccccttccatgattccagtggccaatagaatggagtgtagtggcgtgatcttggctcacaacaacttctgcttcccacattcaagcgatcctcccaccttatactcctgagtagctggaaccacagacaaactacaataaagccatgccctgactggatgtgcctaacatttgtctggtgcttaaaggagttggctgcatgcatgggatggagaaggattcaacatttaatggcagttagaatcaaatttttaactcaagaaggcagaaggaatccacctaaataaatgttggaaagtcaccaaaaatagttctccaagtcagaagcggtgcaaaagctgcctcagctcttggtggattttcaatttctcccagccatctctgtttcgctaaaggtttctgaagacagtgggtatgtggcaaacttctgcaattctatattaagataaactgttagatcaataaa

SEQ ID NO: 729180 - DNA, 691 bp, Homo sapiens
tttttctatctcttcagtgcctctttcaacaatgaagatcaaaccaggttttgtgcaaatatctgctgagtgaactacttatttgaaaatacatcattggttaatattcccttttgctcattgaaatctcaaagactacagaccccgcacaagacattctgacattcccgtctttgaaatgaatgacagcaatgataaatatggctcacctccagagatacagatctcacaacttcatatttttaatataaattattaatctgaggtgtggtgcaattccattagatgaaagagatctacatattcagaagcacatgattcttcccccttccatgattccagtggccaatagacaaactacaataaagccatgccctgactggatgtgcctaacatttgtctggtgcttaaaggagttggctgcatgcatgggatggagaaggattcaacatttaatggcagttagaatcaaatttttaactcaagaaggcagaaggaatccacctaaataaatgttggaaagtcaccaaaaatagttctccaagtcagaagcggtgcaaaagctgcctcagctcttggtggattttcaatttctcccagccatctctgtttcgctaaaggtttctgaagacagtgggtatgtggcaaacttctgcaattctatattaagataaactgttagatcaataaa

SEQ ID NO: 729181 - DNA, 859 bp, Homo sapiens
tttttctatctcttcagtgcctctttcaacaatgaagatcaaaccaggttttgtgcaaatatctgctgagtgaactacttatttgaaaatacatcattggttaatattcccttttgctcattgaaatctcaaagactacagaccccgcacaagacattctgacattcccgtctttgaaatgaatgacagcaatgataaatatggctcacctccagagatacagatctcacaacttcatatttttaatataaattattaatctgaggtgtggtgcaattccattagatgaaagagatctacatattcagaagcacatgattcttcccccttccatgattccagtggccaataggaattctaattggaacagacaaaaacccaatacatgtttaagcagtaaagtattcatcaggtcacaaaaagaggagcaagaggagctgactctttatgtcatatcttggccttgtaatttgattctttgccaacatgcatggtttttctccataggctgtgcattgggacaaactacaataaagccatgccctgactggatgtgcctaacatttgtctggtgcttaaaggagttggctgcatgcatgggatggagaaggattcaacatttaatggcagttagaatcaaatttttaactcaagaaggcagaaggaatccacctaaataaatgttggaaagtcaccaaaaatagttctccaagtcagaagcggtgcaaaagctgcctcagctcttggtggattttcaatttctcccagccatctctgtttcgctaaaggtttctgaagacagtgggtatgtggcaaacttctgcaattctatattaagataaactgttagatcaataaa

SEQ ID NO: 729182 - DNA, 1816 bp, Homo sapiens
cgcctgtagcaccacttagggagttatgtgctggaaccacacagaaaagcttcttgtagacactcaaggaagagaggggggtggacctgccttacccgactgtcctgctggaggtaacttctcttcctccccagcggtgcccaagcacaccctgtgcgggtccctcccttctgctctttctactttggccctccccacattcaacaacaggctctctatcagttattgtcagggaacagcaagacacaagcgattttgtcaaattcatgatcaaaaggctatgttacctgtgacagtgaccagaaaaatgacaggatgggggagcagccaggggttggagcaggaggaatctgactgtcctttgctactttctatcttcccttactcaacagcagtcaaagccaaagatgcgaagtcactcttacctctgatgataataatggtgataattttcttggtgcttctgttctgggaaaatgaggtgaatgatgaagcagtgatgtcaactttagaacacttgcatgtggactaccctcagaatgacgttcccgttcctgcaagtagtacagaaaatggctatattatagccattgttggaggggagaatttgtattgtgaggtagtaagaaataaggggcaattggcaaataaaggccagattatgttgtcactaattctgagctatggcatttcaatcctgtatgtgagagctagagactcatacagtgacctagagcaggcatgggtgggtcacaggctttggagagcactctctgtcctgatcttttcagttgagagacttcagctgttcattgctcatttggacttagttcaaggtcatgtcaaagaagaaggtgcacttacgctagttgttagctctgtcttttgtaaccatcaagttccatgcgattgatcagatttaggagggggcgttgggggataatcaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactgatactggc

SEQ ID NO: 729183 - DNA, 1055 bp, Homo sapiens
tagtacagaaaatggctatattatagccattgttggaggggagaatttgtattgtgaggtagtaagaaataaggggcaattggcaaataaaggccagattatgttgtcactaattctgagctatggcatttcaatcctgtatgtgagagctagagactcatacagtgacctagagcaggcatggaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactgatactggc

SEQ ID NO: 729184 - DNA, 962 bp, Homo sapiens
gtgggtcacaggctttggagagcactctctgtcctgatcttttcagttgagagacttcagctgttcattgctcatttggacttagttcaagaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactgatactggc

SEQ ID NO: 729185 - DNA, 1149 bp, Homo sapiens
agccccgtgccaggcaaggcgggtcaccgggcagcgtcggggccctcttctgcctcggggtctcttcacggagggcgccctgcggcgacagctttcgccggccgcgcgcacggcggtcggtacctgttaaggacgagatgccttccgaccaccggataactcgggacggtccctgatttgcctgctccctgtccaacagcatcttcgggtcactcggaagtgaaaacatgcaatttcatgttataacatgcaatttcatgtcataaattattcccactgacgcctgaacatttttcctaaaagggatctgcagtcacaaggcgccgccttccggaatttagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactgatactggc

SEQ ID NO: 729186 - DNA, 1097 bp, Homo sapiens
gtgggtcacaggctttggagagcactctctgtcctgatcttttcagttgagagacttcagctgttcattgctcatttggacttagttcaaggtcatgtcaaagaagaaggtgcacttacgctagttgttagctctgtcttttgtaaccatcaagttccatgcgattgatcagatttaggagggggcgttgggggataatcgtaagtgaaggacagtttgcaaccttaattttgggtgtcaccaggtaaacagagccctcagcatctgaatagaaactgaacaggaacagaagagattacactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactgatactggc

SEQ ID NO: 729187 - DNA, 827 bp, Homo sapiens; identical to SEQ ID NO: 728345

SEQ ID NO: 729188 - DNA, 398 bp, Homo sapiens
tgcgcgtccgctcccgccgttgcgacggacgggtaggggaggcgaccccggcgttctgctccgcactgtggaggaggtggggaggtgttgggccagggctgaggtaggagggagtctgtccctcgacgcctcctgcgacgccagcccctgagcgatgatgcgaacgtgcgtcctactctccgcggtgctctggtgcctcacaggagtccaatgcccgcgttttaccttattcaataagaagggcttcatttatggcaagacaggacagccagacaaaatatatgtagagttacatcaaaatagtccagtccttatctgtatggattttaagctttctaaaaaagaaatagtggaccccacctacttatggattgggcctaatgaaaagacgttaacag

SEQ ID NO: 729189 - DNA, 535 bp, Homo sapiens; identical to SEQ ID NO: 728348

SEQ ID NO: 729190 - DNA, 439 bp, Homo sapiens; identical to SEQ ID NO: 186291

SEQ ID NO: 729191 - DNA, 438 bp, Homo sapiens; identical to SEQ ID NO: 728349

SEQ ID NO: 729192 - DNA, 691 bp, Homo sapiens
cgccgcccacactgcagccaccagcgctccagccaacgccgctgccggtggctcccccgctcaccccgggtctgggccacaaggagtcagccctggctcccaccgcagcccctgctctgcccccagccttagccgccgaccaggccccggccccatccccggctccagctcccaccgtggctgagccctcgccgcctgtgtccgcgcccgcacccgcgctgcgcccatcaagacccgcacgcgcaggaacaagggttcccgtgcagcccggggcgcgacccgtaaggatggcttgcatggagatggtcctcgcgaacgagctacagctaccgtgcctgacagcagtggtggagggggtggtggcagcggggcctctcagactggggcagctaacacccgtgcgcgccactggctgcccttccaggtgcttaactcctgtccctgcaagtgttactgccaccaccagccacgccatcgccgcctgccacgcaacgtctctgcctggctgagcacatccaccaaccacctgggcgagccaccctgggttgccaccatcaagctgtccggctctctggtggccaagctggagcactacgacttgcaggccacccattccaactgagtgtagtcggctcaacaccctccaccttcccctccatgccaataaaataaccaatccagaaaaaaaaaa

SEQ ID NO: 729193 - DNA, 581 bp, Homo sapiens
tggagacttggaagccgccaccaccattaccttctgaacggcagccggcggaccgcagaatcactcctgctctggccacacccgcctgtgtccgcgcccgcacccgcgctgcgcccatcaagacccgcacgcgcaggaacaagggttcccgtgcagcccggggcgcgacccgtaaggatggcttgcatggagatggtcctcgcgaacgagctacagctaccgtgcctgacagcagtggtggagggggtggtggcagcggggcctctcagactggggcagctaacacccgtgcgcgccactggctgcccttccaggtgcttaactcctgtccctgcaagtgttactgccaccaccagccacgccatcgccgcctgccacgcaacgtctctgcctggctgagcacatccaccaaccacctgggcgagccaccctgggttgccaccatcaagctgtccggctctctggtggccaagctggagcactacgacttgcaggccacccattccaactgagtgtagtcggctcaacaccctccaccttcccctccatgccaataaaataaccaatccagaaaaaaaaaa

SEQ ID NO: 729194 - DNA, 316 bp, Homo sapiens
cccgggcccagggcgccgcggtctgaactctgctcggctggaggactcggtgcttaactcctgtccctgcaagtgttactgccaccaccagccacgccatcgccgcctgccacgcaacgtctctgcctggctgagcacatccaccaaccacctgggcgagccaccctgggttgccaccatcaagctgtccggctctctggtggccaagctggagcactacgacttgcaggccacccattccaactgagtgtagtcggctcaacaccctccaccttcccctccatgccaataaaataaccaatccagaaaaaaaaaa

SEQ ID NO: 729195 - DNA, 398 bp, Homo sapiens; identical to SEQ ID NO: 59272

SEQ ID NO: 729196 - DNA, 872 bp, Homo sapiens
gatttctcaacctggaatcatttccctacacctttcctcaaaggactgttaatgagttttcagagcaggtacttcactgaaatgtaactaccacaatgcatcctttccatgtgactaacttcgctcatggaccagaatcactgtggctctgccctggagtggtgcaaagagctcgcattctgtttggaaagcaaattatttaaatccagtagaggactctcaaatgtggttggaaaatctaagaagacttcccagaggcagcagcactagtgttagggaaagagctcacaaattccattgctgtagaacccatgtgttgaagaccgctacactggaatctagttttctatcctaaaatctacctcctgagtttgagtaagacttgaactagtttgcaaatatctgtgatcttcaccttgcctgcctgcaaagcccataagcaagttcagaagagacttctacttgtccaaagcaacatggagtaaagtgggtcaactagaattaaaatatgctccagccaaaggtgaccatggaaacctattgataaggctctggggtcagattcatctctgttcagacaactctagcggtgtgactctgagcaagtgttttttaacctaagttcctgcttcctcaactgcaaatgtaggaatggtaacatcttcctcaaagttgtatgctggggataacacatgaaggagatgcctgggccatataattatttaagaaatgttcatttctttcttgaactaccttctaccaactatttggtctgagtttatgaaactgtaaattttgtctaacatttgcctaacaaagcattattaccttgcttaaagaaacacacaatacattctaaaccaaaaataaaa

SEQ ID NO: 729197 - DNA, 739 bp, Homo sapiens
tccccaccaaaaacggcaaaatgtcatttttgggggcaaatctaaggttttccctacaattgttcaagctttcacactaaaacatttacctaaaaacgggcagaaattcagccttaaacccacaaatctcacgatggtatagaccctgggcccactcaggtttcctgaaaactaaacagttctggagttaggggtttggagaacgggctattgttaaagaaaaaagtatttagtgacacttgttaaagcacaaaaagagggctttattcaggaccatcgcaacaggtatagggaccactgactgcaatggagacttgcagtagggaaagagatattgggctcaactcctcatacagcatgggcaagtggagatttatagccaaggagcggtgacaggccaagataatgaggcatcacctgggggatggtggagactgaagaacctgatcagatattgaggatgatcagctatcaaggatgggggtttattgctaatctgacttagcaaagttctttgcttaaactggattttacaaagaaagtgtacagaagagcctagcagaagattcagaaacctgactaaagttggccaagcaaaaaaaaaaatctttgtatctgaagggatatgttatcctctggacaaattgagggggactgtgcgttaacaatcttagcagtcctcttcagttgtaccaccatctccactttaataaaaaaaaattttctttcaaatctggcc

SEQ ID NO: 729198 - DNA, 1564 bp, Homo sapiens
  misc_feature (1028)..(1028): n is a, c, g, or t
agcggggtgacgccatctggagcgcgcttggaatccagcaggcggttgctgccgcgtcttccacaacctccgcggtctggagctggcctcccccaccgccgccccaaccaccggccccgccgccatcaccaccaccgtcacctccgccgctgcctccttggggccctcctccttcaccgcccccttagccacctctacacattctaggctttctgtcctggagaagaagctataatcggtttccttgtgggcccggtgcgcagccatggcggacggtggcggcggcggcagcggcggtgcgggcccggcctcgacccgggccagcgggggcggcggccccatcaacccggcctcgttgccccctggcgaccctcagctcatcgctatcatcgtggggcagctcaagagcaggggcctttttgacagcttccgccgggactgcaaggctgacgtggacaccaagccagcttaccaaaacctgagccagaaagcggataattttgtgtcgacacatctggacaagcaggaatggaatcctccagcaaacgacaaccaactgcacgatggtctgaggcagagtgtggttcagtcagggaggtcagaagctggagtggacaggattagttctcaggtggtggatccaaaactaaaccacatcttcaggccacaaatagaacaaataattcatgaattcctggtggcccagaaagaagcagctgtgccagcactccctccagagccagaaggccaggaccctccagctccgtctcaggacacttcctaagaatatgcctgacagcttttgaaagcgctatttaatttttggtgaagaaatggattcggttacataagagtgcagtttcagattgaagataagccaagtcatcactgagctcaagatttccacctcgaccatgagcagtgaccagattgaaagggaagcaagttcgccagagagaaagttgaccgtggtacccccctgcattgcgctgccatttggccagcctttccaagggcatgacaccaancacacactacagagagggaaacactaccgcgacccaggattgtcctgaaacagacatctatacttgaacatggagactgcacatggattttagggtttgtgctctgagataaacgaaagctacagcgagagaacataaccaatcccaaagacaatttcaaagaacaatgacagtaaaggttaactgggaggaatatttgacagtacttatttgatattgtctctcagagttgcaaactagattgtacacaacattagtgtcagatagctttgaagttgtgaccttcttgtacatgaatcttctagccagtttcctttcctttgtaagagataacaaagcatgaaaccctagaatgagtgagaagttcagacattaggtataaggaaactcatttgcagactctctgtccaagaatgcttcctgtcttgcaggggctagtgagtcttgggtgtgtttatgttatgctcacatttgtgttttatttgaaaagtggatggtcaataaatggcttatctttcaactgcaacaacaaaaaa

SEQ ID NO: 729199 - DNA, 786 bp, Homo sapiens
ctcgttagaatcagacatggcttcaggggatgcaggacgctcccctgagctgcctgtcaccgactaagtggagcagtgtttcttccgcagactcaactgagaagtcagcctctggggcaggcaccaggaatctgccttttcagttctgtctccggcaggctttgaggatgaaggctgcgggcattctgaccctcattggctgcctggtcacaggcgccgagtccaaaatctacactcgttgcaaactggcaaaaatattctcgagggctggcctggacaattactggggcttcagccttggaaactggatctgcatggcatattatgagagcggctacaacaccacagcccagacggtcctggatgacggcagcatcgactatggcatcttccagatcaacagcttcgcgtggtgcagacgcggaaagctgaaggagaacaaccactgccatgtcgcctgctcagccttgatcactgatgacctcacagatgcaattatctgtgccaggaaaattgttaaagagacacaaggaatgaactattggcaaggctggaagaaacattgtgagggcagagacctgtccgagtggaaaaaaggctgtgaggtttcctaaactggaactggacccaggatgctttgcagcaacgccctaggatttgcagtgaatgtccaaatgcctgtgtcatcttgtcccgtttcctcccaatattccttctcaaacttggagagggaaaattaagctatacttttaagaaaataaatatttccatttaaatgtcaaaaaa

SEQ ID NO: 729200 - DNA, 415 bp, Homo sapiens
ctcgttagaatcagacatggcttcaggggatgcaggacgctcccctgagctgcctgtcaccgactaagtggagcagtgtttcttccgcagactcaactgagaagtcagcctctggggcaggcaccaggaatctgccttttcagttctgtctccggcaggctttgaggatgaaggctgcgggcattctgaccctcattggctgcctggtcacaggcgccgagtccaaaatctacactcgttgcaaatggaactggacccaggatgctttgcagcaacgccctaggatttgcagtgaatgtccaaatgcctgtgtcatcttgtcccgtttcctcccaatattccttctcaaacttggagagggaaaattaagctatacttttaagaaaataaatatttccatttaaatgtcaaaaaa

SEQ ID NO: 729201 - DNA, 734 bp, Homo sapiens
ctcgttagaatcagacatggcttcaggggatgcaggacgctcccctgagctgcctgtcaccgactaagtggagcagtgtttcttccgcagactcaactgagaagtcagcctctggggcaggcaccaggaatctgccttttcagttctgtctccggcaggctttgaggatgaaggctgcgggcattctgaccctcattggctgcctggtcacaggcgccgagtccaaaatctacactcgttgcaaactggcaaaaatattctcgagggctggcctggacaattactggggcttcagccttggaaactggatctgcatggcatattatgagagcggctacaacaccacagcccagacggtcctggatgacggcagcatcgactatggcatcttccagatcaacagcttcgcgtggtgcagacgcggaaagctgaaggagaacaaccactgccatgtcgcctgctcagccttgatcactgatgacctcacagatgcaattatctgtgccaggaaaattgttaaagagacctgtccgagtggaaaaaaggctgtgaggtttcctaaactggaactggacccaggatgctttgcagcaacgccctaggatttgcagtgaatgtccaaatgcctgtgtcatcttgtcccgtttcctcccaatattccttctcaaacttggagagggaaaattaagctatacttttaagaaaataaatatttccatttaaatgtcaaaaaa

SEQ ID NO: 729202 - DNA, 863 bp, Homo sapiens
ctcgttagaatcagacatggcttcaggggatgcaggacgctcccctgagctgcctgtcaccgactaagtggagcagtgtttcttccgcagactcaactgagaagtcagcctctggggcaggcaccaggaatctgccttttcagttctgtctccggcaggctttgaggatgaaggctgcgggcattctgaccctcattggctgcctggtcacaggcgccgagtccaaaatctacactcgttgcaaactggcaaaaatattctcgagggctggcctggacaattactggggcttcagccttggaaactggatctgcatggcatattatgagagcggctacaacaccacagcccagacggtcctggatgacggcagcatcgactatggcatcttccagatcaacagcttcgcgtggtgcagacgcggaaagctgaaggagaacaaccactgccatgtcgcctgctcagccttgatcactgatgacctcacagatgcaattatctgtgccaggaaaattgttaaagagacacaaggaatgaactattgaagtcctcagcacatgttcttcatggaggtcatctttccctggactgcttggctactttagaagtcaaatcaagactagaagtatgaaagccaatcacaatttcccaacaattaggatccatcattcaccatttggttggtccctgctgctaagaattccaaactacaagggaaaaagttaaactcagctagatttccctgcctgctcaagaccacaaccccagtggcaacataattcttggtgaggatgaaaaaacgaaatctatacttgccttgagaaagcattcatgcaaaataaagcccagattcataagtaatc

SEQ ID NO: 729203 - DNA, 515 bp, Homo sapiens
ctttcccaggcttcgttatctcgttctgaggaatacctgtcccagatcagtgcagaactcatggaggaggctttgtgcactgcttgctgccacttgaaccctgtgcccatcaaaaaaaagcagtcacaagaccaagcgactcagatatccaaacgcgcattcttcaccaagacctgaggcacagacacctggtgagtgaggcttcaagggagatgctctttgtcctgggagagagccctctcccctctcttccaccatctcctgctcggacagaaaccgtacctgcagcaaggcatacctcctgccaactcctggtgaaaagaacatgcctcaaaactactcttttgccactcgttaaccacttccgtttgtggggacctcctggtcatgagcagcatcatcccgaagccttcaaagtgttctggattcatcacaggaccctccagcctcagccagcaaggataccaccaggaatgaaagtgctttaataaagagacagggtgtgcaaaaaaaaa

SEQ ID NO: 729204 - DNA, 477 bp, Homo sapiens
ctttcccaggcttcgttatctcgttctgaggaatacctgtcccagatcagtgcagaactcatggaggaggctttgtgcactgcttgctgccacttgaaccctgtgcccatcaaaaaaaagcagtcacaagaccaagcgactcagatatccaaacgcgcattcttcaccaagacctgaggcacagacacctggtgagtgaggcttcaagggagatgctctttgtcctgggagagagaaaccgtacctgcagcaaggcatacctcctgccaactcctggtgaaaagaacatgcctcaaaactactcttttgccactcgttaaccacttccgtttgtggggacctcctggtcatgagcagcatcatcccgaagccttcaaagtgttctggattcatcacaggaccctccagcctcagccagcaaggataccaccaggaatgaaagtgctttaataaagagacagggtgtgcaaaaaaaaa

SEQ ID NO: 729205 - DNA, 647 bp, Homo sapiens
ttagaaggcttcatttgctctgagttatcattgagaactaaatggagaagaaaagaactgaaggcctgaagatatgtcatctgtagaaaagccccatccttctgcaggtggcctcttctcaagctttcttggcaaatcaagagcttctgccttttggaggacatcctcttgacctcccacccatatcagctcttagaggacattccacaggaacattgccttcttgtcctccagtattttttatggaaacagaaattaggttatcttccttatgctctagatggacatctgaaatcatcaaacccttgagagaaacagccctcattcttttatgagacaacctggaagaaaacaggactctgaagatttgtctccatattctctggaaagatgtactctgtttgcaataagagggagccacatggtttattagatggttattaattgagcattctgtgcaaagaagtttgtgccttagatttagaattccaccctcagttggaatacagatgatccctaacaagtcacatgaaaaaatgaattgtggagccagaagagtgagttcttggagaactaagggccagagacctgtgagcaagatttgataattttataaaaattaaaagacgatttgaaatgttaaaagt

SEQ ID NO: 729206 - DNA, 662 bp, Homo sapiens; identical to SEQ ID NO: 409205

SEQ ID NO: 729207 - DNA, 185 bp, Homo sapiens
aaaaggtgagctgaacttttctctgtctgaacatactttgggtttacaatgagacatttacgtatttgtataaatcggttatactctgagctaatgtgaacacaaacttggtataaatacagatgactccctctctgctgctgtgggaggttcaactgacacctggggctcagaccagtcttgtt

SEQ ID NO: 729208 - DNA, 830 bp, Homo sapiens; identical to SEQ ID NO: 728357

SEQ ID NO: 729209 - DNA, 776 bp, Homo sapiens; identical to SEQ ID NO: 383933

SEQ ID NO: 729210 - DNA, 1034 bp, Homo sapiens
agcggaatgtgagcaagccctggtggcagcgccaggtccagtgcagcccctccccacagcatgctgggggctaattctgatgtcatctttctgcagaaaaccattagaccatccctccagactgccaccctcaaagccgtctgcccaggccccatctgacactcttgacatctgcaggtcccagaccctatgatgtgtccactctggaggctcctcatcttcctcgggttgctggccttgcccttggcaccacacaagcagccttggcctggcctggcccaagcccacagagacaacaaatccaccctggcaagaattattgctcagggcctcataaagcacaacgcagaaagccgaattcagaacatccactttggggacagactgaatgcctcagcacaagtggccccaggctggtgggctggctaatcagcggcaggaaacaccagcagcagcaagagagcaggtccttcgataacaacatcgtaaagatgtgtgcacatatgagcatcgttgtggagttctggctggagaaagacgagtttggccggagggatctggtgataggcaaatgcgatgcagagcccagcagtgtccatgtggccatcctcactgaggctatcccaccaaagatgaatcagtttctctacaacctcaaagagaatctgcaaaaagttctcccacacatggtagaaagtcaggtatgtcctctgatcggtgaaatcctcgggcagctggatgtgaaactgttgaaaagcctcatagaacaggaggctgctcatgaaccaacccaccatgaaaccagccaaccctctgcatgccaggctggagagtcccccagctgacttctgctgatcagaaggaaagtccacatcttgcaaccttaagtctcccttagagtggggcttctgctaccctaaaaactttaccccaggctctgtggacataccatcctctcctacaataaactctagctctgaagggtgcacaggtccctcccacctgggccctggggtttaggtctagaagtcaga

SEQ ID NO: 729211 - DNA, 738 bp, Homo sapiens
agtggatgtctgttcatttattcatcagatattcattgagtacctagattgtaccagacattcatgggaggacggtgtaagggaaagactctggaatctggtgctctattgccatgtttctaatataaccagcacttattagctgtgtgaccttgggcaaggtctgagctacccctttgatgatcactgacaatgatacttctggcatggggctgagtgaggactaaaagactgtggaaagtatactcaacacatacctcctggctttaatattgcctggattgctctgttctgttctgtgcctctacctttctttctagggctatcccaccaaagatgaatcagtttctctacaacctcaaagagaatctgcaaaaagttctcccacacatggtagaaagtcaggtatgtcctctgatcggtgaaatcctcgggcagctggatgtgaaactgttgaaaagcctcatagaacaggaggctgctcatgaaccaacccaccatgaaaccagccaaccctctgcatgccaggctggagagtcccccagctgacttctgctgatcagaaggaaagtccacatcttgcaaccttaagtctcccttagagtggggcttctgctaccctaaaaactttaccccaggctctgtggacataccatcctctcctacaataaactctagctctgaagggtgcacaggtccctcccacctgggccctggggtttaggtctagaagtcaga

SEQ ID NO: 729212 - DNA, 1180 bp, Homo sapiens
agcggaatgtgagcaagccctggtggcagcgccaggtccagtgcagcccctccccacagcatgctgggggctaattctgatgtcatctttctgcagaaaaccattagaccatccctccagactgccaccctcaaagccgtctgcccaggccccatctgacactcttgacatctgcaggtcccagaccctatgatgtgtccactctggaggctcctcatcttcctcgggttgctggccttgcccttggcaccacacaagcagccttggcctggcctggcccaagcccacagagacaacaaatccaccctggcaagaattattgctcagggcctcataaagcacaacgcagaaagccgaattcagaacatccactttggggacagactgaatgcctcagcacaagtggccccaggctggtgggctggctaatcagcggcaggaaacaccagcagcagcaagagagcagcatcaacatcaccaacattcagctggactgtggtgggatccagatatcattccataaggagtggttctcggcaaatatctcacttgaatttgaccttgaattgagaccgtccttcgataacaacatcgtaaagatgtgtgcacatatgagcatcgttgtggagttctggctggagaaagacgagtttggccggagggatctggtgataggcaaatgcgatgcagagcccagcagtgtccatgtggccatcctcactgaggctatcccaccaaagatgaatcagtttctctacaacctcaaagagaatctgcaaaaagttctcccacacatggtagaaagtcagcccctggcctgatccttctctctgtgctgatggtccaggtatgtcctctgatcggtgaaatcctcgggcagctggatgtgaaactgttgaaaagcctcatagaacaggaggctgctcatgaaccaacccaccatgaaaccagccaaccctctgcatgccaggctggagagtcccccagctgacttctgctgatcagaaggaaagtccacatcttgcaaccttaagtctcccttagagtggggcttctgctaccctaaaaactttaccccaggctctgtggacataccatcctctcctacaataaactctagctctgaagggtgcacaggtccctcccacctgggccctggggtttaggtctagaagtcaga

SEQ ID NO: 729213 - DNA, 1142 bp, Homo sapiens
agcggaatgtgagcaagccctggtggcagcgccaggtccagtgcagcccctccccacagcatgctgggggctaattctgatgtcatctttctgcagaaaaccattagaccatccctccagactgccaccctcaaagccgtctgcccaggccccatctgacactcttgacatctgcaggtcccagaccctatgatgtgtccactctggaggctcctcatcttcctcgggttgctggccttgcccttggcaccacacaagcagccttggcctggcctggcccaagcccacagagacaacaaatccaccctggcaagaattattgctcagggcctcataaagcacaacgcagaaagccgaattcagaacatccactttggggacagactgaatgcctcagcacaagtggccccaggctggtgggctggctaatcagcggcaggaaacaccagcagcagcaagagagcagcatcaacatcaccaacattcagctggactgtggtgggatccagatatcattccataaggagtggttctcggcaaatatctcacttgaatttgaccttgaattgagaccgtccttcgataacaacatcgtaaagatgtgtgcacatatgagcatcgttgtggagttctggctggagaaagacgagtttggccggagggatctggtgataggcaaatgcgatgcagagcccagcagtgtccatgtggccatcctcactgaggctatcccaccaaagatgaatcagtttctctacaacctcaaagagaatctgcaaaaagttctcccacacatggtagaaagtcaggtatgtcctctgatcggtgaaatcctcgggcagctggatgtgaaactgttgaaaagcctcatagaacaggaggctgctcatgaaccaacccaccatgaaaccagccaaccctctgcatgccaggctggagagtcccccagctgacttctgctgatcagaaggaaagtccacatcttgcaaccttaagtctcccttagagtggggcttctgctaccctaaaaactttaccccaggctctgtggacataccatcctctcctacaataaactctagctctgaagggtgcacaggtccctcccacctgggccctggggtttaggtctagaagtcaga

SEQ ID NO: 729214 - DNA, 596 bp, Homo sapiens
aattgtgggagctaagaacataaattaccccacgacccagtttccagcatagcagtcaagtggtcagggaggcagaggtctgcagggaaggagaactcccagagactcttataatgaaaccccttcaccggcttcaactcatagcctatcttatagaacttcatctgcctcctctggacaggggattttttctttcagaccatccccaaatgggcattcaggccacacaagagtcctcacccccaacaattttgctcagagggagagcacaactacactagagagtcttcctagtttccagctaccagtcctgcagactctctaccaacaacggaggcatatgggattacccagtgggagagaagcatggaccacttctagatagatcatcttcaagatctgatctatacatgctgctgaaggatggactgtagcttccagtacgcattaggggtgatggccctggaaaatttactattaaatgttaattttcctttctattgaaaacaactgttggagacactgattttcagcttagtatatagatagtaaaataaagacgatgcccttttattgctacaattctatcactttta

SEQ ID NO: 729215 - DNA, 353 bp, Homo sapiens
ttaccccacgacccagtttccagcatagcagtcaagtggtcagtcggtcctcctcagcggaatctattccttatagagaggctggctttggtagcttgggacaaggaggcagaggtctgcagggaaggagaactcccagagactcttataatgaaaccccttcaccggcttcaactcatagcctatcttatagaacttcatctgcctcctctggacaggggattttttctttcagaccatccccaaatgggcattcaggccacacaagagtcctcacccccaacaattttgctcagagggagagcacaactacactagagagtcttcctagtttccagctaccagtcctgcag

SEQ ID NO: 729216 - DNA, 971 bp, Homo sapiens
accagtgggcattacttccccatcacagtcagtcggtcctcctcagcggaatctattccttatagagaggctggctttggtagcttgggacaaggaggcagaggtctgcagggaaggagaactcccagagactcttataatgaacttcatctgcctcctctggacaggggattttttctttcagaccatccccaaatgggcattcaggccacacaagagtcctcacccccaacaattttgctcagagggagagcacaactacactagagagtcttcctagtttccagctaccagtcctgcagactctctaccaacaacggaggcatatgggattacccagtgggagagaagcatggaccacttctagatagatcatcttcaagatctgatctatacatgctgctgaaggatggactgtagcttccagtacgcattaggggtgatggccctggaaaatgtatccctgcattgtttcctagtttcactctgtaccttatgctccccccatctttaccctattcacccttatcacctcccaggacagtggtcaggtcttacaaaaggctagtgcttcaggaagatgtttatatctcttccagaagacattggtagctcccctcatttcctacaatttggaacaaaggtcaaaaaaataattcttggcatcatgcttggttgggagttgggaatggggattgtgatggatcatatactcatcactgtttcatttctggatttcatttttagctttggatatactgtcccattgccaatgttaacgagcaatatctctgttcttttccttattatacttttttatttgtctattatttcctctatgcttagttactattaaatgttaattttcctttctattgaaaacaactgttggagacactgattttcagcttagtatatagatagtaaaataaagacgatgcccttttattgctacaattctatcactttta

SEQ ID NO: 729217 - DNA, 226 bp, Homo sapiens
gtgtggagtttccagaagaaacaaacagatctcctcatcgccttttataagcatagaattacaaagttagaaacagccatgcaggaggcacagcaagcactggtgagccaggacaatcggtcctcctcagcggaatctattccttatagagaggctggctttggtagcttgggacaaggaggcagaggtctgcagggaaggagaactcccagagactcttataatg

SEQ ID NO: 729218 - DNA, 805 bp, Homo sapiens; identical to SEQ ID NO: 728358

SEQ ID NO: 729219 - DNA, 283 bp, Homo sapiens
ctgcacgttctgtctgatgcgctgctcattgtagctcttggccaggaccacaacccttgccaaggcacaaaggactgggtcctccaagagcaccggggagttcgggtccacccatggttcttctcgatgggatcccagagcactataggcaaccagaacaatgtcttttgacttgcagaaatccagcagttttctctggttgaagtaaggatgacattccacctggttgcagacaggcttgtacttgagccctggcttgttgaggatcatctccagcagcctg

SEQ ID NO: 729220 - DNA, 361 bp, Homo sapiens
ctgcacgttctgtctgatgcgctgctcattgtagctcttggccaggaccacaaccccacgctgcagctggtagcgcagggcaatcagggctggggttcgcttgtgcttttttgccaaggcacaaaggactgggtcctccaagagcaccggggagttcgggtccaccctggaaggaaaggcagaaaggctgaggccctgaggctggcgatagtttgttaggcggctccctaaacagactaaggcgtccactctgcaccggagcttctcaagcgaggcccccgaacagcagcctcaacatcacctgggatctcgtcagaaatgcaaattcttccctcaccccaagtcagctgtgagtgaactc

SEQ ID NO: 729221 - DNA, 588 bp, Homo sapiens
aattttttttatcaaaccagtgttttaggtaaacttcctgtatctcttattaccatggttcttctcgatgggatcccagagcactataggcaaccagaacaatgtcttttgacttgcagaaatccagcagttttctctggttgaagtaaggatgacattccacctgcagacgagcaagatggaaaagcatcagataatccaaaagttacactaatattaaaatcaccaaagtaaaagaagctgaataatgtagagcattaaatttgaactgagaatattattgtcaaaaatgatctttttcataaaaataaattttatgcccctctctcctaagaaaatagaaatgctatttctgagcacaagcaactccatgaaccctatcctggtttctcaataactccgaccactagaaggagacacggccaatttcagagctgggatgaggaaccttcaactgggaaaaacaagttaactgatatcaaatacaacaatataaaaacaattgaattctggttaaaaaaagaagagctacaaaagatattttgattaagcaatgaaaaattaaaatatggaccggataccaaatga

SEQ ID NO: 729222 - DNA, 321 bp, Homo sapiens
ctgcagacgagcaagatggaaaagcatcagataatccaaaagttacactaatattaaaatcaccaaaaaaatagaaatgctatttctgagcacaagcaactccatgaaccctatcctggtttctcaataactccgaccactagaaggagacacggccaatttcagagctgggatgaggaaccttcaactgggaaaaacaagttaactgatatcaaatacaacaatataaaaacaattgaattctggttaaaaaaagaagagctacaaaagatattttgattaagcaatgaaaaattaaaatatggaccggataccaaatga

SEQ ID NO: 729223 - DNA, 381 bp, Homo sapiens
gcccacagccccgctcctcacctgcacgttctgtctgatgcgctgctcattgtagctcttggccaggaccacaaccccacgctgcagctggtagcgcagggcaatcagggctggggttcgcttgtgcttttttgccaaggcacaaaggactgggtcctccaagagcaccggggagttcgggtccaccctggaaggaaaggcagaaaggctgaggccctgaggctggcgatagtttgttaggcggctccctaaacagactaaggcgtccactctgcaccggagcttctcaagcgaggcccccgaacagcagcctcaacatcacctgggatctcgtcagaaatgcaaattcttccctcaccccaagtcagctgtgagtgaact

SEQ ID NO: 729224 - DNA, 470 bp, Homo sapiens
  misc_feature (120)..(120): n is a, c, g, or t
gccggggcggcgcgtgagacccacctgctccagagcctccgcccgcagctgtcggtgcctctggcctgcgcccaccccgcccgctcctcggggcgctttggaggaggcggcatcggcgcntcgcccaggggaatgaggctccaaaatgaatcacaactggcgggtctgacttcgggcctttgcagatgctgttcccctgcctggagcgcacttatcacaagatgcctcagcagcccccacacacctgggatgagtatcaggtgctttgttgatcccatgctgtgtgctcagggagacaaagcatgcacgcatggggctgtatccacctgcagcagctggtgaatgactgcagaaggcagccccagcccacatactgctacttcagtgtgactgccactcctctcactgagagtccgggggcgtattccttccccttgactgctctaacaaataaagaatggcagaagtga

SEQ ID NO: 729225 - DNA, 455 bp, Homo sapiens; identical to SEQ ID NO: 240547

SEQ ID NO: 729226 - DNA, 180 bp, Homo sapiens
cctgcctcagtgccacccacatgggagctgtggttaccagtctgcaggcagctccgggagaggctgacagagtgggcccccatgtggaagaaagaagctccaaaatgaatcacaactggcgggtctgacttcgggcctttgcagatgctgttcccctgcctggagcgcacttatcacaag

SEQ ID NO: 729227 - DNA, 977 bp, Homo sapiens; identical to SEQ ID NO: 52885

SEQ ID NO: 729228 - DNA, 806 bp, Homo sapiens; identical to SEQ ID NO: 52890

SEQ ID NO: 729229 - DNA, 481 bp, Homo sapiens
ataacattcaggatgtcatcttgaaagcagagaccaaggtcttcaccagagacagtctgccaatggcttgattttgcacttcccagcctatataacttatcatgccttttcttgcagatgaggtttatataactttccaagacaaggaagttgtgcaaagcctcacagctactaagaggctgggctgggactcaggattaacttcgtgactccaaagcccatgcacctctgcaagccacacgaatcaagcagcttctctaaacctttgaagtcctggaaagtaactcttctgcaatagaagcaagaatcctgtgagattgggatccatctagtactcttcaccatttggaacaactgcctccagagaatgcttctgacgcatcttggaagaacttggaataacctgaggaaatggtcgatttgctaatttaggaaaccaatgttcgatacgtgtgtgatcccaataaagctattaacaaaa

SEQ ID NO: 729230 - DNA, 461 bp, Homo sapiens
ataacattcaggatgtcatcttgaaagcagagaccaaggtcttcaccagagacagtctgccaatggcttgattttgcacttcccagcctatataactatgaggtttatataactttccaagacaaggaagttgtgcaaagcctcacagctactaagaggctgggctgggactcaggattaacttcgtgactccaaagcccatgcacctctgcaagccacacgaatcaagcagcttctctaaacctttgaagtcctggaaagtaactcttctgcaatagaagcaagaatcctgtgagattgggatccatctagtactcttcaccatttggaacaactgcctccagagaatgcttctgacgcatcttggaagaacttggaataacctgaggaaatggtcgatttgctaatttaggaaaccaatgttcgatacgtgtgtgatcccaataaagctattaacaaaa

SEQ ID NO: 729231 - DNA, 938 bp, Homo sapiens
gtggtaatgtggcagctgggaccatggccagcttcagtctgcctggcgtcacataagccagcccacagggtcctgcagcttgtcctttctggctggaagctctgggcatagcctgggactgggtctttccagagagggctgcagccagggccctgccagcctcgggggccacagcggctctcacaccagcatcttgctggataggagcagttccaggactctctgatcacacctgatcatcgtcactgccagaattcaaggtagctgcctgccatggctgagaggtgtgcctcagcttaacccactcagtgatggactccagtgcctgcaagaagtctcaccagagtaagaagtggaggatccaggcccaggagaattttgccaagaagtttccgtacaggttgtcgtggctgacagagcccgaccctgagcccctgcagccctgggaggtcacaaacgactcgaacacggtgcagctgcccctgcagaagaggttggtgccaacgaggtccatcccagtccgagggctcggggctccagattttacatcaccgtctggctcctgcccggcaccactaccagcaccatcaccacctccactgtgcaacctttgggaactcaagttgctgagtcgccgcttccccagacaactcgccttcctgctgtccacccggcacactgaggctgcctgcccccagaccagcaaggcggcagggctgtccaggggcctctcctagagactgggctctgtgtgtggccttcttattggccaccttctccttggcaggctctgggcagtagccacagagactttagtaaagggatcagccttcatggccatcatagaccgggagtggtttgtggtccccccaaaaagctacaccaagctaataaactgcgagttcccaccccacttccagctggaatgaaaaaattgc

SEQ ID NO: 729232 - DNA, 217 bp, Homo sapiens
gttgtcgtggctgacagagcccgaccctgagcccctgcagccctgggaggtcacaaacgactcgaacacggtgcagctgcccctgcagaagaggttggtgccaacgaggtccatcccagtccgaggggttggtgtgaggattaaaaagagcatgaatgtcacttctaggactttatcccaaatgtacactcacacaggtaagtaaatgctgttcact

SEQ ID NO: 729233 - DNA, 1791 bp, Homo sapiens
cctcttggccgtcgggacttgtactgttggtgactccgtctccttagacggtggagcctgcgtgacccagaaaggcctttttgtagggaggtcgaaatagaaacacttcagcccctcttcggcgagggaggttagttggtaaggtgcccattgttcacccatggaaacaggcctgccaagggccgccccgcagacagcacttgcctcggtgacctggcaggacgtgcggttcttgagatgagtggagaaacggactcccaggtccctctcgttcttccaacacagggacagctagagctgctccaaaaatataccctacttcttccacaaccttttgaagaggggaagggaaagaaggcggaatgcttacctgggagaggactggcggccacagagcagggctcaggaaagggcatgagctggggccctggtgaggaatgtgtgagaatgtatgtaggtggtctggatgtagttgtatataattttgcaatctatgggctaaatgacagatgtaacagccctcaaaacaatacagtcgtatcttttgcaaaggtcctaaggctaaggaatactcaaatagctggtaacacattatttctgggtgtgtctgtgaggatgtttctggaagagattagcacttgaatcagtagattaagtagagatcaccctcaccaacatgggtgagtgtcattcaatccattgaggacctggatagaacaaaaaggtgaaggaagggtgcatttgttctctctgcttgaggtgggacatccatcttcttccaccctcagacagctgtgctcctgattctcaggcctcgggacccagaccaggatttccatcagctcccctggctcgcaggccttctgacttctgactcaccatcagctctcctggatccagcttgccaatggcagatcgtgggactccttgccctctaatcgcatgaaacaatgcccacaagagaaaataaaagcagtcagaggagaatggagaatttcccctattccccagcatgtggagccatggactctgccttctcccagtcaagatggggcaggtctcactatgttgcccattctggtcttgaactcttggactcaagcaatcctcccacctcggacttccaaagtgctggaatcacaggcttgagataccatgcccagccaatttattgtggttaagtatatataatagaatttaccattttaagtgttttcaagtatacaattcaggggcacgaattactttcacaatgttgtccaaccatcaacactgtccacttctagaatttttcatcattccaaacagaaactgcatactccttaaccaatagcttccattctcccctgccccccagcccctagtagcaccattctactttctgtctctgaattcgactacgctgggtacctctataagtggaatcatgcagtatttattcctttgtgtctggcttctttcacatagcataatgttttaaagttaatactcaatacatcagcaaaatgatgccattaaaatgtaagtttctcatgttattcttgttaatcaagaagcatgaaaggccggactgcaaagcagttaagacacttattggggtcttaggaattgtgattcaggagaaacagatgtggtcaaaggccacattgtgttctgaaaaataaagtggaatagtaatttttaaaaagatgccgagggtgattacactagttgttttgaaagaattattgttggtagaggaggctggcttagtacatgagtccatagttcattggttgtagctgtttaggc

SEQ ID NO: 729234 - DNA, 433 bp, Homo sapiens
gctaaggaatactcaaatagctggtaacacattatttctgggtgtgtctgtgaggatgtttctggaagagattagcacttgaatcagtagattaagtagagatcaccctcaccaacatgggtgagtgtcattcaatccattgaggacctggatagaacaaaaaggtgaaggaagggtgcatttgttctctctgcttgaggtgggacatccatcttcttccaccctcagacagctgtgctcctgattctcaggcctcgggacccagaccaggatttccatcagctcccctggctcgcaggccttctgacttctgactcaccatcagctctcctggatccagcttgccaatggcagatcgtgggactccttgccctctaatcgcatgaaacaatgcccacagtatgtctcctattaaataaatatatatctaatc

SEQ ID NO: 729235 - DNA, 616 bp, Homo sapiens; identical to SEQ ID NO: 728359

SEQ ID NO: 729236 - DNA, 627 bp, Homo sapiens
cagtggacacagcccgtggtccccgaagccgaaggttgattggagctcttccagggcttccttcctgggccatggacccctctgaggccattcgcctctgttccagtttggctctcctggacccctctggatggctaggttgttcctcctcagtctgcattgattggagctgggaccgaagcccccattccaaaaccggaccaggagataggcaaacaagaagaagccacccaatgtgagaaagaaataagcaacgggggtgatgtccgtctttatgcccagcaaagccagccccagtaggaaggaggcgcagcacaggaggagaagcggcttctccagtctccccagttcttcaatctcaaataaatcatctgtagagtcccctccagttccgaaattctctctatgtcttggagtgtgtggaatagccaggaaaccagcccaggagctttgactcccagccattctgcaccttaagcaaaaaggaagttagccacacatggtggctcatgactgtagtctcagctacatgggaggcaaggcgagaggatctcttgagcccaggagttcgaggccagcctaggcaatgtagtaagaccctgttcttaaatttttttaaaaagcaat

SEQ ID NO: 729237 - DNA, 1612 bp, Homo sapiens; identical to SEQ ID NO: 409299

SEQ ID NO: 729238 - DNA, 796 bp, Homo sapiens
gaagaaattaaggccaaaagaccaccatcacctccaaaggcatgctctactcctggctcctgttcttcagggatgacaagtaccaagaatgatgtgaaagcaaacaccatttgcataccaaactatctggatcaggaaataaaaaaaaagagtgggtctcagctttgattcattctgagcttgccgagataaacctgttaactcatcacagaagaaacacctcaatggaaccagcagcagagactgggaagccacccacagttaaatcaccacccacagttaaattgcccccaaattttactgcaaaatcaaaagtgctgaccagagatacagaaggggatcaaccaaccagagtgtcaagtcaaggatctgaagaaaacaaggaagtaccaaaagaggctgagcacaagcctccactacttataagaagaaataatatgaaaatacctgttgcagaatatttcagcaaaccaaattctcctcccaggcctaacactcaggagagtggatcagcaaaaccagtgtcagcaaggagtatacaagaatacaacctctgtccccaaagagcatgttatccttcaacacaccggaggtagaagttctagactgggtgaattctttcatgaatatgagcttcacatttacatcatcaaattatttttcaaatgaatatttttggtattgaggaatcaagtggtcctctttatggtggcacatgtaaatctaaaaatacctgtatgtaatgctacaaataaatattactggaaatgatatttccatttgtagttaatacgat

SEQ ID NO: 729239 - DNA, 625 bp, Homo sapiens
cggagcgaccctctatggtcccgggcccacccgaaagcgttgttcgtttcttcctgtggttttgttttctcctccccccaactcggaaggcgtcctgtgacccccgggacctcaagagctgtaaccgcccctgtgtgtggtcgaggcttttgaaaccaaactctagcctctccaacctagaaactgcatactttccacaaaatttgagatttttgagaccctggtacttttcacgaagtcaccttaattatcaccaaaaagctcctgcaagatgggagtggttatactccatttacaggaaaggaaccaaggctcagagaagaaatgtgctccgttcaccgtgtgctcctcctcagccatcctggccgtgctcagtcatctgaccagctgacctccgtgttcccccactccctggggagctcctccgccttttggcttccaatgctattgctgcatgctgaagactcccgcattggtaactccagtctgactgtgggacataaatgttattgaactttagacttgtatatcgaactgattactcaagagctgcatttgcatgtgtaatggacatcccaaacctaacataccccccaaatgaattcctgatatctacctaaactgt

SEQ ID NO: 729240 - DNA, 540 bp, Homo sapiens
  misc_feature (283)..(283): n is a, c, g, or t
  misc_feature (354)..(355): n is a, c, g, or t
cacatggcgcgaatgctgggtggcaggttggggccagaccaatgctgctgacaaaaactctgtgaaaacggatctgatgaaagtgccaatggtcatcatggactgggaggagtgttcaaagatgtttccaaaacttaccaaaaatatgctgtgtgccggatacaagaatgagagctatgatgcctgcaagggtgacagtggggggcctctggtctgcaccccagagcctggtgagaagtggtaccaggtgggcatcatcagctggggaaagagctgtggaganaagaacaccccagggatatacacctcgttggtgaactacaacctctggatcgagaaagtgacccagctagnnggcaggcccttcaatgcagagaaaaggaggacttctgtcaaacagaaacctatgggctccccagtctcgggagtcccagagccaggcagccccagatcctggctcctgctctgtcccctgtcccatgtgttgttcagagctattttgtactgataataaaatagaggctattctttcaaccgaaa

SEQ ID NO: 729241 - DNA, 554 bp, Homo sapiens
cacatggcgcgaatgctgggtggcaggttggggccagaccaatgctgctgacaaaaactctgtgaaaacggatctgatgaaagtgccaatggtcatcatggactgggaggagtgttcaaagatgtttccaaaacttaccaaaaatatgctgtgtgccggatacaagaatgagagctatgatgcctgcaaggtaactagggggtacctccctcaccttataggtcctcaccctctgggaactgccagtgcaagggtattctctctctgctgcaaatagacaattctgagtctggaaaatgtatgggaattagggcctgcagccatgagaatgagtatgtggatttcagatcctctggagctgtgagtgagcaccctgggagtcaatatgctgcaaccctgcttaactatttctgatcttcttcaggtacactaggtaaaaaggacgccaaggcttttctcatttctgggaattctttttaaaaatccaaggaggatttggtatctatataagaagtcattttagttcattaacttagaaacctttgttgagcata

SEQ ID NO: 729242 - DNA, 1109 bp, Homo sapiens
ctttgttgtcgttgttttgttttttagagatggggtctcactatgttgcccaggctggtgtcaaactcctgagctcaagcgattccccccacattggcctcccaaagtgctgggctacaggcgtgagccgctgccctgccgttgtttttatggtctctggcctaagcctgtgcttttgatgtcatatgcaacccattgccaaatccattgccatggagcttttcccctgtgtttttttccaagtgttttatggtttcaggtcttatatttaggtttgatccatatcgagttactttttgtatatggtgttaggtaagggtccagcttcattcttctggctgtggatatccagttttcccagcaccagttgttgaaaagactttcttttccccattgaatggtctgggcacccttttcaaaaatcagttgaccaagtattacaaaggtttatttctgtgctctctattttattcccttggtggatgtgtctgtctacatggcagtaccacactgattactttcagctttggaatcagggagtatgtcatctgccattgaatgagtatccactgtgtgctaggccttgtgggtggagcggtgacttggacatcgtccctgctggtccagtgccctgccgtccccctgagtcttgactttattctggatagtggaggttggcacaaaaatatctcccagttaaaggaattataattcagtcacctgactattactgacaagtcaaaaaaaaatgactcagtgggtttagtaccaaggtagcagtgttccatttgatgattcagcatatagcaggttctcttagtgaacatttctctttgtgtattgtttttcccccacatagcaacgaagttagtttctaatgacttccattctctacttttatcagaagcagatttcacctggaatattctataaaccctttgaaaccctctattttagccatggtgtcttctaagcaaagtaattttcttgaacttaaataacaaattgatagttgaattaaccttttaaaataaaatgtaaagtgtagctaagaaatcattatttaaaggtattccaacgataaattatttgggatggggctggggagg

SEQ ID NO: 729243 - DNA, 544 bp, Homo sapiens
ggccacctaagatggaagaagccatgagatgagtaagcgttgcctactcacaaggttgcaaactgtccttcacttacgattatcccccaacgccccctcctaaatctgatcaatcgcatggaacttgatggttacaaaagacagagctaacaactagctaccttgcaggaacgggaacgtcattctgagggtagtccacatgcaagtgttctaaagttgacatcactgcttcatcattcacctcattttcccagaacagaagcaccaagaaaattatcaccattattatcatcagagattaagaagcagcaatgcccctcttgtggcaagagttggcagcgtgcggttggtatgtcaatgcatccaaggtccaagggcctggattgtctgccaaatgcttgggagttgtttgatcaggttgacatgctccaacagcattgtggactgggcccacacctacgctgaggtgaccaatgtctccaactgttggatctgctccaccttccagcagcagctgcggagagtttgccctggaacgcgtatc

SEQ ID NO: 729244 - DNA, 656 bp, Homo sapiens
tttatggtttaattcagtaaagattattttattgaagcagaataaaacaatcccaacccagcaatacaggaaggataaattaattaccagtggcttccccttccgctcaaggcattgccccatgtccacggtccaggtctgcctcaggcacagccagctccaatgccattgagagaagagatctcagactcgggagctgatcttgagttatttaacatagccaaggaaactatctggcctcaagtcatcacaagtgacaagaacaaacccctctgtgggggaatagtggtacctgcaggcagggtatcttgtgccttcaatgagctgacagactgtcattttgaactttgtctcactctgaaagcagaaaatggccgaaaggttttggcaagcaaccttcttgggagaaatgcaaataccattgatttttcgaggcctctcatggatgaagacatgctcctttttacaagtgtggtcaggttccctgataactctttgtatgatcatgtggttgcagtaccttgcaggaacgggaacgtcattctgagggtagtccacatgcaagtgttctaaagttgacatcactgcttcatcattcacctcattttcccagaacagaagcaccaagaaaattatcaccattattatcatcagag

SEQ ID NO: 729245 - DNA, 611 bp, Homo sapiens; identical to SEQ ID NO: 57041

SEQ ID NO: 729246 - DNA, 1672 bp, Homo sapiens
tgccgtagagtgctgaaggtcctgccaacggctctcttggcgtctcaacgttcggatcagcagcttttttccattctctctctccacttcttcagtgagcagccatgagttggactgtgcctgttgtgcgggccagccagagaatgagctcggtgggagcgaatttcctatgcctggggatggccctgtgtctgcgtcaagcaacgcgcatcccgctcaacggcacctggctcttcacacccgtgagcaagatggcgactgtgaagagtgagcttattgagcgtttcacttccgagaagcccgttcatcacagtaaggtctccatcataggaactggatcggtgggcatggcctgcgctatcagcatcttattaaaaggcttgagtgatgaacttgcccttgtggatcttgatgaagacaaactgaagggtgagacgatggatcttcaacatggcagccctttcacgaaaatgccaaatattgtttgtagcaaagattactttgtcacagcaaactccaacctagtgattatcacagcaggtgcacgccaagaaaagggagaaacgcgccttaatttagtccagcgaaatgtggccatcttcaagttaatgatttccagtattgtccagtacagcccccactgcaaactgattattgtttccaatccagtggatatcttaacttatgtagcttggaagttgagtgcatttcccaaaaaccgtattattggaagcggctgtaatctggatactgctcgttttcgtttcttgattggacaaaagcttggtatccattctgaaagctgccatggatggatcctcggagagcatggagactcaagtgttcctgtgtggagtggagtgaacatagctggtgtccctttgaaggatctgaactctgatataggaactgataaagatcctgagcaatggaaaaatgtccacaaagaagtgactgcaactgcctatgagattattaaaatgaaaggttatacttcttgggccattggcctatctgtggccgatttaacagaaagtattttgaagaatcttaggagaatacatccagtttccaccataattaagggcctctatggaatagatgaagaagtattcctcagtattccttgtatcctgggagagaacggtattaccaaccttataaagataaagctgacccctgaagaagaggcccatctgaaaaaaagtgcaaaaacactctgggaaattcagaataagcttaagctttaaagttgcctaaaactaccattccgaaattattgaagagatcatagatacaggattatataacgaaattttgaataaacttgaattcctaaaagatggaaacaggaaagtaggtagagtgattttcctatttatttagtcctccagctcttttattgagcatccacgtgctggacgatacttatttacaattcctaagtatttttggtacctctgatgtagcagcacttgccatgttatatatatgtagttggcatttggttcccaaaaagtaggatgtaggtatttattgtgttctagaaattccgactcttttcattagatatatgctatttctttcattcttgctggtttatacctatgttcatttatatgctgtaaaaaagtagtagcttcttctacaatgtaaaaataaatgtacatac

SEQ ID NO: 729247 - DNA, 484 bp, Homo sapiens
cagcgggaaaacacatagctggtgccaatcacacacacaccttctatggccacagtcaccacagtcaccatggccacccaagccaccagagccacagcctgcctaatcgcagacactagatctgtgacttcttggaagccacctaaccatggatggagacgcccctgcccccagcaaggctggctcacacacacgtctgttttctctcctatggggccatctatgcaggccagggtgagatgctgtgcccaaatccctactttcttaggctcctcacggggattatgggctctttaaactccatgagtggggtctgccacagaagatggcccctgttggagggagagctgggaggacacagcgcaggtgagatagaccctgaggcccctgaagacccaccaagagaagacagatgggagcaggcaagagccccacactgatgtcattgcctggaacggagccaataaagctttgtgtgccttca

SEQ ID NO: 729248 - DNA, 1272 bp, Homo sapiens; identical to SEQ ID NO: 61034
  misc_feature (1267)..(1267): n is a, c, g, or t
  misc_feature (1269)..(1272): n is a, c, g, or t

SEQ ID NO: 729249 - DNA, 2270 bp, Homo sapiens
gggcacattgcagattgttcgggtaaatttaaaatgctagagcatgccctacgtgatgccaagatggcggagacttgtattgtgaaagaaaagcaagattataagcagaaattgaaggcacttaagattgaagtcaacaaactaaaagaggacctcaatgaaaagacgacagaaaataatgagcaacgagaagagatcattcgcctcaagcaagagaaaagttgcctgcacgatgaattgctttttactgtagagagagaaaagaggaaagatgaattgcttaatattgcgaagtcaaagcaagaacgcacaaattcagaactgcacaatctgagacagatttatgtaaaacaacagagtgatctgcagtttcttaatttcaatgtggaaaattctcaggaattaatacagatgtatgactcaaagatggaggaatcaaaggctctggactccagcagagacatgtgtttatcagaccttgaaaataaccacccaaaagtcgatattaagagggaaaaaaatcagaagtcactgtttaaggaccagaaatttgaagccatgttggttcagcaaaataggtcagacaagagctcttgcgatgaatgcaaagagaagaaacaacagatcgatactgtgtttggggagaaaagtgtaattacgctgtcatccatattcaccaaagacttagtagagaaacacaacctcccttggtctctgggaggaaaaacccagattgaacccgaaaacaaaattacattgtgcaagatccacacaaaatcaccaaaatgtcatggcactggggttcagaacgaaggaaaacaaccctcagaaacacccactttatctgatgagaagcagtggcatgatgtcagtgtttacctgggcctgaccaactgtccaagttcaaaacatccagaaaagctggatgtagaatgtcaagatcagatggaaaggtccgaaatctcatgctgccagaaaaatgaagcctgtctgggcgaaagtggcatgtgtgactccaagtgctgccacccgagtaacttcataattgaagccccaggccacatgtctgacgtggagtggatgagtattttcaagccttccaaaatgcagagaattgtccgcctcaaatctgggtgcacctgttcagaaagcatctgtggcacacaacatgactccccggcaagtgagctaattgccatccaagattcccactctttgggttcttcaaaatctgccttgagagaagatgagacggagtcctcttccaataaaaagaactcacctacgagtttgttaatctacaaagatgcaccagcattcaatgaaaaggcttcaattgtgttaccctcccaggatgatttctcgcccacgagcaagctccagcgtttgctggcggaatctcgtcagatggtgacggacctggagctgaacacactgctgcccatcagccatgagaatctcactggcagtgccacaaatatttctcatctatgtggaaggcagaaagcagacaccaatactgaatgaatacttaaccgtaaaactgaaagaggattctagttcttcataaacggcacttaattccagctgggagcagaactagaaagttaatttttaaacatctacacttcattttcaagttaaccatttttgtgctgaagaaatattttcatgtgtaagaaagtagaccttattgtacatatagaaagttggaattatgctaagaatgaaaaagacttctctgtaaagatacggactacagttaaatgctagagaagctctttaaaaatgtgaatgtcaaatagagaaagaacccctgcatagaaagtgctgttttaactatctgatttttaaaaaatctgtgcatacatttaaattctaaacaatagcttatcagagtcagctcaaaatatatgagaaacagtattctctcatggttttagcttttgactttgctgtgtaaatagacataaggtgctttgatataaaatataaaatgtaactggaaaatagctcgaggtccttctgtcccaagctgagcagagccccatctttctgggtctatattagtcccacctactgacacaaacaaaagcttgctggaagatcgagttttagacgcatttttaaaaatcttaaagactaaaacacttccattttaacttgtaaagtaatttaattttttaaagattatactatatgcctctgtgtcttctctaaaagaatagatcaacttcagtccataaaagatatttttaatattaaagaaa

SEQ ID NO: 729250 - DNA, 427 bp, Homo sapiens
aagtcagaggtcccagaagagtcagctcaaaaaaatacctttgtcagttattgaaggaaacaaaaggcaacttcagtattcatcgtgatcacgaatttctcatctatgtggaaggcagaaagcagacaccaatactgaatgaatacttaaccgtaaaactgaaagaggattctagttcttcataaacggcacttaattccagctgggagcagaactagaaagttaatttttaaacatctacacttcattttcaagttaaccatttttgtgctgaagaaatattttcatgtgagtaaaataaggaaggaacgttcatcactttaaactgaacctggcaagttaatttcctcgggaatggggatgtatttttttaagcattgcagatatcaaagttctattgtgctgaataaatgcccctttgttaaca

SEQ ID NO: 729251 - DNA, 2079 bp, Homo sapiens
cagagacatgtgtttatcagaccttgaaaataaccacccaaaagtcgatattaagagggaaaaaaatcagaagtcactgtttaaggaccagaaatttgaagccatgttggttcagcaaaataggtcagacaagagctcttgcgatgaatgcaaagagaagaaacaacagatcgatactgtgtttggggagaaaagtgtaattacgctgtcatccatattcaccaaagacttagtagagaaacacaacctcccttggtctctgggaggaaaaacccagattgaacccgaaaacaaaattacattgtgcaagatccacacaaaatcaccaaaatgtcatggcactggggttcagaacgaaggaaaacaaccctcagaaacacccactttatctgatgagaagcagtggcatgatgtcagtgtttacctgggcctgaccaactgtccaagttcaaaacatccagaaaagctggatgtagaatgtcaagatcagatggaaaggtccgaaatctcatgctgccagaaaaatgaagcctgtctgggcgaaagtggcatgtgtgactccaagtgctgccacccgagtaacttcataattgaagccccaggccacatgtctgacgtggagtggatgagtattttcaagccttccaaaatgcagagaattgtccgcctcaaatctgggtgcacctgttcagaaagcatctgtggcacacaacatgactccccggcaagtgagctaattgccatccaagattcccactctttgggttcttcaaaatctgccttgagagaagatgagacggagtcctcttccaataaaaagaactcacctacgagtttgttaatctacaaagatgcaccagcattcaatgaaaaggcttcaattgtgttaccctcccaggatgatttctcgcccacgagcaagctccagcgtttgctggcggaatctcgtcagatggtgacggacctggagctgaacacactgctgcccatcagccatgagaatctcactggcagtgccacaaataagtcagaggtcccagaagagtcagctcaaaaaaatacgtttgtcagttattgaaggaaacaaaaggcaacttcagtattcatcgtgatcacgatttctcatctatgtggaaggcagaaagcagacaccaatactgaatgaatacttaaccgtaaaactgaaagaggattctagttcttcataaacggcacttaattccagctgggagcagaactagaaagttaatttttaaacatctacacttcattttcaagttaaccatttttgtgctgaagaaatattttcatgtgtaagaaagtagaccttattgtacatatagaaagttggaattatgctaagaatgaaaaagacttctctgtaaagatacggactacagttaaatgctagagaagctctttaaaaatgtgaatgtcaaatagagaaagaacccctgcatagaaagtgctgttttaactatctgatttttaaaaaatctgtgcatacatttaaattctaaacaatagcttatcagagtcagctcaaaatatatgagaaacagtattctctcatggttttagcttttgactttgctgtgtaaatagacataaggtgctttgatataaaatataaaatgtaactggaaaatagctcgaggtccttctgtcccaagctgagcagagccccatctttctgggtctatattagtcccacctactgacacaaacaaaagcttgctggaagatcgagttttagacgcatttttaaaaatcttaaagactaaaacacttccattttaacttgtaaagtaatttaattttttaaagattatactatatgcctctgtgtcttctctaaaagaatagatcaacttcagtccataaaagatatttttaatattaaagaaaaaatatgtttccttggtttctttttattttacaggagtaaaataaggaaggaacgttcatcactttaaactgaacctggcaagttaatttcctcgggaatggggatgtatttttttaagcattgcagatatcaaagttctattgtgctgaataaatgcccctttgttaaca

SEQ ID NO: 729252 - DNA, 1908 bp, Homo sapiens
cagagacatgtgtttatcagaccttgaaaataaccacccaaaagtcgatattaagagggaaaaaaatcagaagtcactgtttaaggaccagaaatttgaagccatgttggttcagcaaaataggtcagacaagagctcttgcgatgaatgcaaagagaagaaacaacagatcgatactgtgtttggggagaaaagtgtaattacgctgtcatccatattcaccaaagacttagtagagaaacacaacctcccttggtctctgggaggaaaaacccagattgaacccgaaaacaaaattacattgtgcaagatccacacaaaatcaccaaaatgtcatggcactggggttcagaacgaaggaaaacaaccctcagaaacacccactttatctgatgagaagcagtggcatgatgtcagtgtttacctgggcctgaccaactgtccaagttcaaaacatccagaaaagctggatgtagaatgtcaagatcagatggaaaggtccgaaatctcatgctgccagaaaaatgaagcctgtctgggcgaaagtggcatgtgtgactccaagtgctgccacccgagtaacttcataattgaagccccaggccacatgtctgacgtggagtggatgagtattttcaagccttccaaaatgcagagaattgtccgcctcaaatctgggtgcacctgttcagaaagcatctgtggcacacaacatgactccccggcaagtgagctaattgccatccaagattcccactctttgggttcttcaaaatctgccttgagagaagatgagacggagtcctcttccaataaaaagaactcacctacgagtttgttaatctacaaagatgcaccagcattcaatgaaaaggcttcaattgtgttaccctcccaggatgatttctcgcccacgagcaagctccagcgtttgctggcggaatctcgtcagatggtgacggacctggagctgaacacactgctgcccatcagccatgagaatctcactggcagtgccacaaataagtcagaggtcccagaagagtcagctcaaaaaaatacgtttgtcagttattgaaggaaacaaaaggcaacttcagtattcatcgtgatcacgatttctcatctatgtggaaggcagaaagcagacaccaatactgaatgaatacttaaccgtaaaactgaaagaggattctagttcttcataaacggcacttaattccagctgggagcagaactagaaagttaatttttaaacatctacacttcattttcaagttaaccatttttgtgctgaagaaatattttcatgtgtaagaaagtagaccttattgtacatatagaaagttggaattatgctaagaatgaaaaagacttctctgtaaagatacggactacagttaaatgctagagaagctctttaaaaatgtgaatgtcaaatagagaaagaacccctgcatagaaagtgctgttttaactatctgatttttaaaaaatctgtgcatacatttaaattctaaacaatagcttatcagagtcagctcaaaatatatgagaaacagtattctctcatggttttagcttttgactttgctgtgtaaatagacataaggtgctttgatataaaatataaaatgtaactggaaaatagctcgaggtccttctgtcccaagctgagcagagccccatctttctgggtctatattagtcccacctactgacacaaacaaaagcttgctggaagatcgagttttagacgcatttttaaaaatcttaaagactaaaacacttccattttaacttgtaaagtaatttaattttttaaagattatactatatgcctctgtgtcttctctaaaagaatagatcaacttcagtccataaaagatatttttaatattaaagaaa

SEQ ID NO: 729253 - DNA, 1450 bp, Homo sapiens
cagagacatgtgtttatcagaccttgaaaataaccacccaaaagtcgatattaagagggaaaaaaatcagaagtcactgtttaaggaccagaaatttgaagccatgttggttcagcaaaataggtcagacaagagctcttgcgatgaatgcaaagagaagaaacaacagatcgatactgtgtttggggagaaaagtgtaattacgctgtcatccatattcaccaaagacttagtagagaaacacaacctcccttggtctctgggaggaaaaacccagattgaacccgaaaacaaaattacattgtgcaagatccacacaaaatcaccaaaatgtcatggcactggggttcagaacgaaggaaaacaaccctcagaaacacccactttatctgatgagaagcagtggcatgatgtcagtgtttacctgggcctgaccaactgtccaagttcaaaacatccagaaaagctggatgtagaatgtcaagatcagatggaaaggtccgaaatctcatgctgccagaaaaatgaagcctgtctgggcgaaagtggcatgtgtgactccaagtgctgccacccgagtaacttcataattgaagccccaggccacatgtctgacgtggagtggatgagtattttcaagccttccaaaatgcagagaattgtccgcctcaaatctgggtgcacctgttcagaaagcatctgtggcacacaacatgactccccggcaagtgagctaattgccatccaagattcccactctttgggttcttcaaaatctgccttgagagaagatgagacggagtcctcttccaataaaaagaactcacctacgagtttgttaatctacaaagatgcaccagcattcaatgaaaaggcttcaattgtgttaccctcccaggatgatttctcgcccacgagcaagctccagcgtttgctggcggaatctcgtcagatggtgacggacctggagctgaacacactgctgcccatcagccatgagaatctcactggcagtgccacaaataagtcagaggtcccagaagagtcagctcaaaaaaatacgtttgtcagttattgaaggaaacaaaaggcaacttcagtattcatcgtgatcacgatttctcatctatgtggaaggcagaaagcagacaccaatactgaatgaatacttaaccgtaaaactgaaagaggattctagttcttcataaacggcacttaattccagctgggagcagaactagaaagttaatttttaaacatctacacttcattttcaagttaaccatttttgtgctgaagaaatattttcatgtgagtaaaataaggaaggaacgttcatcactttaaactgaacctggcaagttaatttcctcgggaatggggatgtatttttttaagcattgcagatatcaaagttctattgtgctgaataaatgcccctttgttaaca

SEQ ID NO: 729254 - DNA, 1390 bp, Homo sapiens; identical to SEQ ID NO: 461382

SEQ ID NO: 729255 - DNA, 597 bp, Homo sapiens
gtgaacttgggcaagtgacctaatcctctgcatttcatctctaaattggggagaatagaagcatctacttcatgtagtagccaggattagaagagatggggccacttgagggaaaagacctacccaagggcacataatctgtacatgagagagagccagatgtaacagactgagtactggacttggggttaaacagactgtgaatctttccaccccattggcaagttaccttggacaagttactttaatctccctgagcctcaatctgctcatctttaaaatggaagtcttaataatctcctcataggggattaaacaagaacatgagcacaccttttctaacacagtgtctgagatgagtagatgttcaaaataggggttcatttgcttctttgctctttggctcccacctttttttcaactgccccaaatctctttctgctcaccttttcttgttccatggggtctttacaccaccgtgttagcatgtgtttctgctacatggttacttcttttttagaagcaagtgagtgagggagggcccagtgggcagctcagaactcagtaataaaaccacacagaatccatctcaaaaaa

SEQ ID NO: 729256 - DNA, 331 bp, Homo sapiens
gtgaacttgggcaagtgacctaatcctctgcatttcatctctaaattggggagaatagaagcatctacttcatgtagtagccaggattagaagagggaggaataactgggccctggatagaatgtgatgaatgtatattcttaatgagaagtggaaataatttgtggttgagagctgtgcctcagatcagagtgacaggatacatggctaggctatattttccagcagattaagagctgcagcccaagactctgaaatatgaagaaaaaaggagaagatgacagcatatctttttaaagaaatattttccagccaaatggtgcagcagaga

SEQ ID NO: 729257 - DNA, 476 bp, Homo sapiens; identical to SEQ ID NO: 59685

SEQ ID NO: 729258 - DNA, 530 bp, Homo sapiens
ttgtgcgcgtggagtgagacagaaaacctggagcccgatctcccggccagcgactccctccttctgggtgtgcggctgaagactggaagcaggttgccttgcctgctgcaagcccgccgtacctaccccttctccgcgtgcgcccctccctgtgcctgcgcattaccggctagccggcggcgggcgctgcagcccctacgtgattctgcggctcactcccctcggatggtctttccacccccacccgccacccccaccgtaccaaatgctagctctgccctttcttctgtgtttttcccatcaagagagatggttgtggtcatgaagttcttccgatgggttagacgggcttggcaaaggattatttcctgggttttcttctggaggcaaaaaattaaaccaaccatctcaggacaccctgactccaagaaacactcattgaagaagatggagaagactctccaggtggttgagactttgaggttggtcgagctcccaaaagaggctaagcccaagttgggtgagtcccc

SEQ ID NO: 729259 - DNA, 278 bp, Homo sapiens; identical to SEQ ID NO: 728321

SEQ ID NO: 729260 - DNA, 354 bp, Homo sapiens; identical to SEQ ID NO: 728322

SEQ ID NO: 729261 - DNA, 590 bp, Homo sapiens; identical to SEQ ID NO: 728323

SEQ ID NO: 729262 - DNA, 562 bp, Homo sapiens; identical to SEQ ID NO: 728324

SEQ ID NO: 729263 - DNA, 662 bp, Homo sapiens; identical to SEQ ID NO: 728325

SEQ ID NO: 729264 - DNA, 2824 bp, Homo sapiens; identical to SEQ ID NO: 288696

SEQ ID NO: 729265 - DNA, 656 bp, Homo sapiens; identical to SEQ ID NO: 728327

SEQ ID NO: 729266 - DNA, 574 bp, Homo sapiens; identical to SEQ ID NO: 728328

SEQ ID NO: 729267 - DNA, 666 bp, Homo sapiens; identical to SEQ ID NO: 728329

SEQ ID NO: 729268 - DNA, 333 bp, Homo sapiens
ccctgggatactcccctcccagggtgtctggtggcaggcctgtgcctatccctgctgtccaagagttggcctgtgtggtcacggagtgggttaagagatgataaaaaaatctgctctgtacagatggcacacctggtcccaactaaaccctggggccctagaaagataagacatcccctcctcacaagcccctcctcaagagccccctcctcaagagcccatttataaaaactctgacattcttaactacaacttggcaatcttctcaggatccctctctaacagagacctgttctttccttttgcctattaaactcctgctccaaactcact

SEQ ID NO: 729269 - DNA, 479 bp, Homo sapiens; identical to SEQ ID NO: 67847

SEQ ID NO: 729270 - DNA, 1153 bp, Homo sapiens
agaatgccaagcccggggagaaggcgttccgggcctcaactttggcgtcgtgagattcttgtgaggcgtctgcctggaagccggcagcaattttgcttctttaaagagaaaaagaaggctagggactcagattcctggattctgagatccagaccagctcctcccagacctctccagaagaagccatgggaacccctcgtatccagcatttgctgatcctcctggtcctaggagcctccctcctgacctcgggcctagagctgtattgtcaaaagggtctgtccatgactgtggaagcagatccagccaatatgtttaactggaccacagaggaagtggagacttgtgacaaaggggcactttgccaggaaaccatactaataattaaagcagggactgagacagccattttggccacgaagggctgcatcccggaaggggaggaggccataacaattgtccagcactcttcacctcccggcctgatcgtgacctcctacagtaactactgtgaggattccttctgtaatgacaaagacagcctgtctcagttttgggagttcagtgagaccacagcttccactgtgtcaacaaccctccattgtccaacctgtgtggctttggggacctgtttcagtgctccttctcttccctgtcccaatggtacaactcgatgctatcaaggaaaacttgagatcactggaggtggcattgagtcgtctgtggaggtcaaaggctgtacagccatgattggctgcaggctgatgtctggaatcttagcagtaggacccatgtttgtgagggaagcgtgcccacatcagctgctcactcaacctcgaaagactgaaaatggggccacctgtcttcccattcctgtttgggggttacagctactgctgccattgctgctgccatcatttattcacttttcctaagaaggcacttctgggcctgggtctgaggacatcttttttgactgggagccttcttactgttgaggttcaacaagctgaggagtagatgggaatttgagggagaatacagagatactatgaacgtatttgacatttttaatacaatttctgctataatttttgtatgcagtaggcgttactaataaacatttctgctgtgatttgtgtatgtttcaaca

SEQ ID NO: 729271 - DNA, 1253 bp, Homo sapiens; identical to SEQ ID NO: 60176

SEQ ID NO: 729272 - DNA, 1157 bp, Homo sapiens; identical to SEQ ID NO: 728362
  misc_feature (435)..(435): n is a, c, g, or t
  misc_feature (447)..(447): n is a, c, g, or t
  misc_feature (450)..(450): n is a, c, g, or t
  misc_feature (464)..(464): n is a, c, g, or t
  misc_feature (472)..(472): n is a, c, g, or t
  misc_feature (494)..(494): n is a, c, g, or t

SEQ ID NO: 729273 - DNA, 1033 bp, Homo sapiens; identical to SEQ ID NO: 728361

SEQ ID NO: 729274 - DNA, 1069 bp, Homo sapiens
tcccatccccaccctgcacattcctagccctttgcagaatttgtcccaccccctggtcccctgttcaccccttgtagcaacccctgtttgaagctcctgggctgggctctgctggcctaggtgggtcctcctcacccttcactgagcctccctgaagcagaggggaaactgaggcactgaggggacatgtgacttccctgagaggcagagctgggactggaacccaggtgtgtttcaggaaggagctgtgggctttgagggaggaggcctgggtccccacagtccccccctcaagcctcagtgtccttatatgcaaaccagcagtcacagtggtgaccttttctgtgcatcctccctcaatgaagcagtgagcactgaagaccaggaacagggcctggtgcgggcggggtccacctgctgctgctctctgtgcttgcgactcatggcaacacagttaattgaatgctctggcctcttgcgtgctgtgcccgggggctggtctcccactgggctcaggtccagttcctgatctgggtctccgggtcccatcctgcgaggggacaggcccagctccgggtgacgggggctgtagtggaggcagtactaggtgccagaactgcaggctccttggcgggggctgacacagcgagggatcttttctgtagcgcagtggccacatgataaggcagtaacagctgattatctcagccctcacagagaccctgttatccgccccatttttcagaaggggagactgaggcctagggaagcaaaacctcttgctcatagtttgtcagcggcagaggtctgattggaacatgactgaaaccccagcccagatcctcagacatgagacggtgcactcagccttaatggctagcaggcaacagcacttccactgtgtaggaagcaatgtcctaggccaagaaggggagagggagaggggcaggtaggcttcgtggaggaggtgtctgaaccgggtagaagggttcctacgtggagcaagacggggaggggcactgctggcagtgggcatcgcagggcacaggtggcagggcagggacgtgct

SEQ ID NO: 729275 - DNA, 937 bp, Homo sapiens
agcggacaggccaggtcgtcaactcaactgtcaaggtgtccattgtaccagctgggccatggatccctcccgcctgaaatctgactccacctgccaagagtctgagcctgcaggcctagatttcgactctgctggccaagattatttctctgcagcccaataattcgactctttctaccaagaattggacctggactctcttaacgaagatcttctttcccagtccatgccacatgccaggacagagacctctgtgggcacatatgaatcccactcgacttctgaactggaggatctgacagagcccgagcaaagagagctcaaaaccaaactcactaaattggaggctgaaattgtaaccctacgccacgtactagcagccaaagagagacgctgtggggaactcaagaggaagttaggcctcaccgccttggtagggctgagacagaatctgtccaagagctggcttgatgttcaggtctccaacacctatgtgaaacagaagacatcagctgctctgtccaccatgggcactctcatctgcaggaagcttggaggcgtgaagaagtcggccacactcagatcttttgaaggtctgatggggacaatcaagtccaaagtctcagggggcaaaagagcttggccctgactgtctttcttctgcggagggtggggttgatctgctctcagttttggggtgtggggaagacccactccagattccggggagtgggaatgagccactcccagttctggagagtgaggatgaccatctccactttctggaaccagaatgagcccccttggtaaccttgcctggtactaaaccagtgcaaggacccccttcccttattacatttgcaactctgcccaacaaaaacaagcaagcaaaccacaatggtaaagtggttaattcaggaaattgacagaatccagt

SEQ ID NO: 729276 - DNA, 1084 bp, Homo sapiens
agcggacaggccaggtcgtcaactcaactgtcaaggtgtccattgtaccagctgggccatggatccctcccgcctgaaatctgactccacctgccaagagtctgagcctgcaggcctagatttcgactctgctggccaagattatttctctgcagcccaataattcgactctttctaccaagaattggacctggactctcttaacgaagatcttctttcccagtccatgccacatgccaggacagagacctctgtgggcacatatgaatcccactcgacttctgaactggaggatctgacagagcccgagcaaagagagctcaaaaccaaactcactaaattggaggctgaaattgtaaccctacgccacgtactagcagccaaagagagacgctgtggggaactcaagaggaagttaggcctcaccgccttggtagggctgagacagaatctgtccaagagctggcttgatgttcaggtctccaacacctatgtgaaacagaagacatcagctgctctgtccaccatgggcactctcatctgcaggaagcttggaggcgtgaagaagtcggccacactcagatcttttgaaggaaaccctaaaggagaaggaagcagaatataaccctctggagagctcaagacagtaggaacctggacggtgcttgtttgaattttctgatatctgattttcacacgaatatactttttgtttgttttccttttccattttcaaaatgccaagatctgggagcctctttcactcctctagacacactgcctgagatagaagtttgcatcttattggctgtgggcagagactaggacccttatgggtacatttcagtaatctctcactgcctaaaatggtaatccctccagcctaagaggatgattctgttttgttgactcttgaatgctcccccaacattcctttggttttcctataagcaaaaccaaataccactataaatacaaaagcatctggtaaactgtaaagttactcatgtatcccaaccctccacagatttctgaagacaaagttttgcttggattaaaacaagatgttttactattaaaaaaa

SEQ ID NO: 729277 - DNA, 845 bp, Homo sapiens
agcggacaggccaggtcgtcaactcaactgtcaaggtgtccattgtaccagctgggccatggatccctcccgcctgaaatctgactccacctgccaagagtctgagcctgcaggcctagatttcgactctgctggccaagattatttctctgcagcccaataattcgactctttctaccaagaattggacctggactctcttaacgaagatcttctttcccagtccatgccacatgccaggacagagacctctgtgggcacatatgaatcccactcgacttctgaactggaggatctgacagagcccgagcaaagagagctcaaaaccaaactcactaaattggaggctgaaattgtaaccctacgccacgtactagcagccaaagagagacgctgtggggaactcaagaggaagttaggcctcaccgccttggtagggctgagacagaatctgtccaagagctggcttgatgttcaggtctccaacacctatgtgaaacagaagacatcagctgctctgtccaccatgggcactctcatctgcaggaagcttggaggcgtgaagaagtcggccacactcagatcttttgaaggattgatcttcaataaatacacgttaaatcaaggaaggaattaacatcatatacttcagacatcaaatatggaatccaagagactatcaacaacatgaacttgttcacaagttccttctgcttttaaacaaaaatatcgtgtttattcaaagccaatctgagaccctactctgtatcaagaactgtcccaggttctgaaagcatagaattagacatcgtatgtgccctctagaaacacttagactttcaaat

SEQ ID NO: 729278 - DNA, 690 bp, Homo sapiens; identical to SEQ ID NO: 67461

SEQ ID NO: 729279 - DNA, 541 bp, Homo sapiens
gcccagaccacagatgaaattgtgcaatatgtggaacaaacacctaaacaatatataacaccttccttggctctgtctacaaagggcacttttatatatcactgggaccatcaaccaggtgatgttgtgccatataactgagaccgtatcaaaagcctaataacaagacgtatgtctggagccccgatatgcacaggatggtgatataaccctcttctctggaatgggccccacacaaaggaaggatagtgacatattgcaagcccaggcacacaggcccagagcacagttgaaattgtgacatatgtacaccaagcaaccaagcaatgtataacacctcatttggcaatggaatcgagggcacttttacatatcactgagaccagcgcccagctgatgtgaaatattggcctgaaccctgcctacaaaagcattgtggcttttatctagctccattacataagtgatgtgacttccttctactgccttggccctgcacttatggtgaatcgtgacacaaaattgggtagagcaaccaggt

SEQ ID NO: 729280 - DNA, 459 bp, Homo sapiens
gcccagaccacagatgaaattgtgcaatatgtggaacaaacacctaaacaatatataacaccttccttggctctgtctacaaagggcacttttatatatcactgggaccatcaaccaggtgatataaccctcttctctggaatgggccccacacaaaggaaggatagtgacatattgcaagcccaggcacacaggcccagagcacagttgaaattgtgacatatgtacaccaagcaaccaagcaatgtataacacctcatttggcaatggaatcgagggcacttttacatatcactgagaccagcgcccagctgatgtgaaatattggcctgaaccctgcctacaaaagcattgtggcttttatctagctccattacataagtgatgtgacttccttctactgccttggccctgcacttatggtgaatcgtgacacaaaattgggtagagcaaccaggt

SEQ ID NO: 729281 - DNA, 729 bp, Homo sapiens
gtactactcaggaagtctggaggctaagtcaacacatcatgaaactctaggactaattcacactgcaacaaaggggctgattagagcttttgaagatggggggatagattctgtgatggaatgggaagtggatgaagtgctgaactggacaaatacactgaactttgatgaagacacaaaaaaaatggagaaaagcctggttctagaaaataatgcatttctactctacaaatcttcctcatttgtttacttacattattgaggacttcatgaaatcctaggcctcccatcatcttggtccccattctagcagccaattggtacataagaggcaaaaatttatatgttggaatcttcattccgtctctctaccattaaaaaaaagacacaaaattaagaaacaaggtatttcaaatattctcacatctaagcaagtaagttattttaagacagtgctcctctattagcacaagtggttaacaaaacttcactaactatattgttttccttcatttcttttcttatctgaaggtctttctaatgggtactctagattaatgcattggtaaatcaaaatatttggtcctaaattaaactggattcagaactagaatacttactgtttatattccaaaaaatctaaggaagacaaatgtgatctgagtgtgactgtgatcttgattcctgagaagtcagtgtacaataaaatgaagtaattgcttttcccca

SEQ ID NO: 729282 - DNA, 499 bp, Homo sapiens
tttttttctccagccctcttgcctgagcaatctgacgcagaggcacatgaggaatcagcacggaaccatcgacccacagggttaatcccaatgtcaatacctgctagatgtcagggatcccctgggctgctggcgagccatttgaaatgacccatctcctgccaccttggcctgctcctctgggccacctctctccacctgcacttgcttaccggaagacggcaaggccaccggtgcacttcgcagtgccaggagaaaggcgcctcatgctattagctcaaataaggaaaatcatgccgggaagattgaattttctgcagacttgtttaacctggtgatttctgagcacttggcgctggcagccacgggggagtgggctccagccggcactttatcagccacttctcaggactattcctaagcttattaaatcagcatgagtcactcccttgccttcctcacaagcatgaatcacgaatcatcaaaacccaagcaaaat

SEQ ID NO: 729283 - DNA, 685 bp, Homo sapiens; identical to SEQ ID NO: 318917

SEQ ID NO: 729284 - DNA, 522 bp, Homo sapiens
ccaggtgagtgcacgcagtggctcttgaagaggggtcctggggccggcagcacctgcattccccgggggtcttgtcggaaaggcacttgccccgcgtggccacaggacctccaggaccgctagagcagccgcaggtaggagggggcggagtagttgaaaagcaggaagtccatcttgtagaggtcgaagaggcgccgctggtagaaggggctgatgtcccggaagaggcgcgctgccaggtcgcgggaggcggcggctccccggggccgcggcggcccagggaagctcaggtcggatgcgcccgccaggcccagcacgaaggccgcgtcctccgccagcgtctcgaacttgcccacgacgtcgtagcggaggcgacacgggtggcagagcgcgtgcgcgcgctcccagtgctcgttgaagggctcctcacgccgcgtgcgcgggtccagcaggtaggccaggaactccgcgaagcgcacgtcgtggccgcgggcccgggcgtcggggagcgcgcgcggccgc

SEQ ID NO: 729285 - DNA, 645 bp, Homo sapiens
ccactgcccagagcaggtcaccgtgaacaaagccagggctccagcgttctctatgggcatccgccactcgaaacgggccagcaccatggccgccaccacgccctcccggcctgcggggcacaggctgcccggccgctgctgctaggccaggcctgtttcccacacagtgaacgggggctggcgggcctctcctggggcctggctttggctggaggggctagaaggcgagaggggctgggaaaggagtcttccctcccctttcctgaactgtccaggtccttctaggacacctgatccttccagtccctgggggctgtgacccatggccctgtgcagggtacagggtgagtctccttccagtgccccagtttcttccaggtcacgccaggccaggccaggccaggtggggaaagggacaccttccggccctccccagtagctggctggagatggagcttcttgtgtcccagaactcggcgtccagctccactagggcctggatccccatcacagcttgggttagccccggtcccagcccaaactcaggctggaggcagccccgaggcctgtgcctttcccactccaccttctacagttgcttagccaataaacctttcctgggctggagagctgtcagcatcaaaa

SEQ ID NO: 729286 - DNA, 984 bp, Homo sapiens; identical to SEQ ID NO: 462680

SEQ ID NO: 729287 - DNA, 488 bp, Homo sapiens; identical to SEQ ID NO: 462681

SEQ ID NO: 729288 - DNA, 572 bp, Homo sapiens; identical to SEQ ID NO: 462682

SEQ ID NO: 729289 - DNA, 454 bp, Homo sapiens
ccgggctttcctgagctgtggcccggcagggaagatcgcctggacgtggagccagcatcgccccgtgccctcggcgtttgcatttgtaaacttgtggtcttcctatgtgtcagaaacaactgtgtcttgggggggaagaccctcgctgcgccgcttcccgccgcagcgcccgcgcctccgaggggacagcgccctctggagctcgctgggagcatcaccgcctggacgcccgcgccgcggaggagccggcgcccatctccacccgcacggctcgccggtccagagccatgagccaagagccctcttcacgctgctaactccaggggacagacgaagggacatctttggaaaacgctggttttggtttttaaaaagcccaactttttttttttaatttccataactaaagtgttcagactggagtgctctccttcaggcctcttcatagctggga

SEQ ID NO: 729290 - DNA, 422 bp, Homo sapiens
ccgggctttcctgagctgtggcccggcagggaagatcgcctggacgtggagccagcatcgccccgtgccctcggcgtttgcatttgtaaacttgtggtcttcctatgtgtcagaaacaactgtgtcttgggggggaagaccctcgctgcgccgcttcccgccgcagcgcccgcgcctccgaggggacagcgccctctggagctcgctgggagcatcaccgcctggacgcccgcgccgcggaggagccggcgcccatctccacccgcacggctcgccggtccagagccatgagccaagagccctcttcacgctgctaactccaggggacagacgaagggacatctttggaaaacgctggttttggtttttaaaaagcccaactttttttttttaatttccataactaaagtgttcagactgga

SEQ ID NO: 729291 - DNA, 895 bp, Homo sapiens
cccactccttcgccatctaccaccaaagcctcttccggatcctcaaggtcttcaagagcttgcgggccctgagggcaatccgggtcctgcggaggctcagcttcctgaccagcgtccaggaagtgacagggaccctgggccagtccttgccgtccatcgcagccatcctcatcctcatgtttacctgcctcttcctcttctccgcggtcctccgggcactgttccgcaaatctgaccccaagcgcttccagaacatcttcaccaccatcttcaccctcttcaccttgctcacgctggatgactggtccctcatctacatggacagccgtgcccagggcgcctggtacatcattcccatcctcataatttacatcatcatccagtacttcatcttcctcaacctggtgattactgtcctggtggatagcttccagacggcgctgttcaaaggccttgagaaagcgaagcaggagagggccgcccggatccaagagaagctgctggaagactcactgacggagctcagagctgcagagcccaaagaggtggcgagtgaaggcaccatgctgaagcggctcatcgagaaaaagtttgggaccatgactgagaagcagcaggagctcctgttccattacctgcagctggtggcaagcgtggagcaggagcagcagaagttccgctcccaggcagccgtcatcgatgagattgtggacaccacatttgaggctggagaagaggacttcaggaattgaccccaggaggacaccagatacagacttcagcccctggcagtctgcccacctgggtgcactgggacgggtccccagatctgctggaatgattgtccggggctgcagagcaggggccccaacagagtttttaaaccccaaaaagc

SEQ ID NO: 729292 - DNA, 561 bp, Homo sapiens
gttaaaaaaagggagaaggactcatcaacacattgctgcctgcaaacccagggaaagaccaccttacaccacattatatggcatctgtaaatcaacatgggccagcgggagacaccaaggccctaccaggagctgctctttgatcacgaggttcacgctgcatcttttcgggaaggttaaaaaataataaatgaccaccaggatcacagaaggaaagagctcgtgatgtccatggaattcacgcagatcacatccaggaatctttggaacaaaaaattcacaacaccatggcctcatacaaaaatgctgggctgcaggaaacctgaggcagagagctccatcatcacagtgaagtccccgccttcagcagatcccaccaacagccacagtgcttcccatcacctgaaaaaaactcatgtatcaaactattacacttcttcagaatattggaaaatggtgcatagttcatatgttctcatttgtttatcttgtgtccaaagtgtcttgtcattccaggccactctatttcttgtgtattaataaaaagtttgaggtataaaa

SEQ ID NO: 729293 - DNA, 605 bp, Homo sapiens
aaaagacattaattgtgacgtgatgattcacagagacgacaagaaagaagtgagggccccttctccatactggataatggtgaagcaagacaatgaaagctcttcctcctctacctcctctacctcagatgcattttggctggaagattgtgcccaagttgaagagggtaaagcccaactggtatcaaaggttggttagcaaatctgtggtcatatgagcatttatcttgcagacacccaagttttgtgcctcaccaggcacaagtttgctgtacttatcaaggactgtctgtagactcaccaattctcttctcttatgactgcgttataaagcctttagagatgttcttcaacaggattatctaaagacttccttgggttcttgcaggcctcacaaatcttattttcagaataagaccctcctttttgagaagaatttctttcttttagaaaatgccgtagagaaatccaatatcagaatgtctgaacatagtagagaatgtcactttatgtaaacactacatttttctttaaatatttagtttctctcttttttttggtaaacttcaagtactataattaaaataactaagagacataaaaat

SEQ ID NO: 729294 - DNA, 1837 bp, Homo sapiens
tacactaagcatggcttccagttgggtgggctggcaagatgagtacaatgtcctctcctgagatctggatgctgcatctgttaatgaagcgacagaccacttataagccaccaggtcacttcctgactcgttctaaatccactaaactcatggttccttttcaagccctcaattccacttttgcctccagttctcagggattagacaacccaagcagacaggctacaggaaatagcagattgggagaggagtgggaacaggagaagctgtctttggctcggctggaaggtgaagggattccagatgccggttcctggcttgctccccgctctccatttggcttcatcctggggctctcttcctccccacagaggggtggtgggcactctgtgccacacctctcctctctgggatctcaggtctgtccctgaaacctgctggtagaagaacctctagagtccttgcctccttcccaccgtgtgaccattgcccattggcacatctgtcaagacacagatttttggaagaaaaaagaaagagtgaatgctgcagagatggattgttaattttccaaatgagatatgactctgagatcccacctacccagctggtaggacgttccaccatgctccctaaggtggtttgagtgtttggaatgacaaagactctctcatcaccctgaaaccttagtccggcggcgcctctgagtcttctgcttgacgaggcctgaccttgggcttccccatgtcctttcagaatccagtttgagcaagaatcctgctaagtcagatggagtctcgctctgtcgcccaggctggagtgcagtggtgcgatctcggctcactacaagctccgcctcctgggttcccactattctcctgcctcagcctcccaagtagctgggactacaggtgtctgccaccacgcccagctaattttttgtatttttagtagagatggggtttcaccgtgtcagccaggatggtctcggtctcctgaccttgtgatccgcctgcctcggcctcccaaagtgctgggattacgggcatgagccacagcgctcagccctaatttttgtatttttagtagaaaaggggtttcactatgttggccatgctggtcttgaattcctgaactcaggtgatccgcccaccttgacctcccaaaatgctgggattacaggcatgagccaccgcacctggtttcttaacattctttgccacctcctctgctatatctatttactttgtatccaccagatcgaaagctcaggtctaattccctgtacctagaatattgcctgtagtgtagtaggcacttaaggttttgttgagtgagagaatgaataaacaaacagaaggatttgcttttcaaaccagagcctccctgcctcctgctctgcctgctaaggatcaggaggagacagcagctaaggaaggcagtcctgaattttccctagggatagggagtaagtggggggatccctgagaaacgctggaagcacccactctgctgccaaggctgcgaggaaaacaggccagagtatcctaacagcctccactcagaaggggcctggaaacttttaaccagacaaaataacaaatgcagtggtttagggcttggtggggcttcccacccgtcccacccctgtcccacacacctaggcccacattgaatgccctcagcacctccggctgcacaggggcctgttttccctgactctgctgctgttcacagaaccaacttcctcccaccccacacagacgctcccttcccagagctcattgggaaccttctgatttgcatctccaaagaaataaaataaattccactaaat

SEQ ID NO: 729295 - DNA, 808 bp, Homo sapiens
ggccccactccaccagccggccccgcgggacggttactctgttcctgaggtaccccccgagattgtctgtggggtcagaaacagctctggaggggtctgcagaaattactttcccaagtctttgggctggaaggaacgaacagtgcctgaccaaggactttgagcaggagagagatgggagcagagaggagccaaggtctactattttcacttctgtcaattagatcaaagccctgcccagaagctttgagcgccgctgtcaagtcccattcctcccctaaaccatccaggttccatctgccttgaagccaaaggatcttcttagattcctcaagaaaaattcaggccccgagtttctccaccagcactctcctctccccgaaggagtgggtgggctgcatttctcttcatattctattccattccagaccgtcttggactaccagcctgtccgccacccctcggggccctccctcctactctgcccttgcccgctgaggtcccaagctgaggagatgagccgagcagtaaaaagagaggaggtttggaaaagcaatgtcctctcagtctttaataggtggcccccctgggaacctgctggaagtggaagttaataagctgaaggtggtcacaaccaatctctgccacactcgcaccctaccccaccccaaatcattccttttaattaatagtggaagacctttttaaaaatgtaacatgaattggctatttcttgaggcaaacaaaaggtggctctgaagcgatatatttgtactcgtataaattcattaaaatagaaagcttataa

SEQ ID NO: 729296 - DNA, 532 bp, Homo sapiens; identical to SEQ ID NO: 299230

SEQ ID NO: 729297 - DNA, 1884 bp, Homo sapiens; identical to SEQ ID NO: 67097
  misc_feature (1872)..(1872): n is a, c, g, or t
  misc_feature (1876)..(1878): n is a, c, g, or t
  misc_feature (1882)..(1884): n is a, c, g, or t

SEQ ID NO: 729298 - DNA, 1790 bp, Homo sapiens; identical to SEQ ID NO: 67096
  misc_feature (1778)..(1778): n is a, c, g, or t
  misc_feature (1782)..(1784): n is a, c, g, or t
  misc_feature (1788)..(1790): n is a, c, g, or t

SEQ ID NO: 729299 - DNA, 2290 bp, Homo sapiens
acaacggccatccctgtggctgggccgccggctacgcaatgctgtctctcttgctgatcctctcaggcctgggcgctgacctccgcgggcccacgccacttattccatcaaaattgaggggaaaccataccttcctgcttgaaaaacagtcatttttacacccacatttcctggtgtatttatacaacaaatcaggaacattgtatgcagattcttcattttcaaagggtcattgcttttaccaaggatatgctgcagacattccaaaatcagttgtggcactacgcacctgttctggactcagaggattactgcagttagataatatcagttatggtattgaaccattggaatcttcacctacatataagcatgtagtttatcgaattaaaaatgatgctattggtcattcctcctttcaagaaaattatcctgtggctcaatatatagatcagtcctacaggattcttgtcaaatcagacataaattcaggtgccatgctatcgaaaagaactctgaaaatacaaatcattatggataaagccatgtatgcttatatgggctccacggtggcagttgcagttgagaaagttttccaaatctttggtcttatcaacactatgttttcccagcttaatatgacagttatgctgtcttccttggagatctggtcagatcaaaataagatttcaacaagtggtcatgctgatgaaatactacagcgatttttgccttggaaagaaaaatttttgtttcaaaggtctcatgatatgacatacttattaatttataggaaccattctacttatgtgggagcaacatatcacggaatggcatgcgatccaaagtttgcaacaggaattgctctgtatccaaagaaaatcactgcagaggccttttcagttgttatggcacagttgcttggaattaatctgggattgacatatgatgatatctacaattgttactgtccaggaactacatgcataatgaatcctgatgcgatacgatcccatggtatgaagttttttagcagttgcagcatggatggatttaaacggatagttctgcagcctgaacttaaatgttttcaggataaaacagtttcaaaaatgacttaccgaaaatcttcaacttgtggcaatggaattttggaacctacagagcagtgtgattgtggctataaagaggcatgcactcataaaaaatgctgtaatcctgcagattgtactctagttagatctgcagaatgtggcactggatcatgctgtaacaataaaacttgtacgatccacgaaagaggccatgtctgcagaaaaagtgtagatatgtgtgattttccagaatattgcaatggaacatctgagttttgtgtacctgatgtgaaagctgctgatttagaatactgcagtaataagactagctattgctttaaaggagtatgcagagaaagggatagacagtgttcacagttatttggaaaatttgctaagtctgctaatcttctgtgcacagaagaagtgaattttcaaaatgacaaatttggaaactgtggttcccgttgtgatttttttgatatcctttgtggaaagattgtttgtcactggatacattcagaactagtaccaatgacagacttagacatacaatatacttaccttagaggtcacgtatgtttgtccgcacatgcaagaaatggttcaaaacaatcggagacctatacagaagatataactgcatgtggccaacacaaggtatgtcactcccgagaatgcagaaattttagtgaactaaatataacaaaatatactacaaattgtggacagaatgggatttgcaatgaacatttccattgtcaatgtgatcctggttatgctcctccagattgtgagccagcaatgtcatcaccaggaggaagtatcaatgatggattttggcttacagtagaaaaaagtgtacccttgcttccaaaacgacgtgctgctcctaaaaacaatggtcttttgatcagtttctacattttttcacctttgctcattttaattgctattgttagtcttaaatggaataaaatgaagagattttggagcaaagtgggaacagtaagcagcagatctatctcagaagacagcagtagtaacagcagccagtcacagagttaaagtaaccaagtgataaaatcaaagccatcggatgaagaaaggatattaccaagaaactcacgattaacttaaaactttcaacttcacagaaaaaaataaatcatatgactaaaagcataaaaaaaaaa

SEQ ID NO: 729300 - DNA, 2387 bp, Homo sapiens
  misc_feature (1288)..(1288): n is a, c, g, or t
acaacggccatccctgtggctgggccgccggctacgcaatgctgtctctcttgctgatcctctcaggcctgggcgctgacctccgcgggcccacgccacttattccatcaaaattgaggggaaaccataccttcctgcttgaaaaacagtcatttttacacccacatttcctggtgtatttatacaacaaatcaggaacattgtatgcagattcttcattttcaaagggtcattgcttttaccaaggatatgctgcagacattccaaaatcagttgtggcactacgcacctgttctggactcagaggattactgcagttagataatatcagttatggtattgaaccattggaatcttcacctacatataagcatgtagtttatcgaattaaaaatgatgctattggtcattcctcctttcaagaaaattatcctgtggctcaatatatagatcagtcctacaggattcttgtcaaatcagacataaattcaggtgccatgctatcgaaaagaactctgaaaatacaaatcattatggataaagccatgtatgcttatatgggctccacggtggcagttgcagttgagaaagttttccaaatctttggtcttatcaacactatgttttcccagcttaatatgacagttatgctgtcttccttggagatctggtcagatcaaaataagatttcaacaagtggtcatgctgatgaaatactacagcgatttttgccttggaaagaaaaatttttgtttcaaaggtctcatgatatgacatacttattaatttataggaaccattctacttatgtgggagcaacatatcacggaatggcatgcgatccaaagtttgcaacaggaattgctctgtatccaaagaaaatcactgcagaggccttttcagttgttatggcacagttgcttggaattaatctgggattgacatatgatgatatctacaattgttactgtccaggaactacatgcataatgaatcctgatgcgatacgatcccatggtatgaagttttttagcagttgcagcatggatggatttaaacggatagttctgcagcctgaacttaaatgttttcaggataaaacagtttcaaaaatgacttaccgaaaatcttcaacttgtggcaatggaattttggaacctacagagcagtgtgattgtggctataaagaggagacaggatttcaccatgttggccaggctagtctcaaacttcggacctcaggttatccacctgcctcagcctctcaaggtgctgggattacaaaccncatgcactcataaaaaatgctgtaatcctgcagattgtactctagttagatctgcagaatgtggcactggatcatgctgtaacaataaaacttgtacgatccacgaaagaggccatgtctgcagaaaaagtgtagatatgtgtgattttccagaatattgcaatggaacatctgagttttgtgtacctgatgtgaaagctgctgatttagaatactgcagtaataagactagctattgctttaaaggagtatgcagagaaagggatagacagtgttcacagttatttggaaaatttgctaagtctgctaatcttctgtgcacagaagaagtgaattttcaaaatgacaaatttggaaactgtggttcccgttgtgatttttttgatatcctttgtggaaagattgtttgtcactggatacattcagaactagtaccaatgacagacttagacatacaatatacttaccttagaggtcacgtatgtttgtccgcacatgcaagaaatggttcaaaacaatcggagacctatacagaagatataactgcatgtggccaacacaaggtatgtcactcccgagaatgcagaaattttagtgaactaaatataacaaaatatactacaaattgtggacagaatgggatttgcaatgaacatttccattgtcaatgtgatcctggttatgctcctccagattgtgagccagcaatgtcatcaccaggaggaagtatcaatgatggattttggcttacagtagaaaaaagtgtacccttgcttccaaaacgacgtgctgctcctaaaaacaatggtcttttgatcagtttctacattttttcacctttgctcattttaattgctattgttagtcttaaatggaataaaatgaagagattttggagcaaagtgggaacagtaagcagcagatctatctcagaagacagcagtagtaacagcagccagtcacagagttaaagtaaccaagtgataaaatcaaagccatcggatgaagaaaggatattaccaagaaactcacgattaacttaaaactttcaacttcacagaaaaaaataaatcatatgactaaaagcataaaaaaaaaa

SEQ ID NO: 729301 - DNA, 2636 bp, Homo sapiens
  misc_feature (1288)..(1288): n is a, c, g, or t
acaacggccatccctgtggctgggccgccggctacgcaatgctgtctctcttgctgatcctctcaggcctgggcgctgacctccgcgggcccacgccacttattccatcaaaattgaggggaaaccataccttcctgcttgaaaaacagtcatttttacacccacatttcctggtgtatttatacaacaaatcaggaacattgtatgcagattcttcattttcaaagggtcattgcttttaccaaggatatgctgcagacattccaaaatcagttgtggcactacgcacctgttctggactcagaggattactgcagttagataatatcagttatggtattgaaccattggaatcttcacctacatataagcatgtagtttatcgaattaaaaatgatgctattggtcattcctcctttcaagaaaattatcctgtggctcaatatatagatcagtcctacaggattcttgtcaaatcagacataaattcaggtgccatgctatcgaaaagaactctgaaaatacaaatcattatggataaagccatgtatgcttatatgggctccacggtggcagttgcagttgagaaagttttccaaatctttggtcttatcaacactatgttttcccagcttaatatgacagttatgctgtcttccttggagatctggtcagatcaaaataagatttcaacaagtggtcatgctgatgaaatactacagcgatttttgccttggaaagaaaaatttttgtttcaaaggtctcatgatatgacatacttattaatttataggaaccattctacttatgtgggagcaacatatcacggaatggcatgcgatccaaagtttgcaacaggaattgctctgtatccaaagaaaatcactgcagaggccttttcagttgttatggcacagttgcttggaattaatctgggattgacatatgatgatatctacaattgttactgtccaggaactacatgcataatgaatcctgatgcgatacgatcccatggtatgaagttttttagcagttgcagcatggatggatttaaacggatagttctgcagcctgaacttaaatgttttcaggataaaacagtttcaaaaatgacttaccgaaaatcttcaacttgtggcaatggaattttggaacctacagagcagtgtgattgtggctataaagaggagacaggatttcaccatgttggccaggctagtctcaaacttcggacctcaggttatccacctgcctcagcctctcaaggtgctgggattacaaaccnacaaggagtcccttgcgggaagactgccaatatgtctgttaggggatactttaagaacctgtaaaatcaacacaagttatttacttaaaagcacagcatacacaaccccattttggaaaaggagaaatagacaagaagaaatgggtaacaggcctcaagcaagtctgaaacccaagagagccaatgatggacattcagactcctgaataatttcctttgatgacatgtcctgcatcttctataaacaggcatgcactcataaaaaatgctgtaatcctgcagattgtactctagttagatctgcagaatgtggcactggatcatgctgtaacaataaaacttgtacgatccacgaaagaggccatgtctgcagaaaaagtgtagatatgtgtgattttccagaatattgcaatggaacatctgagttttgtgtacctgatgtgaaagctgctgatttagaatactgcagtaataagactagctattgctttaaaggagtatgcagagaaagggatagacagtgttcacagttatttggaaaatttgctaagtctgctaatcttctgtgcacagaagaagtgaattttcaaaatgacaaatttggaaactgtggttcccgttgtgatttttttgatatcctttgtggaaagattgtttgtcactggatacattcagaactagtaccaatgacagacttagacatacaatatacttaccttagaggtcacgtatgtttgtccgcacatgcaagaaatggttcaaaacaatcggagacctatacagaagatataactgcatgtggccaacacaaggtatgtcactcccgagaatgcagaaattttagtgaactaaatataacaaaatatactacaaattgtggacagaatgggatttgcaatgaacatttccattgtcaatgtgatcctggttatgctcctccagattgtgagccagcaatgtcatcaccaggaggaagtatcaatgatggattttggcttacagtagaaaaaagtgtacccttgcttccaaaacgacgtgctgctcctaaaaacaatggtcttttgatcagtttctacattttttcacctttgctcattttaattgctattgttagtcttaaatggaataaaatgaagagattttggagcaaagtgggaacagtaagcagcagatctatctcagaagacagcagtagtaacagcagccagtcacagagttaaagtaaccaagtgataaaatcaaagccatcggatgaagaaaggatattaccaagaaactcacgattaacttaaaactttcaacttcacagaaaaaaataaatcatatgactaaaagcataaaaaaaaaa

SEQ ID NO: 729302 - DNA, 697 bp, Homo sapiens; identical to SEQ ID NO: 71652

SEQ ID NO: 729303 - DNA, 896 bp, Homo sapiens
  misc_feature (849)..(849): n is a, c, g, or t
tcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctgtgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagagagacggaggcgcagaataaagtcttcctggcacggcgcgctgtggcgctgacctccaccaaaccggctctttgacccccgcagcccacgtnccgccttcagaccccaggcccattgtaagcctaggtcacaacatctg

SEQ ID NO: 729304 - DNA, 684 bp, Homo sapiens
gatttgggaccgcgcttggtgttggtaccgggaatcgcggccgcgtcgacggattacaggcatgagccacggcgcccagcctaaataagatcttaagattagattggcaattttcagagtggttcatggatacttggggatccccaggacactttctagggagcacatgaggtcaaaattgttttcataataacactaaaacattacctgtcttgactgtttatatttatactgatggtgcaaaagcaatcattagtaaaacttgatggtaccttagcatgaatcaaaacagaagcaccctactttactagaaagttgttttctttattactgtgtacttgcaattttaaaaaacaccacttttgcttaagaatatcactgataaagcaatattttgttaaatctcaaccaataactacacgtattttaaatatctccatgataaaatgataaaagtgtaaagcactacttgtacatgtgaaattgtaatagtagttttgaggaaaaacaagcacttgtgtgatttgtaagctgaactagctgctttttttcatagaataccaaaactactagcgagaacaactaataaaatctattattcacacttgagtatttggcacacattttctcaaaaatgaacaagcttgtgtcactcaaagaaaaaactgacgtacatgaaacagg

SEQ ID NO: 729305 - DNA, 2365 bp, Homo sapiens
  misc_feature (1647)..(1647): n is a, c, g, or t
gggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagcttcagcagttgtactcttttttgatgacctaaaaagggcttatttctgaggaatgaaaggttcccatcattgactacggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcagaagaaatcctttaagagtttaaatgtccctggaacacgcatacaggctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtatttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcatttggcatcctcatgatacttttataaatacgacattaacaggagagcagcagtacgattttgccgatggaataacagatttgccggcaatcactgaaagagtgcaaatatcgggtccttgtgacttcaacggactcttccaaattgtatgaatgtatcaatgtattagataaacccagtttcagaatgataaagaaaaaatgttagaccaaataatgcggctagttaacagtggtacgatttctagcccgtggctttaaaatgcacttaaagtcctgtccttgccttttattttctgaacttgatgtttttgcattctttgagttcagtttaaagacaactacgagcatctgtaaccaatctgacaataatgtgttcatcaggtgcctgtggattaaatcacatactggcatatttaagctgaatgtcaatctggaaaataaattgactgtattaacggaaataccactctttgtgtagatatttgtcgtatattnaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagagggcaacattggaaggttagagttcatcagaaacagaattctaaaatgtgagttcaattcaataaatttgaatttctgtaggaagaatcaaatcaccgatttaaagattgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaagagtcattttaaaataactattaaacaatgtaactgctatcttaatgttctgaaataagttaaaacattttaaaatatgaatactgtaaaggaaataaacggtgggaaggaaaagtagagaaagaaatgccaattccagtccaaagctttatttgccaagttttcttagaatgaattttaccaatttatgaattcttgtaagcggaatgtaaaacggaaatactgaaagacttttgcctaaagtggcattattgactgctggtgtgatgctactgtaatgtaataaattattaagttgttgcaaag

SEQ ID NO: 729306 - DNA, 359 bp, Homo sapiens
gattttaaaatatgaatactgtaaaggaaataaacggtgggaaggaaaagtagagaaagaaatgttttaacttatttcagaacattaagatagcagttacattgtttaatagttaaaacattttaaaatatgaatactgtaaaggaaataaacggtgggaaggaaaagtagagaaagaaatgccaattccagtccaaagctttatttgccaagttttcttagaatgaattttaccaatttatgaattcttgtaagcggaatgtaaaacggaaatactgaaagacttttgcctaaagtggcattattgactgctggtgtgatgctactgtaatgtaataaattattaagttgttgcaaag

SEQ ID NO: 729307 - DNA, 952 bp, Homo sapiens
agcattacatgttattcttaacacctgccacttctctcttcccacctctatctgccttattgaacttcatctttccttcattctcttcaacttccacttcttcttgtatggtcctgttgatgccatcttgtttccgtccccagactcatcatctttaccctctgtcaactgagttcccaccctggttctctctcaagatcttcctctcatagctttcacccttggtaaacaatgaggacacatctcaaaaagaatgatgtaatttaattgccttgagttggctgggccatcatctattataaagtgctcttaaaattaaagctaatttaattctgaagaactaaggattaagaagttaagagctggggttcttacaatatggcttgcagactacaagtgtgaactgaggaggtccccaaagtcacttcttactaagtatattatctttttctgaaaattgctcttatctgaaccacaatgaattcacatattcaagttggcttcttcggaaatttcaggccacaaatggcagtgatgcgaccaggagcagtaacacgattacaagtcgcaatttaggaagggtgctccatcatcatttcatgattctcactacagcccagacaggtgggcagagcagtgttctttcccctttaatgaatgaagaagctgagcctcaaacagatgagggggcttcctgggttcacagagctctaaaggtgggaacctagctttttcagtgacattagctagatgtggtgggcacttctcactagaaaaacaagaattaaatcaacgtgaggtccagaactggtgtcccctgttggaaaaataaattgaaactaatgttctggcaataggtagcaaaaactttaaacctatggtaccatctgtcttgacaatcttacctctagaaattgaccccttaataaattaaaactgtgtcttttttagc

SEQ ID NO: 729308 - DNA, 266 bp, Homo sapiens
ttgaaagcggtgtaaatggctcttatctgaaccacaatgaattcacatattcaagttggcttcttcggaaatttcaggccacaaatggcagtgatgcgaccaggagcagtaacacgattacaagtcgcaatttaggaagggtgctccatcatcatttcatgattctcactacagcccagacagggctgagctgtagatccacggccaccatgatgagctaagagtttctggattcagtgcctgctgttgctcctggagatttgtat

SEQ ID NO: 729309 - DNA, 678 bp, Homo sapiens
agcattacatgttattcttaacacctgccacttctctcttcccacctctatctgccttattgaacttcatctttccttcattctcttcaacttccacttcttcttgtatggtcctgttgatgccatcttgtttccgtccccagactcatcatctttaccctctgtcaactgagttcccaccctggttctctctcaagatcttcctctcatagctttcacccttggtaaacaatgaggacacatctcaaaaagaatgatgtaatttaattgccttgagttggctgggccatcatctattataaagtgctcttaaaattaaagctaatttaattctgaagaactaaggattaagaagttaagagctggggttcttacaatatggcttgcagactacaagtgtgaactgaggaggtccccaaagtcacttcttactaagttcagataggtgatggattgaaaataatcccaatattccacaagcaacatcaacatcccccacacacccagcaccgaggaataccctcctctctagaatgtgaggccactgtgtggaggaagacaccacggtgctctactgagccatgaaagtcacgcctgacctaaacagaagactacgtcccctggctaaaagaggaaatagttgaaagcggtgtaaatggctcttatctgaaccacaat

SEQ ID NO: 729310 - DNA, 2076 bp, Homo sapiens
caagacctcagtgaagcccagccagcccaaggagagtgatatccccaagtccccagaagaaaccatccagcccaaggagggtgacatccccaagtcctcagcaaagcccatccagcccaagctgggcaatattcccaaggcctcagtgaagcccagccagcccaaggagggtgacatctccaagtccccagaagaagccatccagcccaaggagggtgacctccccaagtccctagaggaagccatccagcccaaggaggggtgacatccccaagtccctagaggaagccatccagcctaaggagggtgacatccccaagtccccagaagaaaccatccagcccaagaagggtgacatccccaagtccccagaagaagccatccagcccaaggagggtgacattcccaagtctccaaaacaagccatccagcccaaggagggtgacattcccaagtccctagaggaagccatcccacccaaggagattgacatccccaagtccccagaagaaaccatccagcccaaggaggatgacagccccaagtccctagaagaagccaccccatccaaggagggtgacatcctaaagcctgaagaagaaacaatggagttcccggagggggacaaggtgaaagtgatcctgagcaaggaggactttgagacatcactgaaggaggccggggagaggctggtggctgtggacttctcggccacgtggtgtgggccctgcaggaccatcagaccattcttccatgccctgtctgtgaagcatgaggatgtggtgttcctggaggtggacgctgacaactgtgaggaggtggtgagagagtgcgccatcatgtgtgtcccaacctttcagttttataaaaaagaagaaaaggtggatgaactttgcggcgcccttaaggaaaaacttgaagcagtcattgcagaattaaagtaaacatgtattctgaaaacattgcagacagtcaggtgtttatagcttttgagttctcttttattatttacacaaagtgatcaggtataacaaaagtgtatgtccaaatggcactgcttgtacatgataatattaactctacccttttcaaaaaacagtccaagcattaaagtacattgcgactgtgtttctgttagtgggagagtataaaattagaaattcccatggtgaagactgctaagtcccatggtttcctatttttcaatcttgatatgtatttatttttcacttgtctttgaaaatttcacgcatttagtgtttgcagcaagactgaaaatttagataatttttctatagaggtagatgactgaaaggtgaatggaaacttcttttctcatgtcacacatctttggggattctgaaaagatatgtttggaaataaggaatttgaaagattcacatcttagctaacctccttcttgtgccggaagtgctacggaggccttgggaaattcagtgggttttccaagatctgatttgttggtgacggaagtgagatcaaggccgcttccagatttcaagtccagggctctacctactataatctacgctcacaaaatctcagacaagagatcggaacttcaggtttctcggaggttgaagtcctctggatctttgctgcctttatgacatcagtgccctgatggcagagttcctggttcgtctccctggtaattgagttcataatacctagaccttcctctgacttttttacttaaatttgttcttattttcaatattgaacaagccagcctttaacatgactctaccagcttagacatataggcctagactttaatgaattaacctaatcacagtgctaccagagtcttgtttggacaacttagtgagccccagatgtctatgagcccaaagtcccaggtctgaaccatagacagaggcttagtccagagtgggtttttaaaaatgaataaaaccagcttcattaggtataattgatatacaaagaactgcacatatttaatggagggagttggatgagtttggatgtgttgcatatgcccttgattgccatctccaccatcaaagtaattaacaccttcattgcctccag

SEQ ID NO: 729311 - DNA, 408 bp, Homo sapiens; identical to SEQ ID NO: 73218

SEQ ID NO: 729312 - DNA, 439 bp, Homo sapiens
tatctaaattgttacaaatgggacagtatatgtgccattccagatacctaatcacagctcaatcgatgctggtgtctttttcctttttccttctgcagaaaacatgctttacataggatctctgaacttaaagaatgggaagaagaaaaatcatgtttccagcttgggctgctgtttcatctgttggacttgctgatccctgaatggaaaggaatgctatgcacactttttggatacaggaagtgagattcagaggggttaaacagctttcctaaagccacacagcgagagagtcgatctgaactgaagattgtttgacatcaaagctcatttctttccctaaatgtcagcattctttcctgacttattaatttgatttctgtcctcccctcatggaagttaattaaaggaatgcgagaaccttttagaaaatctccag

SEQ ID NO: 729313 - DNA, 1049 bp, Homo sapiens
cttttctgcgggtcttggcacctttcttggccacagatttctgggttacagagcatgtgtgtctgaggcattgcaggcagaaaagggtggccgacgtgacctctagctggactgctgggcaggggagctgtcctagataaaattggaaagcaccttgtccaatgggaggacctaagtgggagagtgagagtcctgctttgagaagctaagatggtggatggtgcagaaacagtgacccagagacaggtggacaaagaattcggggactgatgggaactgagcttgggatccagactgaaactgattccagactgacctctagcacccaggacccagacacagggccatgggaccccagcatttgagacttgtgcagctgttctgccttctaggggccatctccactctgcctcgtatgtcctgtggggctggatgctataagacccagaaagggactgcaaggggagttgtgggctttaaaggctgcagctcgtcttcgtcttaccctgcgcaaatctcctaccttgtttccccacccggagtgtccattgcctcctacagtcgcgtctgccggtcttatctctgcaacaacctcaccaatttggagccttttgtgaaactcaaggccagcactcctaagtctatcacatctgcgtcctgtagctgcccgacctgtgtgggcgagcacatgaaggattgcctcccaaattttgtcaccactaattcttgccccttggctgcttctacgtgttacagttccaccttaaaatttcaggcagggtttctcaataccaccttcctcctcatggggtgtgctcgtgaacataaccagcttttagcagattttcatcatattgggagcatcaaagtgactgaggtcctcaacatcttagagaagtctcagattgttggtgcagcatcctccaggcaagatcctgcttggggtgtcgtcttaggcctcctgtttgccttcagggactgaccatctagctgcacccgacaagcacccagactctttcacataacaaataaaatagcagagttccctt

SEQ ID NO: 729314 - DNA, 928 bp, Homo sapiens
aaacagtgacccagagacaggtggacaaagaattcggggactgatgggaactgagcttgggatccagactgaaactgattccagactgacctctagcacccaggacccagacacagggccatgggaccccagcatttgagacttgtgcagctgttctgccttctaggggccatctccactctgcctcgggctggagctcttttgtgctatgaagcaacagcctcaagattcagagctgttgctttccataactggaagtggcttctgatgaggaacatggtgtgtaagctgcaagagggctgcgaggagacgctagtgttcattgagacagggactgcaaggggagttgtgggctttaaaggctgcagctcgtcttcgtcttaccctgcgcaaatctcctaccttgtttccccacccggagtgtccattgcctcctacagtcgcgtctgccggtcttatctctgcaacaacctcaccaatttggagccttttgtgaaactcaaggccagcactcctaagtctatcacatctgcgtcctgtagctgcccgacctgtgtgggcgagcacatgaaggattgcctcccaaattttgtcaccactaattcttgccccttggctgcttctacgtgttacagttccaccttaaaatttcaggcagggtttctcaataccaccttcctcctcatggggtgtgctcgtgaacataaccagcttttagcagattttcatcatattgggagcatcaaagtgactgaggtcctcaacatcttagagaagtctcagattgttggtgcagcatcctccaggcaagatcctgcttggggtgtcgtcttaggcctcctgtttgccttcagggactgaccatctagctgcacccgacaagcacccagactctttcacataacaaataaaatagcagagttccctt

SEQ ID NO: 729315 - DNA, 457 bp, Homo sapiens; identical to SEQ ID NO: 317712

SEQ ID NO: 729316 - DNA, 518 bp, Homo sapiens
agtggaggttggattcagaggacatggggatcagtgtgggctgtgctggtcaaggagggcttccagggagaggcaactgaggattcactgcaattgttccttgagaagatgaggatcaggtcgggaattggaaacatctgagggctcaattcaacctggcttctaaaacgaacatggtgaacatagatcaactactgaacttcttttaacctctggcatcctatctgtgaattgtggggaggaaacagggtccacccgctgctgcacaagaggggtgtgtgcagaccgtcaccttgtgtctgctgtagcaggagacccctggccatgcgggactgaacccatgattgcagctgatcttactctgtctcttctctgtgtgagtaaagtgttgttccatctagtgcctgtgtgagtcgtgtctttcgtggcgacacctataaaccatggagtgggctgacatcctggttctgctgctcctggtggcgggcattgttgtgctgtttgccgtcctctacaca

SEQ ID NO: 729317 - DNA, 1323 bp, Homo sapiens
gcaactgaggattcactgcaattgttccttgagaagatgaggatcaggtcgggaattggaaacatctgagggctcaattcaacctggcttctaaaacgaacatggtgaacatagatcaactactgaacttcttttaacctctggcatcctatctgtgaattactcagcgtgtactctttgttctgcttaagcttgtgcgtcatgtggcaggcacctggccaaccccactgttatatctgttccaggtggggaggaaacagggtccacccgctgctgcacaagaggggtgtgtgcagaccgtcaccttgtgtctgctgtagcaggagacccctggccatgcgggactgaacccatgattgcagctgatcttactctgtctcttctctgtgtgagtaaagtgttgttccatctagtgcctgtgtgagtcgtgtctttcgtggcgacacctataaaccatggagtgggctgacatcctggttctgctgctcctggtggcgggcattgttgtgctgtttgccgtcctctacacagacttgtccacaaaaatcactatgaaaatttacttctgtgaactagactcacatcaaaatgctgcctgcttccatgaggcttgtagtgacatccatgtacaagttcaaagaccctctgagccaatttccacttctctgcatgtctctggggacctaggggaccaggattactataaaagcagtatcaaccccttcaaaggatacctacccatgactgtctcagtctgcggcactctagatcttgatagaaatcacacgcattctgattttatttcattgcaaaatgccaaggatcttccatgccaaagctgcacttttctctttacccctctttgtggaggaccaggggccttttctctgtgggtgctcagccctgttgtgtctctgagagtccaaatttcctcttataaggacaccagtcagactagattaaggccgaccctaatagcctcagtccacgttaatgacctctttaaagatcctatctccgaatacagtcacattcgaggtcaggggcagggacttgctaagagcaagaggctgacccatgggattggggaggtaacagagaaagcacccccaaaagcaggctgcagagaaatgtttgaccccagagtggccttggatctgctgggatcacccaaggatctattttccagcccaaccttagttctatcctaaagttcagaaaattcttcctgaatactctttctcacctctacatatttacttgtgcattaaacccacccaagatgcatgctcctctttaatcttttaagctactcttcttcat

SEQ ID NO: 729318 - DNA, 1480 bp, Homo sapiens
cagcaaacttcaaactttttaatggaacaaggacacacagacattaatccccagtgtccatcaaagttgcaatgcagccctaacgcctggcatccttgaaagggacgggcatttagtaatgagatatgcacagcagcatagtcagctgtgtggtgcattctcagctgtgcctcagcagccctgatgcagacatccagaaggagcacagccactttatccagagcaatcagccatgactgcctttgcactgtccatgctctcagcccaccacctcctccccctgccattgcagtggctaacactggagacgaagaccaagacaccaccgcctttctccagtacctctcaaatcagcacaggcaaggacaaaggcctcaatccacaactgctgaagatggaccctggccacatgggatggtcagacacgcctgcccagctatctgcaggcgaagaggctcagaagaggtttaggggcctgaaggacatcttgcttccatgtccatatgagcaggctatttctgctccatgagtcaattttgccatataaaatacttaatttcagccattccagggtgctgtaggatgcacagcttcccatcagcccacctgaactccagccatgccattttaataccaggaataaggtcacctgctttcctgccccttaggaggccagagccgtggaagcaaaatggcacttctgtttacctgttatattatttttttgtcatccttatatgcttggaaaatgcaattatatgaaaaaagtttagtaattacagacataacagcagaaagtcctcggaaccaagcttactctcatggccgattctgctccacctgggactctgctgtgctgcgggcatcctgtggtcagaatcgcagaggggccatcagggagggccttcccagaggatggacctcacgtgactgctgcgtgggcaagtggcactggccactctgcctggagagaggagtaaatgcagggctggccaggcgacctgcacactctgctactggccttgtccatctttagcctctaatttgaaaatgaggctcacacagaccaagagtatctttgagggttagtacagaccacagaaatgccctgggcctttcactctctccttttgcaaattcccatgtgtggaaatgccgtttggataatgagggagcctgaaggaggtggacacatgagcagccccgacaggcctggctccatcctctgaaaatggggccccgtgcccggcgtgtggccttactggttcagtcttctttacagtggtaggttttgagtgcccagatgcccagtgcctcctacctggaacagcacaggatctggcagacccctggaagaatcacatgcacacttaaatattcagggagttcccacccagcagagctcgcctctgtggctaccttggtcttgctgctgatatctgccagaaaaggcctggacttggagacaagcctgggattt

SEQ ID NO: 729319 - DNA, 2522 bp, Homo sapiens
aacatgcacccccaacccgtagaggatctgcagttgctggcatctccaggttttcaggagccaccacattcccttcatccagatgctggcaactgcaggagaagccgcttgtagtatgcctgctccagccgcagccttgcatggagccagtgcctatgccggtgcctggagccgtccgccctgctgcggcagttggcgtgcctggctgtgtgcaggggccacactccgcacttgctcactcacacacccttcgcctttctgcatctggcttgccctcggcaggcatgggatctgggctggtagtgcaagctgggcacagcctgccaggctgaatgggtggaatgaacccagtgggcgtgagcaatattcaagtagaggcgctgccggccatgaggtttctagctggtgaagcgacacccagaggatcctgtgacaataggatttctgaaatctgcattggcttgcagactgacagaaaagtcttcaaagggagacaaaaacaggcttttcctactgatgaaatgggacctactgtcgatgactgctacagagttactctagaagaattcagaggaagatgtgaggagttcactctggagccacagtggccggaatcaacccctgggcgtcttctgaagcacatgtctacaccggggaagaaaacctcctccataacactaaatgctgaagtggccatcagcaccagtgatcatcagcaccagtggccatcagcaccagtgatcatcagcaccagtggccatcagcaccatggccatcagcaccagtgggtcatcagtaccatggccatcagcaccagtggcccgcatgggaggggttctcacatggggcttctgcctggctacctgaaagatgaatacgctttcaggaactcagtggtctctatggagcccatctgtgggtctcacatcaagaaacttccagagacagatctgactctgaagactgcagggcactgcaagaactcgatggaggtggaatccattaaactgacaaagccccagtcccggggtcctaatagtcgggactattaggtcatcctgggtactcaggcctctagactctagactgagctgccttggtcactcggggacagttggcagagtattcgtggtcagggaggtgacccgtggtcagcaggatcaggccacccagggacaaagggtgcttctgcgccaggccctggagaaggacagagcggtggggactcggggtcggccgcagataggggagtcaccacctgccggcaatcagccatgactgcctttgcactgtccatgctctcagcccaccacctcctccccctgccattgcagtggctaacactggagacgaagaccaagacaccaccgcctttctccagtacctctcaaatcagcacaggcaaggacaaaggcctcaatccacaactgctgaagatggaccctggccacatgggatggtcagacacgcctgcccagctatctgcaggcgaagaggctcagaagaggtttaggggcctgaaggacatcttgcttccatgtccatatgagcaggctatttctgctccatgagtcaattttgccatataaaatacttaatttcagccattccagggtgctgtaggatgcacagcttcccatcagcccacctgaactccagccatgccattttaataccaggaataaggtcacctgctttcctgccccttaggaggccagagccgtggaagcaaaatggcacttctgtttacctgttatattatttttttgtcatccttatatgcttggaaaatgcaattatatgaaaaaagtttagtaattacagacataacagcagaaagtcctcggaaccaagcttactctcatggccgattctgctccacctgggactctgctgtgctgcgggcatcctgtggtcagaatcgcagaggggccatcagggagggccttcccagaggatggacctcacgtgactgctgcgtgggcaagtggcactggccactctgcctggagagaggagtaaatgcagggctggccaggcgacctgcacactctgctactggccttgtccatctttagcctctaatttgaaaatgaggctcacacagaccaagagtatctttgagggttagtacagaccacagaaatgccctgggcctttcactctctccttttgcaaattcccatgtgtggaaatgccgtttggataatgagggagcctgaaggaggtggacacatgagcagccccgacaggcctggctccatcctctgaaaatggggccccgtgcccggcgtgtggccttactggttcagtcttctttacagtggtaggttttgagtgcccagatgcccagtgcctcctacctggaacagcacaggatctggcagacccctggaagaatcacatgcacacttaaatattcagggagttcccacccagcagagctcgcctctgtggctaccttggtcttgctgctgatatctgccagaaaaggcctggacttggagacaagcctgggattt

SEQ ID NO: 729320 - DNA, 782 bp, Homo sapiens
caacaactgaagccccatgaccaagtgtcctgctttgtgcggaagagtgcagggaggccgcatgaccccggtgttcgagtgccgcagcccaaatgaggaccacatctaccaggaggagatgctggagatggctcggaagggggttgctgcctgcggtgcccacagcctattcctgcctgcctggcaagcccaagagccagaagcacttccatgacgatatctttggtgctgtatttccctacgaggcaaagaaggacagggcggcggtgcagcccagcagcctggagatgtcagcgctctgagggcccacaggaggggttaaagctgccagcacagaacttaacgatggagccagctctgcattatccgaggtcacagggcctggggagatggaggaaagtgatatcccccagcctcacgtcttatttctcacctcgttccccatcaagccctttacttgacctcctaccaagtagcaccctggattgatcggagcctcctctctcaagctggggcctccctggtcccttggagacgaaatcttcaatgccaggcctggcaagtgggtgaaagatggaacccgctgctgagtgcaccacttcaagtgaccaccaggaagtgccgtcacaccactgtgtatttaactgccatgggtacaattatttatgcctctgtttaaaaaacgaacaccctagtctgttcctaatggccccttgggtcttctctgtatgattccctgatggagatatttacatgagttgaattttactttaaaaacactg

SEQ ID NO: 729321 - DNA, 684 bp, Homo sapiens
ctggatctcactggatccttcactgctaaaggacccccaccgcggattctaagatccttagcacccacctggaggactgggggttttaggtgtccaagaagaaagctcagacctgccgaccgcaggtaccttacctgggatttactatccgacaggggtccgaacgcagctcgggatcagaaaaaaagcaggggtccgaacgcagcccgggatcagaaagaaagcaggtcgtttgcaatctaccggagcctaagggcagaaggcaggaccgtgggaacaatatgccagggggatttccactttctgccatatatgtagtcacatcacccactctgccttggaatattattaaggaccatctaacacgagggtgtatacgtcctgcaatactacgagtaatatcaacttcttggcctctgaatatgaggaagaatatcacagggatattaataacaatttcacaggctgggtgaacacagccggcaatgctgaaattattatcaacctctccccatcttcccctcctggctcttaggacccccatcgcagggggctgaggcacccccgcgaggcggggactgagtgccagcccctcttccctagccccttcgtcagggctgagagaattttgagcgctagccgtctctcgatcgctggctaataaagaactcctgaattagtaaa

SEQ ID NO: 729322 - DNA, 662 bp, Homo sapiens
ctggatctcactggatccttcactgctaaaggacccccaccgcggattctaagatccttagcacccacctggaggactgggggttttaggtgtccaagaagaaagctcagacctgccgaccgcaggtaccttacctgggatttactatccgacaggggtccgaacgcagctcgggatcagaaaaaaagcaggggtccgaacgcagcccgggatcagaaagaaagcaggtcgtttgcaatctaccggagcctaagggcagaaggcaggaccgtgggaacaatatgccagggggatttccactttctgccatatatgtagtcacatcacccactctgccttggaatattattaaggaccatctaacacgagggtgtatacgtcctgcaatactacgagtaatatcaacttcttggcctctgaatatgaggaagaatatcacagggctgggtgaacacagccggcaatgctgaaattattatcaacctctccccatcttcccctcctggctcttaggacccccatcgcagggggctgaggcacccccgcgaggcggggactgagtgccagcccctcttccctagccccttcgtcagggctgagagaattttgagcgctagccgtctctcgatcgctggctaataaagaactcctgaattagtaaa

SEQ ID NO: 729323 - DNA, 763 bp, Homo sapiens
ctggatctcactggatccttcactgctaaaggacccccaccgcggattctaagatccttagcacccacctggaggactgggggttttaggtgtccaagaagaaagctcagacctgccgaccgcaggtaccttacctgggatttactatccgacaggggtccgaacgcagctcgggatcagaaaaaaagcaggggtccgaacgcagcccgggatcagaaagaaagcaggtcgtttgcaatctaccggagcctaagggcagaaggcaggaccgtgggaacaatatgccagggggatttccactttctgccatatatgtagtcacatcacccactctgccttggaatattattaaggaccatctaacacgagggtgtatacgtcctgcaatactacgagtaatatcaacttcttggcctctgaatatgaggaagaatatcacagggtgggtgtacacctcgtgctctattatgcggagtcatatctgtctattatggggagtaatatcattctctccctttcaggatattaataacaatttcacaggctgggtgaacacagccggcaatgctgaaattattatcaacctctccccatcttcccctcctggctcttaggacccccatcgcagggggctgaggcacccccgcgaggcggggactgagtgccagcccctcttccctagccccttcgtcagggctgagagaattttgagcgctagccgtctctcgatcgctggctaataaagaactcctgaattagtaaa

SEQ ID NO: 729324 - DNA, 2184 bp, Homo sapiens
agcgtggggcgtctccgagcggcggggccaagggagggcacaacagctgctacctgaacagtttctgacccaacagttacccagcgccggactcgctgcgccccggcggctctagggacccccggcgccaacacttagctccgcgcccgagagaatgttggaccgacgacacaagacctcagacttgtgttattctagcagctgaacacaccccaggctcttctgaccggcagtggctctggaagcagtctggtgtatagagttatggattcactaccagattctactgtatgctcttgacaactatgaccacaatggtccacccacaaatgaattatcaggagtgaacccagaggcacgtatgaatgaaagtcctgatccgactgacctggcgggagtcatcattgagctcggccccaatgacagtccacagacaagtgaatttaaaggagcaaccgaggaggcacctgcgaaagaaagcccacacacaagtgaatttaaaggagcagcccgggtgtcacctatcagtgaaagtgtgttagcacgactttccaagtttgaagttgaagatgctgaaaatgttgcttcatatgacagcaagattaagaaaattgtgcattcaattgtatcatcctttgcatttggactatttggagttttcctggtcttactggatgtcactctcatccttgccgacctaattttcactgacagcaaactttatattcctttggagtatcgttctatttctctagctattgccttattttttctcatggatgttcttcttcgagtatttgtagaaaggagacagcagtatttttctgacttatttaacattttagatactgccattattgtgattcttctgctggttgatgtcgtttacattttttttgacattaagttgcttaggaatattcccagatggacacatttacttcgacttctacgacttattattctgttaagaatttttcatctgtttcatcaaaaaagacaacttgaaaagctgataagaaggcgggtttcagaaaacaaaaggcgatacacaagggatggatttgacctagacctcacttacgttacagaacgtattattgctatgtcatttccatcttctggaaggcagtctttctatagaaatccaatcaaggaagttgtgcggtttctagataagaaacaccgaaaccactatcgagtctacaatctatgcagtgaaagagcttacgatcctaagcacttccataatagggtcgttagaatcatgattgatgatcataatgtccccactctacatcagatggtggttttcaccaaggaagtaaatgagtggatggctcaagatcttgaaaacatcgtagcgattcactgtaaaggaggcacagatagaacaggaactatggtttgtgccttccttattgcctctgaaatatgttcaactgcaaaggaaagcctgtattattttggagaaaggcgaacagataaaacccacagcgaaaaatttcagggagtagaaactccttctcagaagagatatgttgcatattttgcacaagtgaaacatctctacaactggaatctccctccaagacggatactctttataaaacacttcattatttattcgattcctcgttatgtacgtgatctaaaaatccaaatagaaatggagaaaaaggttgtcttttccactatttcattaggaaaatgttcggtacttgataacattacaacagacaaaatattaattgatgtattcgacggtccacctctgtatgatgatgtgaaagtgcagtttttctcttcgaatcttcctacatactatgacaattgctcattttacttctggttgcacacatcttttattgaaaataacaggctttatctaccaaaaaatgaattggataatctacataaacaaaaagcacggagaatttatccatcagattttgccgtggagatactttttggcgagaaaatgacttccagtgatgttgtagctggatccgattaagtatagctcccccttccccttctgggaaagaattatgttctttccaaccctgccacatgttcatatatcctaaatctatcctaaatgttccttgaagtatttatttatgtttatatatgtttatatatgttcttcataaatctattacatatatatagataaaatgt

SEQ ID NO: 729325 - DNA, 207 bp, Homo sapiens
  misc_feature (175)..(175): n is a, c, g, or t
gttatgtacgtgatctaaaaatccaaatagaaatggagaaaaaggttgtcttttccactatttcattaggaaaatgttcggtacttgataacattacaacagacaaaatattaattgatgtattcgacggtccacctctgtatgatgatgtgaaagtgcagtttttctcttcgantcttcctacataacgtaacgggagatcctcta

SEQ ID NO: 729326 - DNA, 753 bp, Homo sapiens
agcgtggggcgtctccgagcggcggggccaagggagggcacaacagctgctacctgaacagtttctgacccaacagttacccagcgccggactcgctgcgccccggcggctctagggacccccggcgccaacacttagctccgcgcccgagagaatgttggaccgacgacacaagacctcagacttgtgttattctagcagctgaacacaccccaggctcttctgaccggcagtggctctggaagcagtctggtgtatagagttatggattcactaccagattctactgtatgctcttgacaactatgaccacaatggtccacccacaaatgaattatcaggagtgaacccagaggcacgtatgaatgaaagtcctgatccgactgacctggcgggagtcatcattgagctcggccccaatgacagtccacagacaagtgaatttaaaggagcaaccgaggaggcacctgcgaaagaaagtgtgttagcacgactttccaagtttgaagttgaagatgctgaaaatgttgcttcatatgacagcaagattaagaaaattgtgcattcaattgtatcatcctttgcatttggactatttggagttttcctggtcttactggatgtcactctcatccttgccgacctaattttcactgacagcaaactttatattcctttggagtatcgttctatttctctagctattgccttattttttctcatggatgttcttcttcgagtatttgtagaaag

SEQ ID NO: 729327 - DNA, 1273 bp, Homo sapiens; identical to SEQ ID NO: 76781

SEQ ID NO: 729328 - DNA, 440 bp, Homo sapiens; identical to SEQ ID NO: 76782

SEQ ID NO: 729329 - DNA, 536 bp, Homo sapiens
atagcacactcaacgcccagcatgccgaggaggaggagacgccgagggtctccggtgctggcggccggggcggacctgctctcgcaccgtccgagcggagctttcgttttcagtgagccaggtggagcgcagtctacgggagggccactacgctcagcgcctgagtcgcacggcgccggtctacctcgctgcggttattgagtacctgacggccaaggtcctggagctggcgggcaacgaggcccagaacagcggagagcggaacatcactcccctgctgctggacatggtggttcacaacgacaggctactgagcacccttttcaacacgaccaccatctctcaagtggcccctggcgaggactagcttctgacacccggcccctgggacctgacaggtccactcgtccacccacccggccccaaatcccccggcctgaacccccggccttaaacaccctccccccacaacccaggccccaaagtcttgggccttcattaattctgtcaataaaatgtttcaaggaagccaaaaa

SEQ ID NO: 729330 - DNA, 781 bp, Homo sapiens
  misc_feature (24)..(24): n is a, c, g, or t
  misc_feature (26)..(26): n is a, c, g, or t
cggccgaggcctcagctccactangngacttctgcacctcatctctgggatggtttcagtgggtcctagattgctttctgtgctccctgggacagttggtggcactctgtgagactactctcaggtacccttacaagctactcttaattttccccgctgttctgcttgttggacatggcatcatgctgcaatgttaacagtctttcaaagctaagcgcggaggatgtgattccatccctggcagttcttagattccctcatgactataggacagagaggagactgagaaacacaagaagcaccagagtggttgaaaggagctgaaggttcagacagcaacctggacactaagggtccaaagccaagcccaaggtcaagtagctggacagagaaacagctgcaagcacagacttggatcctgacctgattttctgcagaagcaagtccctgtttagccttctactgcctccttttagaatgaagccagaccagtcctttccatcatgggctcctgtggaaaatgaccccagctcagctcagtagttgatgggacatctgattcaggttggacccagcccagacatctgattcaaacaatattcttctccaggaattttgtaaccagcactggtagagggagggaagtgctccccagtggggagagctgcagaatgtgagacttggaaaccaaaggccgccatgttttctgtctcatgatggaatccaatcttctttggcggggaaaataaatgaagccaacaccagtaggtataagagagat

SEQ ID NO: 729331 - DNA, 503 bp, Homo sapiens
  misc_feature (24)..(24): n is a, c, g, or t
  misc_feature (26)..(26): n is a, c, g, or t
  misc_feature (318)..(321): n is a, c, g, or t
  misc_feature (358)..(358): n is a, c, g, or t
  misc_feature (363)..(363): n is a, c, g, or t
cggccgaggcctcagctccactangngacttctgcacctcatctctgggatggtttcagtgggtcctagattgctttctgtgctccctgggacagttggtggcactctgtgagactactctcagcagaccagtcctttccatcatgggctcctgtggaaaatgaccccagctcagctcagtagttgatgggacatctgattcaggttggacccagcccagacatctgattcaaacaatattcttctccaggaattttgtaaccagcactggtagagggagggaagtgctcccccccccccaaaaaaaaaaaggggggnnnnttttttttggggggggggggggggggggaaaaggganaaggnctttgcccaagaagtggggagagctgcagaatgtgagacttggaaaccaaaggccgccatgttttctgtctcatgatggaatccaatcttctttggcggggaaaataaatgaagccaacaccagtaggtataagagagat

SEQ ID NO: 729332 - DNA, 1048 bp, Homo sapiens
  misc_feature (24)..(24): n is a, c, g, or t
  misc_feature (26)..(26): n is a, c, g, or t
cggccgaggcctcagctccactangngacttctgcacctcatctctgggatggtttcagtgggtcctagattgctttctgtgctccctgggacagttggtggcactctgtgagactactctcaggtacccttacaagctactcttaattttccccgctgttctgcttgttggacatggcatcatgctgcaatgttaacagtctttcaaagctaagcgcggaggatgtgattccatccctggcagttcttagattccctttggattacagaagtgatttttaaagacactattaatagaggtattttatcttggtacaaaattatttaaaaaatagacttaaacagagacttccacttatgggtataatagactaagaccctgttggatgatttcttcaccctgcatacaacaactgtgagactgcacgtaatcatatgatagtactggagactgaagagaagatgacaggatctaatgggggagtccatgcttgcttgaaggaggagagatatggatctggacaacatgactataggacagagaggagactgagaaacacaagaagcaccagagtggttgaaaggagctgaaggttcagacagcaacctggacactaagggtccaaagccaagcccaaggtcaagtagctggacagagaaacagctgcaagcacagacttggatcctgacctgattttctgcagaagcaagtccctgtttagccttctactgcctccttttagaatgaagccagaccagtcctttccatcatgggctcctgtggaaaatgaccccagctcagctcagtagttgatgggacatctgattcaggttggacccagcccagacatctgattcaaacaatattcttctccaggaattttgtaaccagcactggtagagggagggaagtgctccccagtggggagagctgcagaatgtgagacttggaaaccaaaggccgccatgttttctgtctcatgatggaatccaatcttctttggcggggaaaataaatgaagccaacaccagtaggtataagagagat

SEQ ID NO: 729333 - DNA, 283 bp, Homo sapiens; identical to SEQ ID NO: 409522

SEQ ID NO: 729334 - DNA, 4397 bp, Homo sapiens
ggaggccagagcgaggagccagttgtagtgctagctccgcctttgtcgcagctgccactactgccaccgggaaaacatttttcttaaaaaatgtgttcttatggccgggctcttgctggatcacgagtgaagctgcagaccttcgcgggagtgaagctgcagaccttcgcggtgagtgttacagctcttaaggtggtgcgtctggagtcgtttgtttctgccagtgccttcatggtctcactggcttcagaagtgaagctgcagaccttcgtgactcatgagcccagctggcttcacccagtggatcccgcaacagggccacaggtggagctgcctgccagttccgtgccatgcgcctgcactcctcagcccttgggtggtcaatgggactgggcgccctggagcagcgggcggggctcctcaggaaggctggggctgggcaggagcccacggctggggcgggagcaagctcaggcatggtgggctgcgggtccccagccctgccccacagggaggcagctaaggccctcggagaagttgagcacagcagctgctggtccaggtgataagcccctcactgccccggccagcggggccagcttgctgctccgagtgcgggccggcgcccacgcccacccggaactggcattggcccgcaattgctgcgcgcagccccgattcccgcccacacctctccctccacacctccccgcaagctgagggagccagctctggccttggccagcccagaaaggggctcccacagtgcagtggcgggctgaagggctcctcaagcatggccagagtgggcgtcaaggccgaggaggtgccgagagtgagcgagggctgtgagggctgccagcacgctgtcacctctcattattacatctatttaactttgtgttgcttttgaaatccttgtgctgttaagttacagggctttgactccattgattcctgggtctgaaaaagacaccaaaccctgctaacttttaaacattgacagcagttaaagcctcatcttcagacccaggagaagatgacagtcaaaacaaagtgtgtttataataagacacagggacagaaattaaaactcttcaactccccaatcccagggactactgcagaagagagcttactgtttgggaaattaagtctcctgtctcaaagtataaagggtttggccatttatttttacatctttgagttatcattttggctaaatgaatgacttatttattttacaatgacctgtgatcctatttcgtgatatcctgtgttttaaacttttcatatttgacaaactttctaaaatcaaatactaaattcagtccttttgacctcactaatgttttgatattaggtcccctgaagtccaaaacagacatatttggcttattttctacagaaaaaaattatacaggaagcattgttaaatatgaaatggtgtttaacctactttgggttatatttacataaatgtgttattagtgtgtgtcctaaaatcatagaatattcctgtgattctgatatgtctcaatatatgttgtcagtagtaattacgattattatgtgtaaaattgtcatatgccacaaaagtaaccaaatttccttgtcagttgtgtctctaactatggctgctctacaacttttgtcatctacaattgttgattactttgatcctttcatagtgtggtttataatcagctatagaactttgtggaattcacatttagagaccgtgtaattgaaatggagagaaaatcttccaggactctcatggagagctgatgttttcatgaggattcctgatccaatattgaccagaagttaactgcatggactgaactaacagacaattgaaataatcttttatgactctttgtttaaaacatttgctgattttgtttttcagagtcaagaaaccttttttatcttttaagctatttacagcttttaacatttgagtaaagtatatatatatatatatatatatatatatatatatatatatatttatattttaattgaggcagaatagctgccatttcacatgcttactttattttatgtaacgtgcaggtttactgagcatgagaatagtgcttaagtaactttttcttatactaccttctttgcacatttaaaactgttgggagcaagccccccaaagtctggccataaactgaccccaaaactggccataaataaaatctctgcagcaatgtaacatgtccataatggccataacacccatgctggaaggttgtgggtttacgggaatgagggtaaggaacacctggcccacccaaggtggaaaactgcttaaaggcatttttaagccacaaacaaaagctgagcaatctgtgtcttaagggcttgttcctgctgcaattaatttggcccatcccttcttttcccttaaaggatacttttagttaatttaatatctatagaaataatgctaatgactggtttgctgttaataaatatgtgggtaaatctctgttcggggctctcagctctgaaggctgtgagacccctgatttcccacttcacacctctgtatttctgtgtgtatgtccttaattcctctagctccattgggttagagtctccccgagcgagctggtctcggcaagtggcgtccattcgtggaggctcgaatccaggtcaaagggttgctggagcgacggttggaatggaaaactagctggaagacacccaagtactcttaaagcaatccccgtgttctggaggctgggaagtccaaggtcaagatgctgacaaatgatgagagctttcttgctgcatcctcacatggaagaaggtggaagggcaagagagaagaaactaatgctaggaaatgcctcttttaaaagggacttagtcccattaacaaagaagcaggtcttatggcctaatcatctcataaaagcaccacctcttaatactatcacattggcaataccttgattttggaggggacacattcaaaccatagcagagaccactaagtatagggaagactaaacccgagaaccaagtggccagaagcctgcactagctcagctgattctgctattagacttagataaagtatgagccttttgctactgaatcaacagaaaggctgcccgaaagcagtgagtctcagatgcctcccatgaagttcacacatcacaccagggacttctactcatacgtgaaaagctagagaatcatgtttaggcttttgacttctggttttagactttctttagcttctgttgttagacaacattgtgcaagcttggtttttataagtttgcatggattaaactgaacttaatgaaattgtccctccccccaaattctcagcacaatttttaggcccacaaggagtcaagcacctcaaggagatcttcagtttgaacttggtgtagacacagggatactgatgaatcaatattcaaattagctgttacctacttaagaaagagaggagaccttggggatttcgaggaagggttcataagggagattttagctgagaaataccatttgcacagtcaatcacttctgaccaagttatcagaaaaaggagaaaagaatgtctccccactaaatgttctagggtggtgagaaatctagggtggttatctaaatcaacaatatttagatattccaatatctaaatattgttggaaatactctcctgaagtgttcattgaactctaagagagacagcttgtgtatcagtggcagggtttaaggttcattttttattcccatattaatcctttaatatttagacaaatttccttctgagtttaaggataaaatgggatgggttctgcctgggcctggccctcatggggacatcaaagggcaatgttgcaaaaaaaaaaaaaaaaaaaaaaaaaaatcagaccatcagattgcatggggggaaccacccccataattaaattacctccacccagtcccacccttgacacctggagattatggggattgcaattcaaggtgagatttgggtggagacatagagccaaagtatattattcaaataagaaatcaaaagagaaattggaaagttcattgagctgaaaatgaaaacacgatatatcagaatcagggagttgcagctaatgtatgcttggaggcaaatttaagcactaagatcctatattataacaaaaaagaaaggtctcaaatcagtgacctgagttttcaccttcagaaactggaaagagaagagcaaattaaacacaatgtaagcagataaagaaaataataaaaagaacagaaatcaatgaaagaaaaaaagggaaaattataagaaaaatccaagaaagtaaatgctaatcattttaaacaatcaattaaattgttagacttctagtcagctgatc

SEQ ID NO: 729335 - DNA, 1166 bp, Homo sapiens
ccacgcgtccgcggacgcgtgggcggacgggtgggctgttgttagacaacattgtgcaagcttggtttttataagtttgcatggattaaactgaacttaatgaaattgtccctccccccaaattctcagcacaatttttaggcccacaaggagtcaagcacctcaaggagatcttcagtttgaacttggtgtagacacagggatactgatgaatcaatattcaaattagctgttacctacttaagaaagagaggagaccttggggatttcgaggaagggttcataagggagattttagctgagaaataccatttgcacagtcaatcacttctgaccaagttatcagaaaaaggagaaaagaatgtctccccactaaatgttctagggtggtgagaaatctagggtggttatctaaatcaacaatatttagatattccaatatctaaatattgttggaaatactctcctgaagtgttcattgaactctaagagagacagcttgtgtatcagtggcagggtttaaggttcattttttattcccatattaatcctttaatatttagacaaatttccttctgagtttaaggataaaatgggatgggttctgcctgggcctggccctcatggggacatcaaagggcaatgttgcaaaaaaaaaaaaaaaaaaaaaaaaaaatcagaccatcagattgcatggggggaaccacccccataattaaattacctccacccagtcccacccttgacacctggagattatggggattgcaattcaaggtgagatttgggtggagacatagagccaaagtatattattcaaataagaaatcaaaagagaaattggaaagttcattgagctgaaaatgaaaacacgatatatcagaatcagggagttgcagctaatgtatgcttggaggcaaatttaagcactaagatcctatattataacaaaaaagaaaggtctcaaatcagtgacctgagttttcaccttcagaaactggaaagagaagagcaaattaaacacaatgtaagcagataaagaaaataataaaaagaacagaaatcaatgaaagaaaaaaagggaaaattataagaaaaatccaagaaagtaaatgctaatcattttaaacaatcaattaaattgttagacttctagtcagctgatc

SEQ ID NO: 729336 - DNA, 676 bp, Homo sapiens
aggggctaacatggagaatcataattctgccttagctgctgaagctagtgaagaaagtttattttcagcctctaaaaatttaaatatgcctctaacaagggaatcttctgtcagacagataattgcaaattcatctgtccccattagaagtggtttccctcctccttcaccttcaacctcagttggaccatcagaacaaattgcaacagatcaacatgctattttaaatcagttgaccactattcatatgcactctcatagtacctacatgcaagcaaggggccacattgtgaattttattacaaccacaacttctcaataccacatcatatctcccttacaaaatggttattttgggctgacagtggaaccatctgctgttcccacacgatatcctctggtatcagtcaatgaggctccatatcgtaacatgctaccagcaggcaacccgtggttgcaaatgcctacgatcgctgatagatcagctgcccctcattccaggctagctcttcaaccatcaccactggacaaatatcaccctaattacaactgatctgccattaaaagaggaccagattatgaatgacaacagagactaacatttacattgacaaaaaaccctaaaaatttctgcaattatcttattgaacaataaaattgcatgtttacttctaaa

SEQ ID NO: 729337 - DNA, 1109 bp, Homo sapiens
tgccaggcacagggttaccatggtgacagaggctggctgggaggggctggggcgccacgaacccagcctgctcctcaaccctctctcggccctccaggcatcacagtgcaccgctgcccttctgcggtgggcaggggtctcggaggaccagagaagctggggccgggagcctgcacctgagacgtcctgggagctggcctgcccgccacacgccccactcttcccaggccacgtggaagacacttgaagtgggctggtggaatgtcgccctgcctcggctcctttcccgtcaacaggaccctctcccttctcccgggtgccggcataggggtcaaaagccccccaggattctgaatcacagctgcacactctgggggcactgccatgtggctttctaggaagaaaaagcacctgcctgattcccaagtccctcagccccaagggaccacagcttcggaaagggatgtggggtgggcacagggcgggcaggggtccacaagagagctgcagggggttccgggacagcactgggctgggaagttgggggacttgaggctaagctgctgtgtgaccctggggttgtcaactcccttctctgggcctcagtttccccccctctctaaagtggaaggagacattgcccgatgtctaatgctaaatctgcaggtgacttgactcccagcttgggaagggaccctctccctgccctagaggggcttcagtccctctctactccagctttcttgacccccacacctgtttctagccccagaccccccagaccccacaccctctcttggcttccttcctccccccgccagccccccggccctgcacaccccagcagagtccctgggcagcacagtaaagacgactggtttcggtatcagtttgtaaactttaaggaaaatgtgtctctgttttcctgtccgttattgtcggatgttggtttgttcacagtcgggtggtggtcaggtgtgtgtgtgcgtgcgtgcgtgcgggtctgcatgtgcgtcctctcctgggccttggcccccgagtctgctccccgccctggccgcctggacccttcccccaaaaggcccccagccctctggctccgacctcac

SEQ ID NO: 729338 - DNA, 2035 bp, Homo sapiens; identical to SEQ ID NO: 728366

SEQ ID NO: 729339 - DNA, 634 bp, Homo sapiens
gacgaaaaccatgaagtgggaagcgaggaagaggaaataccattcaggtgtttcatatgtcgccaggccttccaaaacccagtcgtcaccaagtgcaggcattatttctgcgagagctgcgcgctggagcacttccgggccaccccgcgctgctacatctgtgaccagccaaccggcggcatctttaaccccgccaaagaactgatggcgaaactgcaaaagcttcaggctgcagaaggaaaaaagagataagaaagactcaagtctgtatgtacactggggagaagcagcctgttgagtaagatgagagagatgacagtcttcctgcaatcccatgcctgagtatgtaaccaaaagaattgaaatccggatctcaaagaggtatgtgcactcccatgttcactgcagaattatttgcaaaagccaagaggtgtaaacaacccaagtgtccatggatggatgaatggacaaacaaaatgcgatacacacacacaatggaatgctattaagccttaacgggaaggaaatccttttaaagatttaaactgatccttttaaggatcacatgctacaactagaatgaaccttgaagacgacactgctaagtgaaataaactagtcacaaaatgaaaaa

SEQ ID NO: 729340 - DNA, 335 bp, Homo sapiens
gaaaaaagagataagaaagactcaagtctgtatgtacactggggagaagcagcctgttgagtaagatgagagagatgacagtcttcctgcaatcccatgttcactgcagaattatttgcaaaagccaagaggtgtaaacaacccaagtgtccatggatggatgaatggacaaacaaaatgcgatacacacacacaatggaatgctattaagccttaacgggaaggaaatccttttaaagatttaaactgatccttttaaggatcacatgctacaactagaatgaaccttgaagacgacactgctaagtgaaataaactagtcacaaaatgaaaaa

SEQ ID NO: 729341 - DNA, 1401 bp, Homo sapiens
agcgggtgggtgggcgcgcggggctgtaggatccacccgcctcgggatccacggagctgggtccccgccgcgccccgcggaccccacggcccttccgctccgctcggcctccaccaccctggcctcgagctgcagccgttccaaggacaacggccatccctgtggctgggccgccggctacgcaatgctgtctctcttgctgatcctctcaggcctgggccggctgacctccgcgggcccacgccacttattccatcaaaattgaggggaaaccatacacttcctgcttgaaaaacagtcatttttacacccacatttcctggtgtatttatacaacaaatcaggaacattgtatgcagattcttcattttcaaagggtcattgcttttaccaaggatatgctgcagacattccaaaatcagttgtggcactacgcacctgttctggactcagaggattactgcagttagataatatcagttatggtattgaaccattggaatcttcacctacatataagcatgtagtttatcgaattaaaaatgatgctattggtcattcctcctttcaagaaaattatcctgtggctcaatatatagatcagtcctacaggattcttgtcaaatcagacataaattcaggtgccatgctatcgaaaagaactctgaaaatacaaatcattatggataaagccatgtatgcttatatgggctccacggtggcagttgcagttgagaaagttttccaaatctttggtcttatcaacactatgttttcccagcttaatatgacagttatgctgtcttccttggagatctggtcagatcacaataagatttcaacaagtggtcatgctgatgaaatactacagcgatttttgccttggaaagaaaaatttttgtttcaaaggtctcatgatatgacatacttattaatttataggaaccattctacttatgtgggagcaacatatcacggaatggcatgcgatccaaagtttgcaacaggaattgctctgtatccaaagaaaatcactgcagaggccttttcagttgttatggcacagttgcttggaattaatctgggattgacatatgatgatatctacaattgttactgtccaggaactacatgcataatgaatcctgatgcgatacgatcccatggtcttaaatggaataaaatgaagagattttggagcaaagtgggaacagtaagcagcagatctatctcagaagacagcagtagtaacagcagccagtcacagagttaaagtaaccaagtgataaaatcaaagccatcggatgaagaaaggatattaccaagaaactcacgattaacttaaaactttcaacttcacagaaaaaaataaatcatatgactaaaagcataaaaaaaaaa

SEQ ID NO: 729342 - DNA, 446 bp, Homo sapiens; identical to SEQ ID NO: 636679

SEQ ID NO: 729343 - DNA, 582 bp, Homo sapiens
cgccggacaccgtcgccaagtgcggcgggcggagctagagccgtagccaatcgaggaacggcagcctacaagcctcgtgttgattggctactgcagacgaggagggcggtgctagtaggagggcacaggcccagggtgtcctcgcaacgggcgtcccggggagctgctgaagtcctccccgctgcagaggaccgagaggcagggcccgggagagaacagcccggtcggagggggtgggccgtcagccgccccggaaagctgcgtttcccggtgattaagtgtagcacccgcccccggtaggtcctgagaggggcgagattagttgggtacttaccatgtgggcctggcacttgcccacatcactttgtgtcttcccaccggccctgcgagggtgggggttgccgtcctcagtttccaggcgggggaaacgggctggaagcgtcactcagctaatagtagtggacctgggactggaactcagatttgctaaggaaccaggcaggttctttcctgttttctgcacgggagcattttaaccagcaattaaagaaaccttatttctaggtaatttttaaaagaaaa

SEQ ID NO: 729344 - DNA, 748 bp, Homo sapiens
agcgattaagtcactcgcctaaggagaatgagtcaacgtcaagagtcatagttgacccggcctaaagactccagaccatcagtccagggcttagtcagcggggcccggagtggcttccctggctggcatctggacttaggctatttccgtgcacgtaaaagcggaatattggaacggttgcacagaacttccaaataatttttaccgccacgcaagatttagccctgaggtcttaatctcaggatttgggacagtaaaagctgtcgtccctccccctcgtccagccggtggcaagcgggtactgcgggcggttccgtccgtcccctttcgcagaaatggcaacgaatgaccaccagcattagctgagccaggggacgtgggagggttgattgcctaaacgactctgcatcgccgcctctttttgaaactaagagaaaatggtgggagatcaaaagaaaactaaataaacacacaggcaacttgtcctgggacctcaactaagcaaatgaagccttattgtgtgtgctgagcctgcagttcccaaccttccggggaagatgggaggacagggcgacaaagggcacagtaggcttgcctggcagtaagtgtgaccgcagctatccaggcggaagagcagaggactgaaaccaccctccagcaagcgagtgtccgccgcgttgagaaccgcgcaccctacccatcggccacgtgaccagtcctttttaaaaaaaatttctttaccttaaaa

SEQ ID NO: 729345 - DNA, 2556 bp, Homo sapiens
gagcgaagcgcagcatgctgggtcgagtgggtggaatagtccagtgggtgggaagcaagcacgtccttcttcacaagatggcagaagaaagaagtgccgagcaaagggggaaaaagccccttataaaaccatcagattttgtgagaactcactcactatcaggagaacatgagggtaactgctcccatgattcagttacctcctaccgggaccctcccatgacatgtggggattgtgggaactacaagacgagatttgggtggggacacagcaaaaccacatcagaaaataaatttataataggtcggcggtacagtcagcaggtggcaaagtgggacagacttgtgtcctttccttcagggcggcaagttcccccagaccccgggtggtcagcaggtgatgggtcctgccaaaactggttccttcccttcaaggcagcaagtttccttctggcccagggtgtgcctagaaatgtcatttgggagctagggcctggaaagggggccttaccactgtgccctctcctacggtggctgagctagtattctagatgcaagacaaagtcctctttattctcccctctcttcgcctcccctccccaaaaagaaggagtctctttcagagctgtgttaaatttggtgttcctgttagggggatgattggtgcaggattctattatgccatcttgttttttcccccagtctttggtcttttcatgttttcttttttgtacttgctttagaataaattgactatttatattcattgcctaattttctattgacttgtatatttttcttgtgaaagaactagatagagatagtggttgtaccatattgtgaatgactaattgtaaatgtcactttattgttcactttaaatgattacttttacattgtgtaaatttcaactcaattttaaaaatttaaaaatggaacaagggagaggatttagaaggttctaaatgctaaaagaagttaatgatagaattcaggtgaggtcataaaagatagtactgcttctgcctagctcactcaagaacccagcccccatagtgtgaggaggcctaggacagttacagaagccatgtgtaggtgttctggctccagcaaaagtcttatctgacaacatcaactacatgttagtggcctttccttgaaattgctggagcttgtgcatcatcaaaataatggcataaaccaaggaagaagaaaacaaaattgaggaaatgggatccaacacaaaagagagacaacaggattaattgagtgttggtgaaaagccacagcctgtaaataatgcagttcgaactgaaatagaccaggaggctcaaggagagacttcttcaagaagataaaattgatagaatgcctaaggagtttgagtgcattgagaatagattcatatcagttctggagaactgggtggatacattaatgttaagtacatagaaaagttaaaaatgaaaaaaattctcaattctagggaaaataatcatagtaaactacatgttttagttaccaatagtgtttacgtagtcaatataaacaatgggcattgatataaataatgtatgttgatctgctataacaaggtaaaatgctattggggaaacaagataacctgtgtgtgtgtgtgtgtatgtttgttgaaattattgcttttatatggaaaagatttaaattattagcttctgcaataaataatatagataataatgcctataactaaagttagtaacagtataagactataacaatgttatttaggaatttggggcaaataccaaaaaccagcaaaaagagttgaaagcaattcagggagtgagaaatttgaagtgtggggggatctaattttttcatatctaaccttgtagaagttttaaatgatgcacatgtgtaactctgctaaaaatagccccctaaattataaataaaaggaaatcatgggataagacagaccaagaggtgtaatattaggagttctaggaggttaaaaaaaaaagaaaatgtgagagaaaatagtatgattatattagaagaaacctacatctgcaacttgaagagtgccccagtctctctaatccaagctttatttaggatggatgaggaaaaaaaggtaataggcatattcctataaaattttcagactccaaagataatgataaaatcttacagggtccagatagaaaaaaaacgttagttggaaaggacaaataatcagacatacattacatttcctgtgtgcacttcttgagactggaatgtggtggtttaatggtagtagaccagaagattacacccatgaatcttaggctaggctaagctaagctatcagttacctcttagggagaaagatgtttgcagatgtgtgagaattcagagattagagaagtcttgagaaaatataccagtcaacaaaagggcttgaacagtgactctaggatatgagaagataatgaagggaaatagtggtaagcaataatcttggcagtatacacgattttctttttttttttttcattatactttaagttctagggtacatgtgcacaac

SEQ ID NO: 729346 - DNA, 564 bp, Homo sapiens
gctaaggtcctgcacataaccacaaccacccccactgctcggctctacttcttccacaacatgaattctggcatctttccatgtttctataattttctttccagttagcgttgtcaccctggtgcattgcttcctgagattattccgggagaatgctttaatttcctggttaagggagtacattacatgagcagtggctgggaacaaatacaaacaaatccagcaggcatagaaaacggctgaactgctagtcccttattgcccaggtaacaaagccagcctcagaggtgctcgcccatccaggtaaccgcagcagccacagaccaagagactgagtcgtccagctccgtttatcccagcgatgcaatgtaaggcgaaatttgattggtcattgagacacaagtgccgattggatgctgtttcttcttcctgtcagccagaaacctgcattttcccgaaaggctcgagggatccactggggaagatttcttattgttgctgtttaaatttagctttctaatacacgcagaatggtaaaatataagacttcgttggagagaggaa

SEQ ID NO: 729347 - DNA, 923 bp, Homo sapiens; identical to SEQ ID NO: 74035

SEQ ID NO: 729348 - DNA, 765 bp, Homo sapiens; identical to SEQ ID NO: 74036

SEQ ID NO: 729349 - DNA, 445 bp, Homo sapiens
gcacagtaggaggaacccagaagatgctgcctctcctgatcatctgtctcctgcctgccattgaagggaagaactgcctccgctgctggccagaactgtctgccttgatagactatgacctgcagatcctctgggtgaccccagggccacccacagaactttctcaaagtattcactccttgttcctagaggataataattttctcaaaccctggtaccttgatcgtgaccatttggaagaagaaacagccaaattcttcactcaagtacaccaagccattaaaacgttacgagatggtgaggaagccaagagccccagggccttggggcttgggttgacaaaggcccaccctccaaggcattctcagaggcccatgtggccatgggtgggaggtcttgtgaaggtgggagatgaatgcagtctgtctccgtgtgctctttggaa

SEQ ID NO: 729350 - DNA, 524 bp, Homo sapiens
ataaaacagtacttctggaagagatctacacgcacaagaatctctttactgagaggctgaataagatatctgatgggctgaaggagaaggacatacagtccacactgaaggtcaccagctgtgctgactgcaggactcacttcctctcctgcaatgaccccactttctgcccagccaggaaccggcggacctccctgtgggctgtgagtctcagcagtgctctactcctggccatagctggaggtgatgtttcttttactggcaaaggaagaaggaggcagtaaagcaggaacagggcagcccgcatgtcttccagaagtgaacagaggccgcagctaccaccgtcacaaagttcactcatctctgggtcccggtgaccccatccccccataccctccatcctgggtcctggggccccaaagctctgaggcctaggagactgcgctgtctcgtggtttgcctactcctacacctttgtaaagagtctcttcattaaaacccctcttcatagcctaaaaaactgt

SEQ ID NO: 729351 - DNA, 495 bp, Homo sapiens
ataaaacagtacttctggaagagatctacacgcacaagaatctctttactgagaggctgaataagatatctgatgggctgaaggagaaggcacctcagtttctctaccttctcaccctccctggcagcctgcaatgagtcctgtgccaggaaccggcggacctccctgtgggctgtgagtctcagcagtgctctactcctggccatagctggaggtgatgtttcttttactggcaaaggaagaaggaggcagtaaagcaggaacagggcagcccgcatgtcttccagaagtgaacagaggccgcagctaccaccgtcacaaagttcactcatctctgggtcccggtgaccccatccccccataccctccatcctgggtcctggggccccaaagctctgaggcctaggagactgcgctgtctcgtggtttgcctactcctacacctttgtaaagagtctcttcattaaaacccctcttcatagcctaaaaaactgt

SEQ ID NO: 729352 - DNA, 697 bp, Homo sapiens
gcacagtaggaggaacccagaagatgctgcctctcctgatcatctgtctcctgcctgccattgaagggaagaactgcctccgctgctggccagaactgtctgccttgatagactatgacctgcagatcctctgggtgaccccagggccacccacagaactttctcaaagtattcactccttgttcctagaggataataattttctcaaaccctggtaccttgatcgtgaccatttggaagaagaaacagccaaattcttcactcaagtacaccaagccattaaaacgttacgagatgataaaacagtacttctggaagagatctacacgcacaagaatctctttactgagaggctgaataagatatctgatgggctgaaggagaaggccaggaaccggcggacctccctgtgggctgtgagtctcagcagtgctctactcctggccatagctggaggtgcaggaacagggcagcccgcatgtcttccagaagtgaacagaggccgcagctaccaccgtcacaaagttcactcatctctgggtcccggtgaccccatccccccataccctccatcctgggtcctggggccccaaagctctgaggcctaggagactgcgctgtctcgtggtttgcctactcctacacctttgtaaagagtctcttcattaaaacccctcttcatagcctaaaaaactgt

SEQ ID NO: 729353 - DNA, 737 bp, Homo sapiens
gcacagtaggaggaacccagaagatgctgcctctcctgatcatctgtctcctgcctgccattgaagggaagaactgcctccgctgctggccagaactgtctgccttgatagactatgacctgcagatcctctgggtgaccccagggccacccacagaactttctcaaagtattcactccttgttcctagaggataataattttctcaaaccctggtaccttgatcgtgaccatttggaagaagaaacagccaaattcttcactcaagtacaccaagccattaaaacgttacgagatgataaaacagtacttctggaagagatctacacgcacaagaatctctttactgagaggctgaataagatatctgatgggctgaaggagaaggccaggaaccggcggacctccctgtgggctgtgagtctcagcagtgctctactcctggccatagctggaggtgatgtttcttttactggcaaaggaagaaggaggcagtaaagcaggaacagggcagcccgcatgtcttccagaagtgaacagaggccgcagctaccaccgtcacaaagttcactcatctctgggtcccggtgaccccatccccccataccctccatcctgggtcctggggccccaaagctctgaggcctaggagactgcgctgtctcgtggtttgcctactcctacacctttgtaaagagtctcttcattaaaacccctcttcatagcctaaaaaactgt

SEQ ID NO: 729354 - DNA, 373 bp, Homo sapiens
ggaccattagcatggctgccttgccctctgctctgggttgggtttggccaggggagactcccaggaggaagttagagagacagggaggaggccagagtagtgggaggtcagggtagaaatgcccagcttcttctccctcagcaggaacagggcagcccgcatgtcttccagaagtgaacagaggccgcagctaccaccgtcacaaagttcactcatctctgggtcccggtgaccccatccccccataccctccatcctgggtcctggggccccaaagctctgaggcctaggagactgcgctgtctcgtggtttgcctactcctacacctttgtaaagagtctcttcattaaaacccctcttcatagcctaaaa

SEQ ID NO: 729355 - DNA, 453 bp, Homo sapiens
ggtaaacagcacagatgctgggagagggctggcatctgaccgtgaccatcacgcccatgtgacaaaggatgtcaccacagtgaacagttctgaccacagtggcttttcacctgcttcgttaaatttaactcacaccggctcagaggacaatttgattcattctgtatctcagcagaaaccagagcacctcagaagatcaaggcttccaaattctcctgggggaacagacgtcagccattcagcacaaaggaaacttccttctctgtatgtcagaggaagacataattgtgccatttccttcttgaagaagtttacaaacatttgcaagttgtcaaaaataattagtctaaaattgtttcataaaccgtggaatgaaacaggacgtgccttgttgagatcaaagggcttctgttaccttcttgtaaactcaaatgaaattcttttgaaagtaaa

SEQ ID NO: 729356 - DNA, 2720 bp, Homo sapiens
aactcagccctcctctgtcccccaggtcagggagtgggtgatggtgagaagggagcaaacaagcctcttgggagagagtgcagggaagtgcactgatgttttggagtaccttccattaccatcattgtgcttaacgtgttcgttacgaagcagcctggtgatgcttgcttctcctcctatgggtgactcctcctctgtccaacaggggagcctcacggtgggtgcctttgctcaaagaggacccatcctcagggagtttgcagccagccgaagggcagccaggagtgaagagtgaatggaagggtgccaaggtcggagctgatattggttatctcatcgggccttgcagcagcgccgcagatattctgcctcccattttgcccgcggggacgccgaggcccggcgccgcatcctgccgcccgttttgcccgcggggaagccgaggcccgatgccgtaccctgccgcccgttttgcccgcggggaagccgaggcccggcgccgcatcctgccgcccgttttgcccgcggggaagccgaggcccggcgccgtatcctgccgcccgttttacccgcgaggaagccgaggcccggcgccgtatcgtgccgcccgttttgcccgcggggaagccgaggcccggcgccgtatcctgtggccgttttacccgcgggaaagtcgaggcccggcgccgtatcctgccgcccgttttacccgcgaggaagccgaggcccggcgccgtatcctgccgcccgttttacccgcggagacgccgaggcccgatgccgtatcctgccgcccgttttacccgcgggaaagccgaggcccggtgctgtattctgccgcccattttacccgcggggaagctgaggcccagtgctgtttaatatcttactcatgttcacttgatgagaaagtgacagatctgagacaaacccagttctagaggttatgacaccagccatggaagagcagagaggccaatgaggtggggaggttggaaacaaaaggccttctccaccccagcttgaccaacccaaaagctggaaggcaaggaagacctagatcgacagaaaagaaatgagtcaacgatggtgcagaaagggaccagcttgacgaagcttctgcttttgtgactgtctcctaatgcagaaaccagagcacctcagaagatcaaggcttccaaattctcctgggggaacagacgtcagccattcagcacaaaggaaacttccttctctgtatgtcagaggaagacataattgtgccatttccttcttgaagaagtttacaaacatttgcaagttgtcaaaaataattagtctaaaattgtttcataaaccgtggaatgaaacaggacgtgccttgttgagatcaaagggcttctgttaccttcttgtaaactcaaatgaaattcttttgaaagtaaactcttggaattagcagtggtttttgtggcacatgtatggcagggggaggggagcagaatgattcagatagcagagtccaggggagagccgggaggagtaaagccctgtccacagagaatgggaatgggtcttgaacagccatggtgatctgtgccagtgggcacaggacttcttcaacgggaagctcaggcattcaggaaacactcatttcggtgatcttgaacttgcaagacaccgccggctcctacaagcaggccctggagaagccacttcacctccgcgtctcaggccactcacctccaaagacagatgcaaactccgcctccctcctcggtgagagggtcccctcttctctgcttgcagatttcgatgagttcttggctgacttcaaacctggaactgctgtggttttggagatccggggcacagtcaactacgtgacctggtgctcagcaggcaagaaggagcaggagaagcatggctactcactggaacaaggaggctgtgctgggggccaggtagcccaggccagaccgcagtgcagagaagaaagtattaaaggcagaagcagacacagtgaagacacaggtcggcctgacttcgaagtgtgagttatgtcactctgatagtgggtcctaaagtgcagatgtgtttgggtgatgcttttcagtagcctatggacatggcaccaagtgacaatgacttccgtgcctaaggagtgttctgaatgcagaacagggagcacctcctccgggttgggagagatgcctctgcccccacctgcccagtatcggcctctgtgcatagcagtactgggctttcctggaacccatgtttcatgacaaatgaggctggagatgaagtcagcaggaagttgcatgaaaccggttgattctctggtggagctgtgcatggcaaggaagcatcagcacagggaagtgtgcctgaccggatggcagatggggaaggatgctgagagaaattaatgcaagctgagaccatatgtgcactgataggctcctcaccactctactgggtcgaacagtgtcccccctataatccatgtccactcagaacctcagaatgtgaccttatttggaaatagagtctttgcagatataactggttaagatgaggttgtactagattagggtggatcttaattggccaatgtccttataagaagaggaaaatttggatgcagagatggactgagaagaaggccatgtgaagaaggccatgagaagaaggactggagaggaatagctgccagtcattgatataaaaatggagtc

SEQ ID NO: 729357 - DNA, 685 bp, Homo sapiens
ggtaaacagcacagatgctgggagagggctggcatctgaccgtgaccatcacgcccatgtgacaaaggatgtcaccacagtgaacagttctgaccacagtggcttttcacctgcttcgttaaatttaactcacaccggctcagaggacaatttgattcattctgtatctcagcagaaaccagagcacctcagaagatcaaggcttccaaattctcctgggggaacagacgtcagccattcagcacaaaggaaacttccttctctgtatgtcagaggaagacataattgtgccatttccttcttgaagaagtttacaaacatttgcaagttgtcaaaaataattagtctaaaattgtttcataaaccgtggaatgaaacaggacgtgccttgttgagatcaaagggcttctgttaccttcttgtaaactcaaatgaaattcttttgaaagtaaactcttggaattagcagtggtttttgtggcacatgtatggcagggggaggggagcagaatgattcagatagcagagtccaggggagagccgggaggagtaaagccctgtccacagagaatgggaatgggtcttgaacagccatggtgatctgtgccagtgggcacaggacttcttcaacgggaagctcaggcattcaggaaacactcatttcggtgatcttgaacttgcaaga

SEQ ID NO: 729358 - DNA, 1123 bp, Homo sapiens
ggtgccaaggtcggagctgatattggttatctcatcgggccttgcagcagcgccgcagatattctgcctcccattttgcccgcggggacgccgaggcccggcgccgcatcctgccgcccgttttgcccgcggggaagccgaggcccgatgccgtaccctgccgcccgttttgcccgcggggaagccgaggcccggcgccgcatcctgccgcccgttttgcccgcggggaagccgaggcccggcgccgtatcctgccgcccgttttacccgcgaggaagccgaggcccggcgccgtatcgtgccgcccgttttgcccgcggggaagccgaggcccggcgccgtatcctgtggccgttttacccgcgggaaagtcgaggcccggcgccgtatcctgccgcccgttttacccgcgaggaagccgaggcccggcgccgtatcctgccgcccgttttacccgcggagacgccgaggcccgatgccgtatcctgccgcccgttttacccgcgggaaagccgaggcccggtgctgtattctgccgcccattttacccgcggggaagctgaggcccagtgctgtttaatatcttactcatgttcacttgatgagaaagtgacagatctgagacaaacccagttctagaggttatgacaccagccatggaagagcagagaggccaatgaggtggggaggttggaaacaaaaggccttctccaccccagcttgaccaacccaaaagctggaaggcaaggaagacctagatcgacagaaaagaaatgagtcaacgatggtgcagaaagggaccagcttgacgaagcttctgcttttgtgactgtctcctaatgcagaaaccagagcacctcagaagatcaaggcttccaaattctcctgggggaacagacgtcagccattcagcacaaaggaaacttccttctctgtatgtcagaggaagacataattgtgccatttccttcttgaagaagtttacaaacatttgcaagttgtcaaaaataattagtctaaaattgtttcataaaccgtggaatgaaacaggacgtgccttgttgagatcaaagggcttctgttaccttcttgtaaactcaaatgaaattcttttgaaagtaaa

SEQ ID NO: 729359 - DNA, 681 bp, Homo sapiens
  misc_feature (16)..(16): n is a, c, g, or t
  misc_feature (76)..(76): n is a, c, g, or t
ttagctgctctccccnatttctcctttcctctccattcttcttcccttctcccatatatccccttcctaaccacancttcctcagcggccgcataacaaatgtttcaacgatggtgcagaaagggaccagcttgacgaagcttctgcttttgtgactgtctcctaatgcagaaaccagagcacctcagaagatcaaggcttccaaattctcctgggggaacagacgtcagccattcagcacaaaggaaacttccttctctgtatgtcagaggaagacataattgtgccatttccttcttgaagaagtttacaaacatttgcaagttgtcaaaaataattagtctaaaattgtttcataaaccgtggaatgaaacaggacgtgccttgttgagatcaaagggcttctgttaccttcttgtaaactcaaatgaaattcttttgaaagtaaactcttggaattagcagtggtttttgtggcacatgtatggcagggggaggggagcagaatgattcagatagcagagtccaggggagagccgggaggagtaaagccctgtccacagagaatgggaatgggtcttgaacagccatggtgatctgtgccagtgggcacaggacttcttcaacgggaagctcaggcattcaggaaacactcatttcggtgatcttgaacttgcaaga

SEQ ID NO: 729360 - DNA, 963 bp, Homo sapiens
ggtgccaaggtcggagctgatattggttatctcatcgggccttgcagcagcgccgcagatattctgcctcccattttgcccgcggggacgccgaggcccggcgccgcatcctgccgcccgttttgcccgcggggaagccgaggcccgatgccgtaccctgccgcccgttttgcccgcggggaagccgaggcccggcgccgcatcctgccgcccgttttgcccgcggggaagccgaggcccggcgccgtatcctgccgcccgttttacccgcgaggaagccgaggcccggcgccgtatcgtgccgcccgttttgcccgcggggaagccgaggcccggcgccgtatcctgtggccgttttacccgcgggaaagtcgaggcccggcgccgtatcctgccgcccgttttacccgcgaggaagccgaggcccggcgccgtatcctgccgcccgttttacccgcggagacgccgaggcccgatgccgtatcctgccgcccgttttacccgcgggaaagccgaggcccggtgctgtattctgccgcccattttacccgcggggaagctgaggcccagtgctgtttaatatcttactcatgttcacttgatgagaaagtgacagatctgagacaaacccagaaagggaccagcttgacgaagcttctgcttttgtgactgtctcctaatgcagaaaccagagcacctcagaagatcaaggcttccaaattctcctgggggaacagacgtcagccattcagcacaaaggaaacttccttctctgtatgtcagaggaagacataattgtgccatttccttcttgaagaagtttacaaacatttgcaagttgtcaaaaataattagtctaaaattgtttcataaaccgtggaatgaaacaggacgtgccttgttgagatcaaagggcttctgttaccttcttgtaaactcaaatgaaattcttttgaaagtaaa

SEQ ID NO: 729361 - DNA, 998 bp, Homo sapiens
ggtgccaaggtcggagctgatattggttatctcatcgggccttgcagcagcgccgcagatattctgcctcccattttgcccgcggggacgccgaggcccggcgccgcatcctgccgcccgttttgcccgcggggaagccgaggcccgatgccgtaccctgccgcccgttttgcccgcggggaagccgaggcccggcgccgcatcctgccgcccgttttgcccgcggggaagccgaggcccggcgccgtatcctgccgcccgttttacccgcgaggaagccgaggcccggcgccgtatcgtgccgcccgttttgcccgcggggaagccgaggcccggcgccgtatcctgtggccgttttacccgcgggaaagtcgaggcccggcgccgtatcctgccgcccgttttacccgcgaggaagccgaggcccggcgccgtatcctgccgcccgttttacccgcggagacgccgaggcccgatgccgtatcctgccgcccgttttacccgcgggaaagccgaggcccggtgctgtattctgccgcccattttacccgcggggaagctgaggcccagtgctgtttaatatcttactcatgttcacttgatgagaaagtgacagatctgagacaaacccagatcgacagaaaagaaatgagtcaacgatggtgcagaaagggaccagcttgacgaagcttctgcttttgtgactgtctcctaatgcagaaaccagagcacctcagaagatcaaggcttccaaattctcctgggggaacagacgtcagccattcagcacaaaggaaacttccttctctgtatgtcagaggaagacataattgtgccatttccttcttgaagaagtttacaaacatttgcaagttgtcaaaaataattagtctaaaattgtttcataaaccgtggaatgaaacaggacgtgccttgttgagatcaaagggcttctgttaccttcttgtaaactcaaatgaaattcttttgaaagtaaa

SEQ ID NO: 729362 - DNA, 458 bp, Homo sapiens
tcttcattctttccgccatcttgattctttctcactgaccaagactcagccgtgggaaatatgagtgagcttgtaagagcaagatcccaatcctcagaaagaggaaatgaccaagagtcttcccagccggttggatctgtgattgtccaggagcccactgaggaaaaacgtcaagaagaggaaccaccaactgataatcaggggcctgacatggaagcttttcaacaggaactggctctgcttaagatagaggatgagcctggagatggtcctgatgtcagggagggtattatgcccacttttgatctcactaaagtgctggaagcaggtgatgcgcaaccataggtttcaagcaagacaaatgaagactgaaaccaagaacgttattcttaatctggaaatttgactgataatattctcttaataaagttttaagttttctgcaaagaatccttaca

SEQ ID NO: 729363 - DNA, 457 bp, Homo sapiens
tgggaaatatgagtgagcttgtaagagcaagatcccaatcctcagaaagaggaaatgaccaagagtcttcccagccggttggatctgtgattgtccaggagcccactgaggaaaaacgtcaagaagaggaaccaccaactgataatcagggtattgcacctagtggggagattgaaaatcaagcagtgcctgcttttcaagggcctgacatggaagcttttcaacaggaactggctctgcttaagatagaggatgagcctggagatggtcctgatgtcagggagggtattatgcccacttttgatctcactaaagtgctggaagcaggtgatgcgcaaccataggtttcaagcaagacaaatgaagactgaaaccaagaacgttattcttaatctggaaatttgactgataatattctcttaataaagttttaagttttctgcaaagaatccttaca

SEQ ID NO: 729364 - DNA, 698 bp, Homo sapiens
cggggccgggctgctgggtccgagctctgggcacgatgtcctccctgacgccgccaggacagcgcctgggcccaggcctgggcctggtgaacgcgggtttcttcctctgaggttcaacactccgcacttgggttggctcctttcatcctgattggtttattcgccacgtgccaagcactgaagagggcgtgcaggatggatacttttggagcaaaaatagccctgcttctttcctggggagggatcgcactttctagaggggcggttctcaaagtatggtctcaggactagcagcgtcgaaaatgctgggaactcgttagaaaagcaagttttcaatcctcgccccagaatcagaaactcggggtggagcccagcaatgtgtgtcctgacaagtccacgcgcgaccccagtgctggctagggttgcaaagccactgctctacggagcgagcgagatccatcatagtgggacaagcgagaggatgaggccatacagaccagggcaagttttgagcgtgcagatccaccagctgcttgaagccaggggcaccaggatgtctggtcccccagctcagggatcctgtctccccacaaaaagcagcagcagaagacccctctttgagttctgaacatgttcctagattttcccagtatctatggggattgagagattgataaaggctgcttggagctgaaaaa

SEQ ID NO: 729365 - DNA, 586 bp, Homo sapiens
cggggccgggctgctgggtccgagctctgggcacgatgtcctccctgacgccgccaggacagcgcctgggcccaggcctgggcctggtgaacgcgggtttcttcctctgaggttcaacactccgcacttgggttggctcctttcatcctgattggtttattcgccacgtgccaagcactgaagagggcgtgcaggatggatacttttggagcaaaaatagccctgcttctttcctggggagggatcgcactttctagaggggcggttctcaaagtatggtctcaggactagcagcgtcgaaaatgctgggaactcgttagaaaagtactgttccacgcacttgacaccaatccacccatttcacctgcatgatcaccctgcctttgcatgagttgccggtgtggacagagcagggacacagtgagacagcggattccagctttgctcttacctagaacacactgcctctcaccaggaatcgtccttccattttatgcagttatcccagacaatgatgcacaagctttgggaaaaaaaccccacaagtccaaaggtgtacttcataataaaggcaagttatctgtca

SEQ ID NO: 729366 - DNA, 934 bp, Homo sapiens
cggggccgggctgctgggtccgagctctgggcacgatgtcctccctgacgccgccaggacagcgcctgggcccaggcctgggcctggtgaacgcgggtttcttcctctgaggttcaacactccgcacttgggttggctcctttcatcctgattggtttattcgccacgtgccaagcactgaagagggcgtgcaggatggatacttttggagcaaaaatagccctgcttctttcctggggagggatcgcactttctagaggggcggttctcaaagtatggtctcaggactagcagcgtcgaaaatgctgggaactcgttagaaaagcaagttttcaatcctcgccccagaatcagaaactcggggtggagcccagcaatgtgtgtcctgacaagtccacgcgcgaccccagtgctggctagggttgcaaagccactgctctacggagcgagcgagatccatcatagtgggacaagcgagaggatgaggccatacagaccagggagagaggctccttacactgacattcaaagtcctcaatgacccggccccagcctacctctgcagccttatctccctacaaaccatcaaagcagaacaaaaacctgtccctccgatttaggttttagcaaaccacaagaagcacttcataaactggtgactcaagtagaaaagtactgttccacgcacttgacaccaatccacccatttcacctgcatgatcaccctgcctttgcatgagttgccggtgtggacagagcagggacacagtgagacagcggattccagctttgctcttacctagaacacactgcctctcaccaggaatcgtccttccattttatgcagttatcccagacaatgatgcacaagctttgggaaaaaaaccccacaagtccaaaggtgtacttcataataaaggcaagttatctgtca

SEQ ID NO: 729367 - DNA, 491 bp, Homo sapiens
gcaagttttcaatcctcgccccagaatcagaaactcggggtggagcccagcaatgtgtgtcctgacaagtccacgcgcgaccccagtgctggctagggttgcaaagccactgctctacggagcgagcgagatccatcatagtgggacaagcgagaggatgaggccatacagaccagggttttagcaaaccacaagaagcacttcataaactggtgactcaagtagaaaagtactgttccacgcacttgacaccaatccacccatttcacctgcatgatcaccctgcctttgcatgagttgccggtgtggacagagcagggacacagtgagacagcggattccagctttgctcttacctagaacacactgcctctcaccaggaatcgtccttccattttatgcagttatcccagacaatgatgcacaagctttgggaaaaaaaccccacaagtccaaaggtgtacttcataataaaggcaagttatctgtca

SEQ ID NO: 729368 - DNA, 622 bp, Homo sapiens
ggctcagtaaacacttaaggaagttgccgtgcactgcagcctgccggagacatgaaggaatgtacgggaggataatcgcaacatcatcaacccaattctccaagtaatttgccatgggacaggcacaccccatgtgtttgggaagacaatgggaaggttctgttttctgctccaagactgattcaaccagttggatctggaaggggataaagggctgtgtggctgcttgattttcattgtctagtggcagccaaaattggaaaagagagaagtgcagactttaaagacaagcagcgacagctcatcagcagtctaacaacacgacagatgacaggcccagaggcacacccagggccgccagcccatcaccctgtgcaggatgtcaaagagcagctgcagcaaaggaagaagatcatccagacttaaatgtttgggccttgctaagaccatagagtctttgtgctttggaaacagtcctccatacaaagaccccttcctagaaaagagtggaaagaaaccaaggtggaatggatacaacagaaaggagaccatgctaatattcttgtgcaatgcttcctgggcagaaattatgtcataaaggatgttccattctgcaaaaaaa

SEQ ID NO: 729369 - DNA, 397 bp, Homo sapiens; identical to SEQ ID NO: 386988

SEQ ID NO: 729370 - DNA, 1499 bp, Homo sapiens
gcctactagatatttaatgtaatcaccatgataatggctaagatttattaagcatctgctatgtgctttatggtgctaagaacttctcatgtatttactcattgaatcttcacaaaaaccttatgaagacggctctctcaaatgttactgtctatatgaatccaccttgggatattagtaaaatgagtttctgatacagaagatctagaaagcgcctgaaatgctgatattctgtctcccaggtggaggagttcagctattaccttgactttgccgaagtcctaggcactcccatgccctcagagtctcattttgaatccaggcacttagggatgctatttttccacatcaaacagcttcctcccagccaaagaattctggtgacagtagtgaagataattttcactcctgcttacagaatgacaaagcaaaagcaaagaggagaagaatgaagtaaagacaaccaaaggaaaagactgatggctccttaagaatgatcttgataaaggaatggtggctgaggggtccatctcctaaaccacccaccttactgactccctagagcaatgccatacagaaagctgcaccttgaggggaagacacaagaatcctggagtggaaaaaaattgggtaatgatgacagccttcgaggtcttgagagtaaagcagaagcaaaaaaaaagtgttatttttatcttttgaagatggttccctcttaagacttttgcgaatgattaagatttcaattatgttccaggaaaaaaataagatttttgcttgacaaaaaaaatttttgtctagaacaggtgggaaggaagagatagtttagccacatccaagagacctgtaaattgggtacagtgaagtgaatggtgtaccagtcataaaagaatgttaactggagaagtctctgctgtcttcctgtaactgaggggggtgtaaccatccttgtggaagcgtccacttttattgaagattggctaaataaatctgtgcctactgaaactcaagccatttcaaattgaaaactctattccggggagacactaaaccatgggtccactgaaggatactcatctggagactagggattctggagacattgcagcacagagactagcacgcacagagcagaggcatgggaagcttggcgctgcagggaatgctggtacagccgtcctcatctatgagtttaccctcagtgatgtcagttacctggggtcaactgcggcatccactgggggtcttcgaacatatcctctccggccggagcttaaaccatcagttggcatcttggtagaaatcctgccaaagtacaaagagaatactcatgaaaccagtgaacagagaagtaggatgtttaaacccatgaggaaggaaaatggtttcagccaaacgtacggaagaacagtcctccaattagagcaaagtcaaatggatggaggcagtagactctccatccctgggtctatttaggtagctaatggctctcacttttc

SEQ ID NO: 729371 - DNA, 3057 bp, Homo sapiens
atgtcactctccagtcccagcaagggggaggtacatggaaggccacaggaagaaacaagatcttgagctgagcaagaacatcccagcatcttcattgactttaaaagtatattctggagtcttccgtggttcactattccagtactacagagattccttatattacatggcaggaggggggtaaactgagggatagtgaagacaacaataaattaatcaagagctttcctcatatctcagaacctatcctctgtaagaatgtcagaaaaggttgactggttacaaagccaaaatggagtatgcaaagttgatgtctattctcctggagacaaccaagcccaggactggaaaatggacacctccacggatcctgtcagagtgctcagctggctccgcagagacctggagaagagtacagcagagttccaagatgttcggttcaaacccggagaatcatttggtggggaaacgtccaactcaggagacccacacaaaggtttctctgtagactattacaacaccaccaccaagggcactccagaaagattgcattttgagatgactcacaaagagattccttgccagggccccagggcccaacttggcaacgagagttcagtagatgaagtttccttctatgctaaccgcctcacgaatctagtcatagccatggcccgcaaagagatcaatgagaagatcgatggctctgaaaacaaatgtgtctatcagtcattgtacatggggaatgaacccacacccaccaaaagcctcagtaagatagcatcagagcttgtgaatgagaccgtctctgcatgttccaggaatgctgccccagacaaggctcctggctctggagacagagtctcaggatcatcacaaagtcccccaaatttgaaatacaagtccactttgaagatcaaggagagcaccaaagaaagacagggtccagatgacaagcctccttctaagaagtctttcttctataaggaagtgtttgaatctcgtaacggagattatgccagagagggtggaaggttctttcctcgggagagaaagaggtttcgagggcaggaaaggcctgatgactttacggcttctgttagtgaagggatcatgacctatgctaacagtgtggtatctgatatgatggtctccatcatgaagacactgaagatccaagtgaaagacacaaccattgccaccatcctactgaagaaggttctgctcaagcatgcaaaagaggtggtctcggatctcatcgactccttcttgaggaatctccacagcgtcacagggaccctcatgactgacacacagtttgtctcggctgtgaaaagaactgtcttctctcatggaagccaaaaggccacagatatcatggatgccatgctaaggaagctgtacaatgtaatgtttgccaagaaagtccctgagcatgtcaggaaagcccaagacaaggctgagagttattccctcatctccatgaaaggaatgggtgatcctaaaaaccgaaatgtgaactttgccatgaaatctgaaactaaattgagagaaaaaatgtattctgaacccaaatcagaggaggagacttgtgcgaaaactctgggtgagcacattatcaaagaggggcttaccctgtggcataaaagtcagcagaaagaatgtaaatctctaggtttccagcatgcagcattcgaagctcccaacacacagcgtaagcctgcatcagacatttcctttgagtaccctgaagatattggcaacctcagccttcctccatatcctccagagaaacctgagaattttatgtatgattcagactcctgggccaaggacctgatcgtgtctgccctgcttctgattcaatatcacctggcccagggaggaagaagggatgcacggagcttcgttgaagctgctggcaccaccaactttcctgccaatgaacctcctgtagctcccgatgaatcttgccttaagtctgctcccattgtaggtgaccaagaacaagcagaaaagaaggacctaaggagtgttttctttaatttcatccggaacttacttagtgagaccattttcaagcgtgaccagagccctgaacccaaggtgccggaacagccagttaaggaagataggaagttgtgtgaaagaccgttggcgtcttctccccccaggctatatgaggatgatgagacccctggtgccctttctgggctgaccaagatggctgtcagccagatagatggccacatgagtgggcagatggtagaacatctgatgaactcagtgatgaagctgtgtgtcatcattgctaagtcctgtgatgcttcgttggcagagctgggagatgacaagtctggagatgccagtaggctaacttcggccttcccagatagtttatatgagtgcttaccagccaagggcacagggtcagcagaagctgtcctgcagaatgcctatcaagctatccataatgaaatgagaggcacatcaggacagccccctgaagggtgtgcagcacccacggtgattgtcagcaatcacaacctaacggacacagttcagaacaagcaactccaagccgtccttcaatgggtagctgcctctgagctcaatgtccctattttgtattttgctggtgatgatgaagggatccaggagaagctacttcagctctcagctgctgctgtggacaaaggatgcagtgtgggcgaggttctgcagtcggtgctgcgctatgagaaggagcgccagctgaatgaggcggtggggaatgtcacaccgctgcagctgctggactggctgatggtgaacctgtaatcggcaaccccactgctttcccctcttctggcagtggggccggcccttatccccgcccttctttctcacttccacatctccccctctatatcctcacagagccctaacattatcttcacaccactctcatcaaagacatgtcatcttgtgctagccactggattttgcagattttcctgtccatgcaagcaaggacgtaaaattaaaaaattacaattaaagggcatccaaaaaaaa

SEQ ID NO: 729372 - DNA, 459 bp, Homo sapiens
agcattctatgatcccatggctctcacatcgacagaccacaacactaagccaacaatgatacggcgtccaccagcagttgtttgctacatttgtggtcgtgaatatggaacaaaatctattagcattcatgagccacaatgtctgaaaaaatggcataatgaaaacaacttgttgcctaaagagttaaggagaccagtacctaaaaaaccagaagtcaggaccattactgacaaataagaaaaacagttctgaaatgcctgtccaaagaattatcttctgatgctgagacataaagacactatgtcctggcaacactgtgcatgagagggacctatgggaatttgctgtattctccaaaagtttctttcatacatcatcaaaccctttgaatgtaaaataaataataaaatacttaaaaaataaaaatgaataaaacttaaaaaaatatgaaacttaaa

SEQ ID NO: 729373 - DNA, 406 bp, Homo sapiens
agcattctatgatcccatggctctcacatcgacagaccacaacactaagccaacaatgatacggcgtccaccagcagttgtttgctacatttgtggtcgtgaatatggaacaaaatctattagcattcatgagccacaatgtctgaaaaaatggcataatgaaaacaacttgttgcctaaagagttaaggagaccagtacctaaaaaaccagaagtcaggaccattactgccaaaggcttctatgatcttgatgctttaaatgaagctgcttggacaagtgcccacagccagttggttccctgtaatgtttgtgggcgtaccttcctgccagacagactgattgttcaccaacgatcttgtaaacccaaagccgccaagtaaagcccttttctctctactgaagtg

SEQ ID NO: 729374 - DNA, 168 bp, Homo sapiens
acaaacttttcaccattctaaagaacccactttccttatcaaccaagctgggcttctctctagtgactcctattctagcctttccccagaaacagagagtgttaatcctggtgaaaatataaagacagacactcagaaaaagagacctgggactgtgatactatcaaa

SEQ ID NO: 729375 - DNA, 743 bp, Homo sapiens; identical to SEQ ID NO: 75160

SEQ ID NO: 729376 - DNA, 690 bp, Homo sapiens
cagctccttccctgaaaactcagaggtgctcagcatgccatgctaaaaggcaaaataaaaagatcttggagacatctcagctttaatgaggactttccaacattccagactgccgtcctgcaatgaagctctgagtcacggtctgtgaggctaagctttaggccctttcaagctaattggaacagaagagagctaattaactataaaccagaatgaagcttttgtctaataagtttttattaggcaaaactcacagtgggaagagcataatcagaaaaacacatgagggcaggatattctcatcttttcaaattctgcatgtgtatctattagccaacaatgatacggcgtccaccagcagttgtttgctacatttgtggtcgtgaatatggaacaaaatctattagcattcatgagccacaatgtctgaaaaaatggcataatgaaaacaacttgttgcctaaagagttaaggagaccagtacctaaaaaaccagaagtcaggaccattactgccaaaggcttctatgatcttgatgctttaaatgaagctgcttggacaagtgcccacagccagttggttccctgtaatgtttgtgggcgtaccttcctgccagacagactgattgttcaccaacgatcttgtaaacccaaagccgccaagtaaagcccttttctctctactgaagtg

SEQ ID NO: 729377 - DNA, 796 bp, Homo sapiens; identical to SEQ ID NO: 75162

SEQ ID NO: 729378 - DNA, 1350 bp, Homo sapiens
agtttctctctgcttctggtcagctgggttgtcctgcatggtgacgggtgtcatcccgaacaaatcagatggcatcagaggcactccatcaagtgggagatggggaggaggctgtactgaagaaagaaaacttcaacatgatgaatgcccttgaccaactgccaaaacccttttcaaaccccaagtctatgaaccggaccgtcactaccaaaggactcccactagcctcaaagggcaatttggtcaacttcttggaggatgataccatcaacctactgaagccgctgccagtagaggattcagactgcagctctgatgagaccagcatctctgccttctcatccaccttgctgaaccccatcaaattagctgtgacccagcccaacagcagcttctttgcagggatgctggagggggagctgaacaaactcagcttctccccaatggccaagaatgcagaaaatgaggacctggcgctcggcccctgcccatgcccatcgaagtcccagatggccacaaggggcctgctggaccttgacaaccctgagctggagacagaaacctcctcaacgcactcagaatcttctgtggttgtggacctgccggacacccccttcatctttgagcacaccgtcaacaattccacagctgtgatttcctggacctacgccttgggcaagcagccggtcagtttctaccagctcctgttacaggaggtggccaagacacaggagaatgagttgcccgaggcaaagaatcgtccatggatcttcaacaagattttgggcactactgtcaagctgatggagctaaagcctaacacgtgttactgcctcagtgtccgtgcagccaacacagctggggtggggaagtggtgcaagccctacaaatttgcaaccctggccactgacttcagcagctttcctgagaactaccccatccagatcaccgtgcggcgcaaggaaccccggcaaaagatcgtgtccatcgggccggaggagatgcggaggctggaggatctggaatacctatttccctgttaagggggagggccccaggacacccctcacctactttcagcttcaaccccaggccctcagaaaccagagccatgagacctaccataccaccagcaccctgcgggcccggggtctggcagagtggtatgggcaccccacccctgggctggggccaaggctacataggggccccattcacctggaggcatctcaggccaggccatgccaggctcagccactgcccacagctgctagactccctcctcctccaaatctgggctgggtctaggtccctcattaaagaactgcaggtcatccagcaaaaaaaaaa

SEQ ID NO: 729379 - DNA, 1427 bp, Homo sapiens; identical to SEQ ID NO: 286162

SEQ ID NO: 729380 - DNA, 1292 bp, Homo sapiens; identical to SEQ ID NO: 286161

SEQ ID NO: 729381 - DNA, 743 bp, Homo sapiens; identical to SEQ ID NO: 728369

SEQ ID NO: 729382 - DNA, 455 bp, Homo sapiens; identical to SEQ ID NO: 728370

SEQ ID NO: 729383 - DNA, 1254 bp, Homo sapiens
acgacctaagggcctccacagcaggaacaaaaggaattttgtctgagattttagcagaaaagtaatttttgaaatctattcttggatttagacgtttattggatttcaaagcttcttgctgcccaggagcttgtgaatacggtcaaaggtccatgaaatttccaaagtggtaccacagcagatgaacctgaatgcaaactggagggaccaacagagtccagcctatagacataaatccttaactacacctagatctcactgtcttttccaatggtcaaaagaggggctcttgaaatggctccattgttttatagaaacaaggtcttcctaagaagtctttttctcctatctttttcttacccaaaataaaggaatggcccaaaacctcaagccaagcttaccagctataaacaacttggtggtcagcagccaaaagaagagtggacatgccatggtcatgtggcacgtaccctatacaagcttcacagagaagaatggaagcacttgattgtaagacagagggtgagatgtgagaggaatattaaccttcactttccacaggcatttttttctgcaaatggcaccagcttttggacttaaaattttattccgaatactatttagatgcatcagggccctcaaaatatggatttcaagttggagacatcaaagtgcattatttactaaaaccactgcagcttttttcccctctcctttcacaagatgctattgtaaattcaggctgctttaatctctgtgattaaaaaaaaaaaggaagaaagaaaaaaaaagtgctgcttgaagaggaactgaactcacaatctgggagctagaaatgctctctcgtgctctctctgtctccagtgataagctgaccagatgtcttgaattaagtacagggtcaccaacatctctaatagaatccaactgtggaatagaaaaactatttcgtctaagaagtggatcctagctgtcaaataaaaaatcgctgttgaatgctgtaaagtacatttttacacccatgtacaatttagagcttaggaactcatggaaaaaaatagagttaacacggataaagggattttaaaaggcgagagagggaagagtttcttaaggagtctccaatgacaaaaatgtgttcattttctgagacctccagaatgaattactaaggtatcctcaaacaaaagtggttttgctattcagaaattcatatgttctaaatagagaaaattaaaaattaaaaagacatga

SEQ ID NO: 729384 - DNA, 2306 bp, Homo sapiens
  misc_feature (972)..(972): n is a, c, g, or t
  misc_feature (1368)..(1368): n is a, c, g, or t
agctagactgagcaagggaagtgacaggaaatggagctggggagacaaaaatgtggataacaacaaaagaatttcaacaggtaaaaaaatgagtcaaacatctctcaaacagaaaaagaatgagcctggaatgaggtcctcaaaagagagtctagaagcagaaaaaagaaaggaatctgacaaaacaggagttcgtctgagcaatcagggatcacaagaatcatcactgcggaagacagactctcgagggtaccttgtgcgcagtcaatggtctagaatatcccggagcccatccaccaaggctccatccatagatgagcctagaagcaggaacaccagtgctaagctccccagcagctccacgagctcccggactccatccacctccccaagcctgcatgactcctcaccgccgccgctgtccgggcagccctcgctccagccacccgcgtcgccccagctgccccggtcgctggactcgcggcctcccacgcccccagagcccgatcctggctcccggcgcagcaccaaaatgcaagagaatccggaggcctgggcccaaggcatcgtgcgggaaatccgccagacccgggactcgcagccgctggaatattcgcgcacgtcccccaccgagtggaagtcctccagccagcgcagggggatctaccccgcctccacccagctggaccgcaactctctgtccgagcagcagcagcagcagcgggaggacgaggacgactacgaaggctgcctactgggcatccatgaggtcgttctacgagaaagaacccgagctgctcgcgcccctggccgcccaaacccaagaacgccatcaccattgctctctcatcctgcgcgctcttcaacatggtggacggcaggaaaatctacgagcaagagggtctggaaaagtacatggagtatcagctcaccaatgagaacgtcatcctgaccccgggcccggcgttccgnttcgtcaaggcactacagtatgtcaatgctagactccgtgatctatatcctgatgaacaggacttatttgatattgtactgatgactaataaccatgcccaagtgggagtgcggcttataaacagcgtcaatcactacggcttactgattgaccgcttctgtctgaccgggggaaaagaccccattggctatttgaaggcatatcttaccaacttgtatattgctgcagattctgaaaaagtgcaagaggcaatacaagaaggtattgcctctgcgacaatgtttgatggagccaaagacatggcttactgtgacactcagctccgtgtagcctttgatggggatgctgtcctcttctctgatgagtctgaacattttaccaaggagcatgggctngacaaattcttccagtatgatacattatgtgaaagtaagcctcttgctcagggtcccctaaaaggctttctggaagatttaggcagactgcaaaagaagttctatgccaaaaatgaacggttactttgtcctatcaggacctacctggttacagctaggagtgcagccagttcaggcgcccgtgtgctgaagacccttcgacgctggggtctagagatagacgaagctcttttccttgctggagcccccaaaagtcccatcttggtgaagatccggccccacatcttctttgatgaccacatgttccacattgaaggggcacagaggttaggttccatcgcagcttatggctttaataaaaaattcagtagttaggggcagggaggagaaataaagtggtgatagtctggtgttacagaagccacttcttttggctctctaggataattagataggtatttcagaaaattggaccttaaaactttgcttctttggaaaggttttctcctgattttttggaaaaccttttgaaccctcaagttaccatcaaactacttctctttgaactaccaatactgttgaatgccattacacctatctctgtgtaagtcataatgatgactctttaggataagtttagaacttgaatatttgcatgcttaaggcactgttttagaagcttacttagttttataaacactgctcatttttggatgtttgtagataacaatgaattgttacccatcagcattgtagaatagtgtcttcaaaggtagaaggagtatggttaagcacactcttgaaaactggagctttgtattctgtgactgctatggctagctttgtaaccaaagcaaaatgagaatttcactctacctgcatgagtataacaattttgatactgctcatttagaaataaatcatctggttgttcctcc

SEQ ID NO: 729385 - DNA, 1252 bp, Homo sapiens
ggtcccctaaaaggctttctggaagatttaggcagactgcaaaagaagttctatgccaaaaatgaacggttactttgtcctatcaggacctacctggttacagctaggagtgcagccagttcaggcgcccgtgtgctgaagacccttcgacgctggggtctagagatagacgaagctcttttccttgctggagcccccaaaagtcccatcttggtgaagatccggccccacatcttctttgatgaccacatgttccacattgaaggggcacagaggttaggttccatcgcagcttatggctttaataaaaaattcagtagttaggggcagggaggagaaataaagtggtgatagtctggtgttacagaagccacttcttttggctctctaggataattagataggtatttcagaaaattggaccttaaaactttgcttctttggaaaggttttctcctgattttttggaaaaccttttgaaccctcaagttaccatcaaactacttctctttgaactaccaatactgttgaatgccattacacctatctctgtgtaagtcataatgatgactctttaggataagtttagaacttgaatatttgcatgcttaaggcactgttttagaagcttacttagttttataaacactgctcatttttggatgtttgtagataacaatgaattgttacccatcagcattgtagaatagtgtcttcaaaggtagaaggagtatggttaagcacactcttgaaaactggagctttgtattctgtgactgctatggctagctttgtaaccaaagcaaaatgagaatttcactctacctgcatgagtataacaattttgatactgctcatttagaaataaatcatctggttgttcctccagggtactttctaagataagccttaaacagaaacccctaagaaaggttctctgaaaattatttggtgggttaaatgcctctgatccacagagtttcatatttgaagtctccggctttgggcctggcaggctggcacatccatatttgtatggaaaaaaaaaaaaaagaccctacgctaccacttcaaaaagtgacatgaagtgtagtatcctggcccttcattgtcattctctcatgatttttgttttgttttcaacaaaaattggttggtcattaaatatatcatatgttaggcacagtgacctggttattttcacatgttacttcattttcttatcaaattaaatgtttgtgacatagtatta

SEQ ID NO: 729386 - DNA, 536 bp, Homo sapiens
  misc_feature (134)..(134): n is a, c, g, or t
cacagccccagccagcagatcccatgctgcccctagtcctgggcatggtggcaaacatggaggcggagaccagggcattcagactggactcctgtacctcgctggagagaggcttctctcattcgccggaaccncagcacgctgctgcagggcctgtttattgtgctaattctggtggggtatatctctgtgaaggtgatgctcaagagcattaaaacaaggctgggaagaagagttccagcagctcctcctgctctcagacgcaatcttctcctccaggcatggaagtgtgtctgcaactgggcatccaggctgtttgcccctaatgtgctgccccgaacgggctcttaacaggtgggcaggggttgaggggaccaggaggtggctccaaagggtacagcaaggaaagcttttaaagacagctgttgtgctccaggctctccatgccaccacctgccctagcatttattaatagtgttagaattacaagtttatgaaatgaaatataaataaagtttgatttctgaaacttcaaa

SEQ ID NO: 729387 - DNA, 1116 bp, Homo sapiens
ctaggtggaaagcgacgtagactcccagccagtgccaaacatagatcatttactcaccaacattggaaggacaggagtctccccaggagatgtatcagattcagctactagtgactcaacaaaatctaagggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaacagcactaggaaagaccccagcacgacaaaagatgaaaagatatcactaggaaaagagagcacgccttctgaagaaccctcaccaccacacaactcaaaacacaacaagtcaccaactctcagctgtcgctttgccatcctgaaagagagccccaggtcacttctggcacagaagtcctcccaccttgaagagacaggctctgactctggcactttgctcagcacgtcttcccaggcctccctggcaaggttttccatgaagaaatcaaccagtccagaaacgaaacatagcgagtttttggccaacgtcagcaccatcacctcagattattccaccacatcgtctgctgcatacttgactagcctggactccagtcgactgagccctgaggtgcaatccgcggcagagagcaagggggacgaggcagatgacgagagaagcgaactcatcagcaaagggcggcctgtggaaaccgacagcgagagtgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaa

SEQ ID NO: 729388 - DNA, 822 bp, Homo sapiens
ccagactataaattgggacagctgagcttgcagaatccagacaaccaaactccatcaatcaagaggaacttaatccagggttcttctgctcactgggtcagaagcatccgatttcctgtcatcggttgcggttcagccatgttaatactgaaagtataagaatatcataatcccagagtgatataaagacctttccaaggaagatgagatacccggaggctgtgaaggagaagtctgaaggatttgaacgcgttcaaatgaaaacctttggttcagcaaaacaccagaaacaaattcaaaagataaaatacactccggagaagcccattctctcaacgcatctgacagttcacaaagagcaactgcagtccaacttaaaaaataaagaaaatggtaggaaaatgggcaacatgcactgaggcaatatataagaagaaggaatgcgcaattaatcaacaaaagcctgctctttcctaacgagtgaagatacaagcttagtaaatattaaaatttattgaagataaaaatggacacttccggccatatataaaagcattgttggtaagagagtggggtaattgacatgctcctgggaaataatacgcattcagacaacctctaatgagtgaatccactgggggtatccactaggaatagaaaacgaccaccaatgcccaagtttgtggtccagaatttgagcagcgatctaacaaagtagagtctccccctgtgtcatgggccccacttcttaagcaaagaagaatgcctcattttggtaactcacccaaataaacagaaattttttttgataatcttatcgca

SEQ ID NO: 729389 - DNA, 667 bp, Homo sapiens
aacaccaacgtgtacccgtggtggggtgaggccatgggctgggccttcgtgctgtcctccatgctgtgcatgccactgcacctcctgggctgcctcctcagggccaagggcaccatggctgagtgctggaagcacctgacccagaccatctggggcctccaccacttggagtaccgagctcaggatgcagatgtcaggggcctgaccaccctgaccccagtgtccgagagcagcaaggtcgtcgtggtggagagtgtcatgggacagctcagctcacatcaccagctcacctctggtctgtggggcaagaggctgcaatattccatcctgggtgtctgggctgctaacctggcctgctcaggcttcccaccctgtgccctgggctgggcacacccccgggaagggaccccggacacggctcccacatccaggctcaaggcggatgcacttcctgcacctccagtcttctgtgtagcggctttaacccacgtatgtctgtcacgtccagtcccgagacggctgagtgaccccaagaaaggcttccctgacacccggacagaggctggagggctggggctgggtgagggtggtgggcctgcggggacattcttactgtgctaaaaagccactgcaaacatagcaataaaaacctgtcattttccaaagc

SEQ ID NO: 729390 - DNA, 778 bp, Homo sapiens
cgtggtcttcttgcgcgggatagggcacctgaggaagcgggctgcgcctgtggcacagtggtacggggccggaagataacttacctgaagaggcgatcaatccctgagaatcgcgggcgacccgttttttgtgtgcccgggtgcggggtgccgggacacggcgttgaaggcgctgagcggagggatctcagggcgagctcgagcggcgacggcgcgctctgtgattgcaccgcgagcgcctgaggtgatctcggcctacatcgcgtcagcggggccttgggcgtgagcaccgccccctgtccggacgcagggtactggggcacctcgaactgtggcacctcacccttctccggggccacgtcttggggactccgacagccccaaataagccctcggggactggggttgtgaaaagcgaggtcgtgaagacgccggcctcataccgaagggtaggacggtgaggtcagccccgtcccactccaactaaaatcaacctgacaggtattaatatgccaccatgaagttaacaaatgttggtgattaagtatgctaggttttacgaaaacagattttccaaaataaatgtacatgttttaggacgtcgcgagccgtttgaggcagcattccccaaggacgccacttagtctgtaggtttagcggctagaaagattcagaagctgagttcagtcctgccgccacaatcaatcttcgctcctatggcttcacagaagcgtctcccatgactaccaaatttaactccttccagatcacccacggg

SEQ ID NO: 729391 - DNA, 250 bp, Homo sapiens; identical to SEQ ID NO: 409597

SEQ ID NO: 729392 - DNA, 2893 bp, Homo sapiens
cgtggtcttcttgcgcgggatagggcacctgaggaagcgggctgcgcctgtggcacagtggtacggggccggaagataacttacctgaagaggcgatcaatccctgagaatcgcgggcgacccgttttttgtgtgcccgggtgcggggtgccgggacacggcgttgaaggcgctgagcggagggatctcagggcgagctcgagcggcgacggcgcgctctgtgattgcaccgcgagcgcctgaggtgatctcggcctacatcgcgtcagcggggccttgggcgtgagcaccgccccctgtccggacgcagggtactggggcacctcgaactgtggcacctcacccttctccggggccacgtcttggggactccgacagccccaaataagccctcggggactggggttgtgaaaagcgaggtcgtgaagacgccggcctcataccgaagggtaggacggtgaggtcagccccgtcccactccaactaaaatcaacctgacaggaggtggttcaggaaaacggtcccatttggcacctcaagtctaggtccctcaagtctctacaacagtatgcaaagaaaatgttcatcttcattcttcttatagttttctggtaacttactgaaccaagcgcacacacactctccaaggacaaacatttttcagtgctgggacaatgcaaattcagctctcggcagactactacacactgtgcatgatataccaagactaaaagactcataacctacccgcagaaagagtgcatcttccatagtagctctgcaaaaagatccaaaagaaactgttaatggcctggcttaagtcaaattgtgtccggaattggtgggttcttcgtctcactgacttcaagtatgaagccgaccctcacggtcagtgttacagctcttaagatggcgcctctggagtttgttccttctgatgttcggatgtgttcggagtttcttccttctggtgggatcgtggtctcgctggctcaggagtgaagctgcagaccttcgcaacttccttccagaggaagatgttgactctaatgtattctgtctaggatgtgtttcataaatctggttagaagatttcccttccagcatcaacaaattgttttctaaatgtggaaaaagagacattcagtacaggctaacgtaacgtgggacagcatgcaaagccatgagaagtgggaaaatgagagagaatctgggcgtggcttacagggctgctgaagtaagacacacccttcgcttcacctgtggcctcccgcggcggctgcggctccttcgcaggaccggtagggggcgcgcgcggttgagtccagcaattgcgaggacctccgcaggcgcagcccagcactgacgcctctccgggccgtggctcctctttcccaggccgaaagcggccgggccctctgctccgctgcgccctggcgcggccgcacccactgcgcgtttgtgagctggccatcggtcacactgggatactcgaggaggaggcctggggcctgcattcaattccctaagagggacccgcgctggccgctgcaggcgggtggagaacgggcgtctgagtctttggctttcgtaccggaatctccccgggagattttacaagcccctccgaatgttctgattgaattggtctgggggggtcggtccgggcatctaacgagcagccgggatggagaattactagtctggattctggtcctcagaggttcactcacgttaatcaacccgagtccatcttggtgggattgtcttgctccgaggccctcccactgagctttattttcctgcctgatttcggggtccgctaacaggatgaacagcggaccatacaggcacggtgaaaatgacacttggtgacgtggaagacccagcttgccacagttgaggcagagctcctcagggtcttttgtcttagttatccccgagctatttttcaggaaccgacaggctcccccaccccaacaccggatgaaggccagcaactggaggccaggaataatcaagcacgctctcatttcaaagaggtgacgattgtgcccgtgtttaaaagggatgcctgagaccatgaggatttggagttttggaggcggatctgcctttggggagtgagcgtagggccctaagatgtggttgtgctttgagacagttcccaaaatacggtatttgtcagaaaacatgtagtatttgtataatttgagaatgtaattgaagaacccgatatagagcttttagaaaggggaaatagaaaacttaaaaagaatcttgcttggtatattaataccaacatctaaaatataataaaattgaataaaccagtgagttttatactatgattgaaataaaatgccactatgttcttaagagtgctagtttaacaggaaatctccaatgcattattatctagactcatctcaaaggctcacttttcatttgcatgggcccttgctatttgtagggtaggaggcagcacctcgttctggtggctgccaccttcatgaggagacactccttgttaacaggatggttagcccacggctcttcccagcccccttttccacacccagtaaattgttttagtttatggccctcagctgcagttgcaatcatcatcaaattccagttttgaatttaaaggtgaataatgaatgcaatgaactttctagaatttatgaagggcagtgatgttcctttttatctaataattctacatgtgtagcctttcagtatgctattctgtggactgaatttacaaattgtcatttgtttaatgaactgttaatataacatgatgactaactgaaaacacatacaatttgctggtattccagaagtctatggatttcgttgttttgtttaaataaaaggcattaaaagc

SEQ ID NO: 729393 - DNA, 601 bp, Homo sapiens
ttatggacagtaccctaacagtggtcgcttctcccccctactcccgcgaatgacgtcatcgcctcgcggccccgtttcgccattgtatcctcaatgtgtaaacttactgagctgccactcatgtcgcacagtgggtgcaaaccttctgctgctaggcattgtgccatcgctggacctgcaaacatgcaaatatttagaccatcaacgacagatgtgtagtcgggttctgaaactcctatatcctattcaccaacaccctcaactcaatttcctccctgatccttcgcccacctgcaaaactgttagtctgcaacagttcaaccaaccttgctcactcctgcatcggtgcagaaaatcacacaaccctgagaattggcaccactgcgaacgaaaagtgtccaacttcagtcgggacttccacgtgcgactacgcaatattgctgagcctaagacagtcacatttacacattgctactcagattatctcctattcccctcccctgctgttcccagccctcacgctcttctaacctcttactgaactctactcactcacccgctttggtaaaaataaaaataaaaaattttgtctcttaaatct

SEQ ID NO: 729394 - DNA, 520 bp, Homo sapiens; identical to SEQ ID NO: 283977

SEQ ID NO: 729395 - DNA, 662 bp, Homo sapiens; identical to SEQ ID NO: 45661

SEQ ID NO: 729396 - DNA, 474 bp, Homo sapiens
cctctgctttgcttggccagttgcttcttgcacaactgcatcacagaaaaagggtgaaggcagctgggcagatccaggcctggtggcgtggggtcctggtgcgcaggaccctgctggttgctgccctcagggcctggatgattcagtgctggtggaggacgttggtgcagagacggatccgtcagcggcggcaggccctgttgagggtctacgtcatccaggagcaggcgacggtcaagctccagtcctgcatccgcatgtggcagtgccggcaatgttaccgccaaatgtgcaatgctctctgcttgttccaggtcccagagagcagccttgccttccagactgatggctttttacaggtccaatatgcaatcccttcaaagcagccagagttccacattgaaatcctatcaatctgaaaggcctggggcatggagaacaggctgcactaccctaataaatgtctgaccaggt

SEQ ID NO: 729397 - DNA, 573 bp, Homo sapiens
atcaggaaacagcaaccagagggagatgatcacctgaaccactgctccaaaccatgggcagtaaatgctgtaaaggtggtccagatgaagatgcagtagaaagacagaggcggcagaagttgcttcttgcacaactgcatcacagaaaaagggtgaaggcagctgggcagatccaggcctggtggcgtggggtcctggtgcgcaggaccctgctggttgctgccctcagggcctggatgattcagtgctggtggaggacgttggtgcagagacggatccgtcagcggcggcaggccctgttgagggtctacgtcatccaggagcaggcgacggtcaagctccagtcctgcatccgcatgtggcagtgccggcaatgttaccgccaaatgtgcaatgctctctgcttgttccaggtcccagagagcagccttgccttccagactgatggctttttacaggtccaatatgcaatcccttcaaagcagccagagttccacattgaaatcctatcaatctgaaaggcctggggcatggagaacaggctgcactaccctaataaatgtctgaccaggt

SEQ ID NO: 729398 - DNA, 751 bp, Homo sapiens
atgaactgctggattcagtttgcaagtactttgttaaggatttttgcataaatgtttgtcaaggatattgacctaaagttttgttgttgccaggttttggtatcaggatgatgctggcctcatagaatgagctggggaggggcctttcctcctcaattttttggaatagtttcagtaggaatgggaccagctcttctttgttcatctgatagaattcagctgtggatccttcttgtcctgcgctttattttgttgagagttgcccaaggaagtcaacaggagagccagatcaggaaacagcaaccagagggagatgatcacctgaaccactgctccaaaccatgggcagtaaatgctgtaaaggtggtccagatgaagatgcagtagaaagacagaggcggcagaagggcctggatgattcagtgctggtggaggacgttggtgcagagacggatccgtcagcggcggcaggccctgttgagggtctacgtcatccaggagcaggcgacggtcaagctccagtcctgcatccgcatgtggcagtgccggcaatgttaccgccaaatgtgcaatgctctctgcttgttccaggtcccagagagcagccttgccttccagactgatggctttttacaggtccaatatgcaatcccttcaaagcagccagagttccacattgaaatcctatcaatctgaaaggcctggggcatggagaacaggctgcactaccctaataaatgtctgaccaggt

SEQ ID NO: 729399 - DNA, 3131 bp, Homo sapiens; identical to SEQ ID NO: 43928

SEQ ID NO: 729400 - DNA, 609 bp, Homo sapiens
aatttgattaaactccaatattatctttaataaaaaacttgacatttcccttcatatctgagaagacacactttaccttgttgataaaattgaaagaaaaaaaacccattctccatggtcactaacagaaacgtcttgctaaatcctcttgcttatttgagggctgtggtccatcagtgactgaccagacaatcgactttctcgtgcctcagttttcctcataagaacttgggttggagccaattgagaggtaatattcccagtaaaaattaaatgcattctgaaagtgaattgactgccaagagttttgagtaatccagcacttcttctaataatcaccactcataatggaatttgtgtccttaaagttatgttattcttttcaaggtgtcactggttgaaaaccatttggccggactggaaggaagggcactagcagacatgtttgacttcctgtccaaagagctggtgagactgcaggaggagaggaggatccatgcctttgtcatgctggctgagcgccagcggcgggtacgagaggctgaagagagtggtcggcgccaggtggaaaaacagcgcctgcgggaggaggacgagatatttaaggag

SEQ ID NO: 729401 - DNA, 395 bp, Homo sapiens
gattagtggaacttgagtcatgtctcccagattttgtgacacaaccccaaatcagagctccaaaacctaaagtcattaccaccaaagctggttttctgaagagggcagcaaggttggactatgagttggcagaggttcataaggcactgttggataagaagaataaagttcttgaagtaaagaaaccccctcgcttccttcaaagaaacccaatacctcaacctcggcttccaactccaaccttggaaatgacgtccaatgaagaagaagaaatggaaatggctgtgatctaccttcaaaagttactccggggcagagtcgttcagaacatggtgtgtaggtccaaccgctggccctgcatttctcttttgagaataaattttttagaatgcata

SEQ ID NO: 729402 - DNA, 446 bp, Homo sapiens
atgtttgaagggaaagaaaagcgactggagttgatccaggagttgcgcacctgccacgcactacaagaagatgaaaagctggtgaaaaaagccgagaagcaagtgaccctggccttacagcggcagaggaacttgcatgagcacaaggtgtcactggttgaaaaccatttggccggactggaaggaagggcactagcagacatgtttgacttcctgtccaaagagctggtgagactgcaggaggagaggaggatccatgcctttgtcatgctggctgagcgccagcggcgggtacgagaggctgaagagagtggtcggcgccaggtggaaaaacagcgcctgcgggaggaggacgagatatttaaggaggtggttaaagttcaccatagtactataagctcctacctagaagacataatactgaataccgaagcgaatactgcaga

SEQ ID NO: 729403 - DNA, 1492 bp, Homo sapiens
ccccaccttaggagccctttgtgagggggaggccccagctctgtgatgtggacctgggccccaataacttgtcccagaggggatgcccagggctcagttgcctgaggacagcagtgcagttgacatggatattctctttcctctggacagtgttatcggtacagagctgtgccccagccccattccccagatcatccatttcgtcctctttgttgtgttcagcctggtgatcctgattatcttatgcccctacattcccagggagccgtcctcagtgcctcccagagaggacagcgagaatagaaggaaaccagaaaaaggttattacgcactttagaaaccagtgaaagagaagcacacaggctccatgagctgggcggagaaagtgtgtcattcacgagcactgggtctgcagctgtggggacaggagactgagacccggcctgcaccctctttcttgtctctcaggatcaagctgaagtgggggaatggctcaggatcggaaataaatatatcactttgaaagactgcagaattctcttgaaagaattggagaaccttgaggtctacactttcctgctggaaaagcgcctgaagaagctctctagggagggcagctcccatcaccttccacgcccagtccgcccaggggcagtgtacaaaccagcacctgctaggaaccaccggccacgtggggggcgtgggaaagcttctcccaccagcttccatgtgtccccacgggctcccccggctcctctggcctccatgccgtcatcagtcccgaagacctccatagagtcccttgggtctccatcatccctgagctcctcccaggcatcagagcctctgtgtcccctgaagcacccttcacaccggccacctgcaagcaccctatcaccaaacccgaccagctccacagaatccttggggtatctgtcatccctcagctcctcccagccaccagagcctttgcgtcccctgaagcacccttcacacaagccacatgggcgttcccctccccgacgacggaatcctggctgggtgtcctggtccgactccatgcaggctgattccgaaactgacgccataatatgcccaatgtgcaaggcccctgagcgctcctgtccacacacctggtgggtgccttctagccctcgagtgatccgaggcgttggtcgctgcagtgatcccaacctgggcctctcctggaggcaggaggctgctagagcctggtgccactgcacctcctcacagtacccattcgagcaccctaatcttcccacccacctaccaaaggcttccttctagggagaccccacatgcaggcagatggaggcagggctcacactggcctccagggctgtgcaactggcatattattttgcacataacttggctcaggtttgtgaggtctgatttttaaaatgaagcaacaatcacataaagattttcaaacaaataagtcaaatgtatggcagtatttctattttat

SEQ ID NO: 729404 - DNA, 909 bp, Homo sapiens
atcagaaagaagcaggcgaagaaagctgcagcgatcagagcaaaaaagagctctaaagtcagagcaagccaagaacttgagatgtctctgaagcctgaggaaccaggaaaacccgtagtcgccacattttctgagagccggatattggaaaagcaagataaacgagccagctaagcctgtggaacatgcctcatacctggagtcgccattatccctggaattacaaagatctgcaaaatttatagcgctcacagaaaccctggaggctgtaataaacctggagccccctggactctcctcagctcacaaaaccctctcaattcctacacatcccttaacactcattctccattgaataggtggttactcttagacctagtcttagaacctctgaagacacactttgtaatttgttgtttggctaaatgagaagaaatctgtgccaccctgggaaggtgtcaaaagaaggaaaaatacatgtgacaatatgaatcaagtccatcagcaagttacttttgagcgcctactgtgtgtcagtgcctgagatacacctacaagagcgccaggctttcaagccttcatatctggatagaatcccaacttcagtgcttggtggctgtctatctttggacaagatctttcattccccatcctttgaacatcacatgacccatatctgggtggagaatgggtgaaaagtactgttcagagatgcaggtgagaaaaaacatgacgatgggccctgaatgccaagattcattggagctttggagctttatcttgtaggaccttatcctgactcccttagaatgtaagttccaagagaacagggactttgtctgccttgttttctacttttatcaccagcacccagaatgatgcctaaaatacaataagatctcaagaatg

SEQ ID NO: 729405 - DNA, 779 bp, Homo sapiens
gatgaagcactaaaagataagctagagccaaccctctatagaaaacttcaggatattaaggaaaaggaaacagacaaaattgcaatagtgcaaaaggttatttcggtcatcctgggagaagctacatctgcagccagtgcagtcgctgttaaacttgtgggctcaaatgtcacaactggcataattaacaagttggtcactgtgttagctcaaattggtgcttctctccttggtagtattggagttgctgttcttggccttggcatagatatgattgtccgtgccatcctgggagcagtggaaaaaacacagcttcaagcagccatcaaaagttatgagaagcatctggtggagttcaaatcagcctcagaaaaatataatcatgccattactgaggtcatcaatacagtgaaacaccaaatgaaatgaacagccgttttatttgccactgaagtgtttttctgcttccttttcagtaacagtgtttgcttctttgattaggttcattttctataggcttccaatatggacttaaataagataaacaatttggagagggaaactggagatgccaagactagatgactagatgagttttgagtcaacaatgcctggatcagctgatgctagaccctgtgaggtaaaaaaattttctccctggatgttttcacaccctgctctaccagatcaacattggggtaaatgctatcgtagagtagcaagtataggggttacttttctcttttctaatttcagtaaaattcttaaatttcacattg

SEQ ID NO: 729406 - DNA, 580 bp, Homo sapiens
ggccgaataggaacagctccggtctacagctcccagcgtgagcgacgcaaagacgggtgatttctgcatttccatctgaggtgaagacaccatgttcctctactgttgtggatgcagccctcaccagacgaccgaacctgccagtgccttgttcttggacttcctagccttcagaactactgtttgacctctggtaactaaaactgcagaaggcaaaactggataaggagactactgtaatgattatgctattacaagacgctcgattgctaacatcagacatttttataaaaggccagaatcctgctaggacatctctgcctgtggaaggagggctggatggcatactgggaatggctttctaggatgacttcctgttgctacagactacaagaagcatttctggccttgatgttgtctgaatgaagaagacataggagtttcaccaaaggtaggatcctgattgttacacgaactgtccacctccatccagagccgtgtggcttgtagtgccttctcgtggagatgcgaaaagggcacctgttcccaaaggtgaaatcataacatgctgaaaaaaagc

SEQ ID NO: 729407 - DNA, 478 bp, Homo sapiens
gtgggagctgactgtcccctgggagtaattctgtgaccataattagccacacagctcctctggaggcccctctaaaggacccccaagcttgggcacatgacccaaggtcagccagcaagatgccctgtcccggaaatttacatctgtgtatgagccacatgagaacagggaagcttgcagtgagagcacagcagttttcctggaactgccccacaaggctgtctctgagccccttttgctgggtccccagagctgctgtggctcccattcttcctgaggtctgagattccatcttccttcagttctgtaggatcctgattgttacacgaactgtccacctccatccagagccgtgtggcttgtagtgccttctcgtggcaggtatattttcctgcctgttcacgtgacttgtgttggccagtggaatatagtttgatctgcagtagtttgaatctgaggatgctgaacctgtggataa

SEQ ID NO: 729408 - DNA, 509 bp, Homo sapiens; identical to SEQ ID NO: 90848

SEQ ID NO: 729409 - DNA, 844 bp, Homo sapiens
ggcggcgcggagggatctccgcgggagccgttggggctgttggcctcgggctgaggtgcaaggaccaggactagggcgagggcagcggtccaagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttctttttcaacacgaagatctaattggaaagtgtcatgcttttgatggaacgatattatttttacctaaaagactacagcaaaaggttactgaagtttttagtaagacccggaatggagaggatgtgaggataacgatcactttaacaaatgaacttccacctacatcaccaacttgtttgcagttctataatattattttcaggaggcttttgaaaatcatgaatttgcaacaaaattggacgaaattattataacccaaatgacccaattgatattccaagtcacaggtt

SEQ ID NO: 729410 - DNA, 478 bp, Homo sapiens; identical to SEQ ID NO: 90851

SEQ ID NO: 729411 - DNA, 522 bp, Homo sapiens; identical to SEQ ID NO: 90852

SEQ ID NO: 729412 - DNA, 1134 bp, Homo sapiens; identical to SEQ ID NO: 62601

SEQ ID NO: 729413 - DNA, 484 bp, Homo sapiens; identical to SEQ ID NO: 287398

SEQ ID NO: 729414 - DNA, 308 bp, Homo sapiens
ccacaattctccattcttcttcaaacctactctaaacaacactaaggttaactatttattcgggtcttcatttctttatgaagtttccatgttatgtaaaactaacattaatatttatgcttttctcttgttaatttgtcttttgttacaggatccccagccagtgagcctaaaatgggtagaaggaaaagatatttcttaccctacgcacccaggtccaagtcatcattattttgtctgaaatttatcttcctaactgatttctctgcttccccattgtgccttaagagttagttttccacagagca

SEQ ID NO: 729415 - DNA, 332 bp, Homo sapiens
gggctggagatcaagacctacccattgtgatgaataaatccaggctctcagcaatgcagggagaaaaagttttgtctatcaacactgcagcaaccagttagcacaggcaccagccctggagttcatgtcctcatcaaaggatggaaagaagcaaagctcaaatcagcttgggaaggaccttacctagtgctcctgaccactgtaaccatcatccagacagcagagaaaggatggactcattatacccgagtcaaagtgttgccacctccacagtcatgggccattgttccaggggaaagccctaccaaattaaagctaagaaaaacttatca

SEQ ID NO: 729416 - DNA, 354 bp, Homo sapiens
gggctggagatcaagacctacccattgtgatgaataaatccaggctctcagcaatgcagggagaaaaagttttgtctatcaacactgcagcaaccaggtaattctgtgcacagaccaagttagcacaggcaccagccctggagttcatgtcctcatcaaaggatggaaagaagcaaagctcaaatcagcttgggaaggaccttacctagtgctcctgaccactgtaaccatcatccagacagcagagaaaggatggactcattatacccgagtcaaagtgttgccacctccacagtcatgggccattgttccaggggaaagccctaccaaattaaagctaagaaaaacttatca

SEQ ID NO: 729417 - DNA, 661 bp, Homo sapiens
cctgaaaactcatgtatttaatgaaatgcatgaagaatacagttggcagtctgagatgataactttagtatatttttcccagatttcctatagttggtaaattatttcttggttattgaattcagttttacttttttggtactatgttggttaaggaaattgctgtggttttccttgctgttccatttgactgcttggggcagtctggtcttggcttttttgggagttggtagagatctttttttttttttttcctagatcttatgggaaatacattatgccaaaatcatcctaacatgaaatctggaagcaagacactaaattgtggctactaccagatacataagcttgagttagctgttagattttacagttagtacatgtgaaagtcttagtcaacataaagattatgcatttatttttgctcttatttacagttgactcataagtgtaaggacaatgtaaaagtggttaaatagggatgttaggtatcgtgtggagaacggatgctgcatttaatggtctttaggtttcctgtggtcagcttttttcaaaaaaattaggaaaatttggcaattagctggttttttttctgccatagtattttgcacttcaattatttaattgcacttcaatttttagttttcgggttcgtaaaacc

SEQ ID NO: 729418 - DNA, 499 bp, Homo sapiens; identical to SEQ ID NO: 66407

SEQ ID NO: 729419 - DNA, 4734 bp, Homo sapiens; identical to SEQ ID NO: 66406

SEQ ID NO: 729420 - DNA, 3052 bp, Homo sapiens
ctgggattacaggtatgagccaccgcacctggcccttgggcataaattgtaacataagtgtatgttcttcgacacatttaagagtggagtgatggtgtcataaaattaaataatgggatgttctaagtcccttaagctggacctttccaatctgtgcatcaaagctaattctgcattaaagtgcaaggacggctcacaaaccccatagttgcctgatatagattggcaggtgcattctcttggtttcgtttttattcctgctgaaatgtttaatgatcttgtgtggcgtcattctgttgccgattgtgtaagagagaagctggacctgggtggagacaggcttcttaggtggcctcagtgggctgttgggcatttatggttctgctggttgcagctgagatcttcagacagaatactcttctccttgaccagcgcttatctttcagattgtgaactaggcccagacaccattaccattcaccatctctaacattctcttattctttgactacataaggcactgtcgttctaggggaaacatgatagaggaaggaagttggttgcagaaaccattctttgaaagacttttttttttttttaacttagtcaattaaaatagtcctttaaggtgaacttagttctgagtttctggtccttttcccagatggaaaaggattttcaagaaaaaatcctgtcacttactgagcatgtgtgccggctcctttttggcacttccatcctcaccacaaccctataaaggagggagctcgtggcgaggcagcccaggtttctagataaggagagtctcgaggaggttccttaaccttcctgtggtggtttttctccattttttaaaatgaagaaacagaggccaagagaggttagggaatttgctcaaggtcgtgcagccagtggcagctgttctcactcggagttctgagagaggtaagcctcagaagccgggcatccattgtgtgtaacgtagtaacgtcttgcctgtgcatctagaaaggtacctgttatgttccgttcataggagaattgagaaaatattaatagtcacttcattttaagaactccagttgaaaaaggctagacagtcaatgtttgttcattgtttttctccattcttccccagcatgcgcgctctctcatgcacacgcacgcatgcgcacgtggctgagccaaagcctaagctgcgaattgagtttcgttaattcatgtggaggcagctgagagtgccacctggtcctgaagaaattgggatacttgtgggcacaaaggtggacctgagatcactggagccaagctggtggaagtgttgaccactgccgttggcagagagctgtcattactggtgcttcaggccacagctcagcaggctgtccttgttctgttttgttaagagcctagcagcatggctagcttgcaggcataatcccagagcctcttgctatctgcctgcaggaagtctctatgtgctccagcacactgaaggaatttggtgctcactttctcctgcttttgagctttggtcctgtgttattactaatccttagaggaagattttgactgtaaccactttcctgagtgctcttaaggcaggtccagaggattctcacagcgtgaaatgagaaaacgctcagcctcagaaaaatggaagttattcttttagtgccaaagtgtcattggaccacagtgcagcttggttaattcaggttaagacttagcccctggaacagtgtcaagccaaggcctgtgtggtttcatcatagatttgtaaaacaaaaaacacgtgtgttctggtaaattccaagcgcacattagtgcatacgtgtatgtgcaggagcactccctgtaagactcttgttctcatttcacactggcgcgtccccggggctggggaaatcattttcatttttgagagtaaccttaactaattaaatggatcaagggactctttgtgttttgttttcattttgttttgttttttactttaatgtacagataaattaagggaaataataattaccttgaataattttgattctcgtaactaattttccacctatgtgtgtttagctcaattttgaaatggttcactgaaagatttccaaatttcttatcactgaaactgagttatttcacttttatgactgttagtgactcctctgttttatgtatttctggtgcagtataattcttctatgtctgtgtgtctgtgatagatctcagttcaagttagcgtttcccgagcacccatcttgtgtcaggcactctgctaatgattgcgcaggttacaaggtttagagtggccacatcccctgttcacttgcagtttagagtccagtcggaggaaagggaggaggggaatcatgttatagacataacttgatatcctgcaggactcagtgatgtatgagcctcaaaaaggtcacagctgagtgagagagttggtaatcatggaaacaggcgcatcggaaactcgcttcctatgggtcagtaaagtgtgtatgaggtggtgtggatgacagcacatagagctggaggggtgggccagcagcaaccaggagaaggcgttccaggtgtctgcacccaaggagatcctggggtcagaggcaggacatgtgggaaaaaccattggtcccttttacccagggaaggactcaagaagccgaacgtggtaggagatggaggctcccaagccctggcagacgttacagcagcgctgagcactttcaggaccaggactccaaggtccagctctggaacgcccctctctgccctgactttggttccttcatcagcagaggggctcctgggctatgggctcaagtctgaagtcaccttaaagagaaatctctacctttctgttctccttcattgctgaggcaggataatggtgtgaacccaggaggtggagcttgcggtgagacatgattgctcactgcaagcttgggtccaggtgtgttttgtgcagtgagctgagaccatgccactgcactccagcctgggcaacagagcaaggctctgttttgtttcgtttaaaaaa

SEQ ID NO: 729421 - DNA, 455 bp, Homo sapiens; identical to SEQ ID NO: 304308

SEQ ID NO: 729422 - DNA, 439 bp, Homo sapiens
  misc_feature (25)..(26): n is a, c, g, or t
  misc_feature (28)..(30): n is a, c, g, or t
aagaattcggcacgaggctctcagnnannncctgctcttactccaaaaagatggacccaggtccgaaggggcactgccactgtggggggcatggccatcctccaggtcactgcgggccaccccctggccatggcccagggccctgcgggccacccccccaccatggtccagggccctgcgggccaccccctggccatggcccagggccctgcgggccacccccccaccatggtccagggccctgcgggcctccccctggccatggcccaggtcacccaccccctggtccacatcactgaggaagtagaagaaaacaggacacaagatggcaagcctgagagaattgcccagctgacctggaatgaggcctaaaccacaatcttctcttcctaataaacagcctcctagaggccacattctattctttaaaaaaaaaaac

SEQ ID NO: 729423 - DNA, 373 bp, Homo sapiens
  misc_feature (25)..(26): n is a, c, g, or t
  misc_feature (28)..(30): n is a, c, g, or t
aagaattcggcacgaggctctcagnnannncctgctcttactccaaaaagatggacccaggtccgaaggggcactgccactgtggggggcatggccatcctccagggccctgcgggccaccccctggccatggcccagggccctgcgggccacccccccaccatggtccagggccctgcgggcctccccctggccatggcccaggtcacccaccccctggtccacatcactgaggaagtagaagaaaacaggacacaagatggcaagcctgagagaattgcccagctgacctggaatgaggcctaaaccacaatcttctcttcctaataaacagcctcctagaggccacattctattctttaaaaaaaaaaac

SEQ ID NO: 729424 - DNA, 585 bp, Homo sapiens
tacgaaaagtggtttgtttttttacaaatgtgtggttcatactcctgggtggccttattagcttttttggttgggagacaagggaaggaactttcttggatcagtgtgtgctggtgattttattgccttttcctcttaattcaatcccactctttcccttcctcaagtcttgttcacccagcctcctgccccaggaatcacggggaagaagtctgggagaccacagaaaaaacaccaatgacactgagctattagagatcaaaactgggtcaggaagagttcatgttaagctttcacatgtgctaagaacgctgaaagatacacactgatttccatcttaatagtgccggataattgacaaatttgggacaagatgagggagaggtcaaaatccccctaacttcccaaagcaaaaaaacaggagtataatgatcagaaacgtaatagtagtgtcagaagcacacaatcagctgtggacggtgaaacatataatggttctatctgttctgagattgtaaaagcacaattattttcatcaggataaaaaataaaaatgaaaaactatgctgttgaatggaaatgcta

SEQ ID NO: 729425 - DNA, 807 bp, Homo sapiens
gtttcataatttaacaacaattatcaatgaagtaggtaatgatcttgatattgcacatctgcgaaaagttatcagtgaacatcttacaaatttgttagaatgttttgaattttattttccatcaaaagaagatccacgcataggaaatttgtggatccaaaatccatttctttcatcaaaagataacttaaatttaactgtaactctacaggataagttgttgaagctggctaccgacgaaggattgaaaatcagttttgaaaatacagcatcacttccttcattttggataaaagctaaaaatgactatcctgagcttgctgagattgctttaaaattgctgcttcttttcccctcaacatacctctgtgagaccggattctctactttaagtgttattaaaacaaaacatagaaacagtttaaatatacattatcccctgagggtagcattgtcatcaatccaacctagattagacaaattaacaagcaagaagcaagctcacttatcacattaaaagctttaaatattgatatgtaaggtattggttcaaagtatgcatataagcattgagtgtgaggaatttgctatttcactttaaactttctgtctagttacagttatggaagtatgagaagttatgagtgaaacagcaattttctatataaattgcctatatgtatattttcaattaagaatgtgtacagtttttataattctatttttcctcatatttgtcgtatttattaaaatataattttaaatctgttgattctaatattaaaacatttgatcttatattttgtg

SEQ ID NO: 729426 - DNA, 989 bp, Homo sapiens
gagtttcctcatgcgccagccagcgtcaccatcggccgcaactcgtcgcagggctcggtggacttgagcatgggcctgtccagcttcatctcgcggcgccacctgcagctcagcttccaggagccgcacttctacctgcgctgcctcggcaagaacggcgtcttctggacggggccttccagagacgcggcgcccgcctgcagctgcccaagcagtgtaccttccggtttcccagcacggccatcaagatccagttcacttcgctctatcacaaagaagaggccccagctccccgctgcggccactgtacccccagatctcccctctgaagatccacatcccggagccggacctccggagcatggtcagccccgtcccctccccgacgggcaccatcagtgtccccaactcctgcccagccagtccacgcggtgccggctcctccagttaccgctttgtgcagaacgtgacctcggacctgcagctggcagcagagtttgcagcaaaggccgcgtcggagcagcaggcagacacgtctggaggagacagccccaaggtctgagcccacctggcgccgtggtgcacctggtgacccaggatcgggccatagtgacccggcgcgggcggcacagacagcccagggcctgcgggcgtgtgctcgaggtggtctcagcccacagggaatggagccgcagctggcggtagagccgtcggccctttctcgttttcgtgcccaaatcatccccgttggtcatttgctggtgacaggggtggcgccgtcaccgagggtaccctcccgccacgctccttgttcatctgccgctggcagcccggcgtcaaagccttcatacagcccttgagcaggatggcgttctccttataactttgtcttagttcatttttgtccaatagctgttttcaaattgatttctggaagaggtgagaaatttcagaattaaattataataaaaccgaagttttccttccca

SEQ ID NO: 729427 - DNA, 606 bp, Homo sapiens
aattcgcggccgcgtcgacgaagacgacagaagggggggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttagtatacatggcctggtcctaccagagactcacccaatgccagcctccagccagggagagccaagtttgcattttcacacgcatctcacactcctctgcactctcaacttggagagctccaaacagggaaaccccaagccttgctggcttctgccaaccccctgagcagaagcatgggtccccctgatcaccacctcaccaccctcatcctgatctcactgtacactccctttcctggtctgctaagtagcgggtgtttttccttgacactaacgctacagctagaccacggtgggcttggcaacaggtgtcttcccagatgctggcgttaacgctagaccaaggagccctctggtggccccgtccgggcatcaggctcgcactcttgtcttctggtcatcctcatgttccctc

SEQ ID NO: 729428 - DNA, 206 bp, Homo sapiens
acagcaaccaattgcaacaaaacaaaatgttaagaaatgatctttttatgaggcaattggaaatttgaacactgatcaactataggatgattggaattattaattttgtaaaggtgtgataagatactgcacttggctgggcacagtggcacatgcctgtaatcccagctacttggcaggctgaggtgggagaatcgcttgagctc

SEQ ID NO: 729429 - DNA, 422 bp, Homo sapiens
gtggcacatgcctgtaatcccagctacttggcaggctgaggtgggagaatcgcttgagctcaggagttcgagaccagcctgggcaatgtggcgaaatccccgtctttacaaaaacaaacaaacaaacaaaaaagatattgcagttgtgttgtaagcgtccttatctttcagagctacatagtggaatgtttatggaatatttaggataaatgatatacgcatttgggatttgctgcaaaatgacccagagtcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttagtata

SEQ ID NO: 729430 - DNA, 485 bp, Homo sapiens
  misc_feature (113)..(113): n is a, c, g, or t
  misc_feature (116)..(116): n is a, c, g, or t
ccgagtctttgccggacttagataccgggtccctggagtattcccccccgggggttatgtcctctccagtgtgttttttttttttgaaaaagtaaagagataataacaaaaanaanagttgagtaggaaggacgtattgaaaaatggaggaatctgataacaagtagtatgaagtcagatttgtaagagtctgagaagaaataagtagagaaaacagaaaatggtgtgaggtttacagtgttaaccacaaagtgaaagcaggcaagaacgtggtgggtacctggctgggtaaaggtcactggcaaagctttggtgtccatagtgactcaaaacaaacaaacaaacaaacaaaaaacaaacaaaaaaacaggtacgataatctaccttaggctaaaaaaaaaaggccaaatttcagcctgaaagggcccacagtatgcccaataaagagaaaatgctgacatctattaatacatctactatggtga

SEQ ID NO: 729431 - DNA, 431 bp, Homo sapiens
  misc_feature (59)..(59): n is a, c, g, or t
  misc_feature (62)..(62): n is a, c, g, or t
attcgcgggcgcgtcgacaactcttgtttttgttattatctctttactttttcaaaaanaanagttgagtaggaaggacgtattgaaaaatggaggaatctgataacaagtagtatgaagtcagatttgtaagagtctgagaagaaataagtagagaaaacagaaaatggtgtgaggtttacagtgttaaccacaaagtgaaagcaggcaagaacgtggtgggtacctggctgggtaaaggtcactggcaaagctttggtgtccatagtgactcaaaacaaacaaacaaacaaacaaaaaacaaacaaaaaaacaggtacgataatctaccttaggctaaaaaaaaaaggccaaatttcagcctgaaagggcccacagtatgcccaataaagagaaaatgctgacatctattaatacatctactatggtga

SEQ ID NO: 729432 - DNA, 1583 bp, Homo sapiens
acagctgctgctggctcttcctcttgcggccttttcctgaaacggattcttctttcggggaacagaaagcgccagccatgcagccttggcacggaaaggccatgcagagagcttccgaggccggagccactgcccccaaggcttccgcacggaatgccaggggcgccccgatggatcccaccgagtctccggctgcccccgaggccgccctgcctaaggcgggaaagttcggccccgccaggaagtcgggatcccggcagaaaaagagcgccccggacacccaggagaggccgcccgtccgcgcaactggggcccgcgccaaaaaggcccctcagcgcgcccaggacacgcagccgtctgacgccaccagcgcccctggggcagaggggctggagcctcctgcggctcgggagccggctctttccagggctggttcttgccgccagaggggcgcgcgctgctccacgaagccaagacctccgcccgggccctgggacgtgcccagccccggcctgccggtctcggcccccattctcgtacggagggatgcggcgcctggggcctcgaagctccgggcggttttggagaagttgaagctcagccgcgatgatatctccacggcggcggggatggtgaaaggggttgtggaccacctgctgctcagactgaagtgcgactccgcgttcagaggcgtcgggctgctgaacaccgggagctactatgagcacgtgaagatttctgcacctaatgaatttgatgtcatgtttaaactggaagtccccagaattcaactagaagaatattccaacactcgtgcatattactttgtgaaatttaaaagaaatccgaaagaaaatcctctgagtcagtttttagaaggtgaaatattatcagcttctaagatgctgtcaaagtttaggaaaatcattaaggaagaaattaacgacattaaagatacagatgtcatcatgaagaggaaaagaggagggagccctgctgtaacacttcttattagtgaaaaaatatctgtggatataaccctggctttggaatcaaaaagtagctggcctgctagcacccaagaaggcctgcgcattcaaaactggctttcagcaaaagttaggaagcaactacgactaaagccattttaccttgtacccaagcatgcaaaggaaggaaatggtttccaaggtattttaaatattaaagttaacttaaagaagtaaaagagttgttaatgttatatgttcaggcagtaaaagatcaacagccaaccaatgctgttgtcatttcaagagccatcaggcaaaataggttataagatgggagtctggtgacagacagaattgaaaagggcaaagttgtagtattaatatcaaatactcagctttaaaatgtctagcaatccatatttgaattttattttatttttttcggtaaagaaaagcagtattggccttggagtcagactgccctggttctgaatcctgaggctccttctactagttgtgtgaattcgagctagttatgatgctttctaaacccatttgctcatccgtacactgtgttaaccaaaagtactt

SEQ ID NO: 729433 - DNA, 894 bp, Homo sapiens
gcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaaacaacaacacaaagaagcccgagggcccaaaagccgggcgcgcgacaagagggcaacgaacggccctggccaagcgggtccctgacccaaggctggcacaagggagaccgcggcccctaaaggacgcgatattcgaaagccggtaaccgtaggg

SEQ ID NO: 729434 - DNA, 920 bp, Homo sapiens
gcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtgtgtggcgcgtttgaccctttaggggaaggggaaaaatcgtagtagcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaaacaacaacacaaagaagcccgagggcccaaaagccgggcgcgcgacaagagggcaacgaacggccctggccaagcgggtccctgacccaaggctggcacaagggagaccgcggcccctaaaggacgcgatattcgaaagccggtaaccgtaggg

SEQ ID NO: 729435 - DNA, 386 bp, Homo sapiens
tgtgcgataccccaagattttcctccacccgccaaaggccttctcatccgcatcagcagttgctggaacccgcctgccggtgagggcgggccggggcggagagtcgggttgtccgagttacttgctgggtcttgaccatccctttaactttatcacatttctttaaagaaaatctgtcttgccctctctttattgctactccatccttctttcaagatcaaaagatttagatcaaagccaagatcaaactcactactttaaatagcagcaactttgccatggagtattttacacagaggagcttaatggagacatcaggaatttatcccttcattccatattcataactcggacaactcgtcgggatcctctagatgaccgcagca

SEQ ID NO: 729436 - DNA, 841 bp, Homo sapiens
ctgatgaacatagatgcaaaaatcctcaagaaaatactaatgaaccaaattcaacaacatatcaaaaagaaaatccaccatgatcaagtgggtttcatgccattaatgcagggatgatttaatatacacaagtaataaatgtgatagagcacatacacagatttaaaacaaaaatcacatgatcatctcaatagatgcagaaaaaagcatttgacaaaatccagcatccctttatgattaaaaccctcagcaaaatcggcataaaggggacataccttagagtaataaaagccatctacaacacaaacaaagggaaacgcatcccatgctcatggatgggtacatatggaaccaaaaaagagcccaaatagccaaagcaagacaaaaaaaaaaaaaaaataggcgcatagaccaatggaacagaatagagaacccaaaaataaagccaaatacagccaactgatctttaacaaagcaaacaaaaacatgaagtggagaaaggacaccctattcaacaaatggtgctgggataattggcaagccacatgtagaagaatgaaactggatcctcatctctcaccttatacaaaaatcaactcaagatggatcaaagacttaaatctaacacccataaagattctagaagataatattagaaaaacccttctagacattggcttaggcaaagacttcatgaccaagaacccaaaagcaaatgcaacaaaaacaagaataaatagatgggacttaattaaactacaaagcttctgcacagcaaaagaaataatcagcagagttaacagacaacctacagagtgggagaaaatcttcacaatctata

SEQ ID NO: 729437 - DNA, 238 bp, Homo sapiens
cagtttaagggctacccatttctgaagctattctctctgttaccttagggcttctgttttggttttcagactctgaaacctatgtgaccatttctctttccttatttaaggcccctttcctttaccctctctataccttgagtttttacagtctcccagaaagcttgagattgacagttcatgcaatattccagaagaaatagtctgaaacaggtagcccttaacctacgcagtcaca

SEQ ID NO: 729438 - DNA, 368 bp, Homo sapiens
cttgaatattttccattcccatttggttgaatctgcagatatggaacctgcaggtatggggagggctgatgtacattaatctctggaaattctttacaaccctggtcagattcatggtcataaactgaagcctttggcctctagcctgttagcttgttgctgggattggagcagcgaaggtggtaaggtgcagggcatggttaccagggttgtgaatctgggtggtatttgggtgaatacacatgactgtatacagtcccagccatttctctttccttatttaaggcccctttcctttaccctctctataccttgagtttttacagtctcccagaaagcttgagattgacagttcatgcaatattcca

SEQ ID NO: 729439 - DNA, 421 bp, Homo sapiens
cgaccaggacgctctgcatccccagtagcaggctgagccgagggaggctgcgtatgcccgcccctctggctgtcggagccgcacctcttcctcttccggcccccgtagcaattaggtttctttgcaggagatgaagccagactgctcatcattccagacatcttcagctgctacacccagaacaagcattcgaaatatgaacaggatggtgagccagatctttccaatcatggtggagtggatgtgaacttcctccagagtatctccaaggagattccagtcccccatgtttatttagtcagccatcttagctctgatccacatcaaataagaggcagataaattcttccattctgaagggagcactatttcttaaagcaaacctatggtgaaaatataacaatatgtcacttctaaaagc

SEQ ID NO: 729440 - DNA, 448 bp, Homo sapiens
attgattgtcctcatcctgcaactgtacttgcccaaccgatatttattgatgcctgcagtgtcctgggtgcctaccaaggggcacagaactggatccgacgcagaccctgcctgccttcaggttgcttgaagatgaacagagagatcggacctctgcatgaagccagactgctcatcattccagacatcttcagctgctacacccagaacaagcattcgaaatatgaacaggatggtgagccagatctttccaatcatggtggagtggatgtgaacttcctccagagtatctccaaggagattccagtcccccatgtttatttagtcagccatcttagctctgatccacatcaaataagaggcagataaattcttccattctgaagggagcactatttcttaaagcaaacctatggtgaaaatataacaatatgtcacttctaaaagc

SEQ ID NO: 729441 - DNA, 365 bp, Homo sapiens; identical to SEQ ID NO: 120683

SEQ ID NO: 729442 - DNA, 457 bp, Homo sapiens; identical to SEQ ID NO: 120682

SEQ ID NO: 729443 - DNA, 334 bp, Homo sapiens
attaatgtagtataaagaaataggtagattaagccagagtttttgttattggtttttatatttattatatatttatttattttttgagacagggtcttgctctgttgtccaggctggggcacagcagcacagtcacagctcatagtgacctcgatctcctggtctcaaggcaatcctcccacctcagcctcctcagtgctgggattacaggcatgagccaccacgcccagcccgtaccctgtatttcttgaagtgaagaatataaagtctgtatgggtgcagttcctgagtgttctgctcttccctaaagtttatatatttttttagcttaagt

SEQ ID NO: 729444 - DNA, 791 bp, Homo sapiens
tgcctcagcgtcgacgatctggtagcaaagaagaagaaacaaacactgatctctttctgccacccctctgaccctttggaactcctctgaccctttaggacaagcctacctaatatctgctagagaaaagaccaacaacggcctcaaaggatctcttaccatgaaggtctcagctaattcttggctaagatgtgggttccacattaggttctgaatatggggggaagggtcaatttgctcattttgtgtgtggataaagtcaggatgcccaggggccagagcagggggctgctgctttgggaacaatggctgagcatataaccataggtatgggaacaaaaaacatcaaagtcactgtatcaattgccatgaagacttgagggacctgaatctaccgattcatcttaaggcagcaggaccagtttgagtggcaacaatgcagcagcagaatcaatggaaacaacagaatgattgcaatcattctgttgtttccagtcgtccttctgacttgataaaagggaccgtcttccttggatttagtgaacccctttggttcctgaaaaattcaaggagtatctaggacatagtccccagaagacagtacaagactttctgataaactggacatttcaagacccaaataactaatcagaaaaatcaaagatgtgatactattttttatcccatgcataggtgctacacttggatcaaatgaacaatgttgggatctctatggataaaggtcttaaaagtcctgagataaagaatcctgcacccactggtacttctaa

SEQ ID NO: 729445 - DNA, 801 bp, Homo sapiens
  misc_feature (477)..(477): n is a, c, g, or t
  misc_feature (678)..(678): n is a, c, g, or t
gggctgttgcaatctccacgtgcgatggatccttggacccactttgttaactcttaaacttgtgtcttgtctttatttcttttctcattccctcgtctccaccgggaaggggagagcctgcgggtggtgtatcaggcaggttcccctacatctttggcacccaacacggtctccttgaacccaggtgaagttacacctgagcgtggtcgtgtgaagaacggtctgtccaggaactcccgagaacgtgtggtcggccttgcggtaagcttgtgcactcggagcattccaggacaccatgggacaatccaaaagtaaacattctgcatatttacattttattaagctcctcttaaagagggcaggaattaaggctagcacagaaaatttgattactctgtttccaacagtagagcaatatcgtccttggtttcctgaacatggtaccatggacttcaaagattggaacaggtgggaatngccttaaaacaagttgtaaggaaggaaaatttatccccctaacagcctggtcaaactgggctatagttaaagcagcctcggaaccgtttcaatcgggaaaatgagggcttatcctccagcagaaagaatttctgcagaggaaggtgggatgctgctgaaggaggagaggtagtgaagacgattggggaaatacagaccacntgggatgagtaattctttgggggcacgtggcctcaagtgttcttaaatagaagagcttttgccagaggttaacaaaagagggtcggagggaggggggcccatgggaaaaggggggggcacaaa

SEQ ID NO: 729446 - DNA, 483 bp, Homo sapiens
gggctgttgcaatctccacgtgcgatggatccttggacccactttgttaactcttaaacttgtgtcttgtctttatttcttttctcattccctcgtctccaccgggaaggggagagcctgcgggtggtgtatcaggcaggttcccctacatctttggcacccaacacggtctccttgaacccaggtgaagttacacctgagcgtggtcgtgtgaagaacggtctgtccaggaactcccgagaacgtgtggtcggccttgcgacaaggctcaaaggaaccatatcctgatttcattgctcgccttcaagacgcagcacagaaggctctcactgatgaaagtgccaggaaggccgggtgcggtgctcatgcctgtaatcccagcactttgggaggccgaggtgggcggatcacctgaggtcgggagttggagaccagcctgaccaacatggagaaaccccgtctctactaaaaatataaaactta

SEQ ID NO: 729447 - DNA, 489 bp, Homo sapiens
ggccgagaaggcgacgcccctggcgcccaaaggggccgctccgggagctgtccagcctgtggctggtgctgaagcggcccccgccgcgaccctggccgctttgggcggcaggaggcccggaccgcccgaggagccgcctcgggagctagagtccgtgccctcgaaactcggggaaccccctccgctcggagaagggggaggagggggcggggaaggaggaggagccggcggcggctccggggaaagggaggggggcgctccgcagccgccgccgcccaggggctggcgagggaaaggcgtacgcgctcagcagaggggcggcagcggcggggagggggcctccccttctccatcctcctcttctgcgggcaaaaccccaggaaccggcagcagaaactccggaagcggcgttgcggggggcggcagcggtggtggagggagctactggaaagaaggatgtctgcagtctgagctcatccagttccatct

SEQ ID NO: 729448 - DNA, 317 bp, Homo sapiens
gttttattttttttttttactacaatcatacattgtctgacataatatgtcacagtcatagtgtctgacaaaaatatgtatgtcataacacatacacaagatgaagaagctcagaaacaaaggatccagaataacaatttcagtcctacaaagcaaaatattctaaagattttccaaggaatttgaaaaagcatggtaatataaacattctttttttaatgtttagaatcaatctacagccaaaacatggaagattttacaatttactatagttacaaaaaaaaatgtaaatgttgtaaaccttcacaaggtcgacg

SEQ ID NO: 729449 - DNA, 1872 bp, Homo sapiens
  misc_feature (1091)..(1092): n is a, c, g, or t
caggccagagtcccagctgtccaggatcccctgtgacaaggctgatgcaggtgtggagtcaatgtgggtgcctcctgcagccgggtgccaggaggggtggaggggccaccctgggctttgtccgggagcctggtcttcccgtccttgggctgacaggtgctgctgcctctgagccctccctgctaagagctgtgtgctgggtaaggctggtggccctttgggctccctgtccaggatttgcgctctggagggtagggcttgctgggctggggactggaggggaacgtggagctccttctgcctcctttcctgccccatgacagcaggcagatcccaggagagaagagctcaggagatgggaagaggatctgtccaggggttagacctcaagggtgacttggagttctttacggcacccatgctttctttgaggagttttgtgtttgtgggtgtggggtcggggctcacctcctcccacatccctgcccagaggtgggcagagtgggggcagtgccttgctccccctgctcgctctctgctgacctccggctccctgtgctgccccaggaccatgaatggcacctacaacacctgtggctccagcgacctcacctggcccccagcgatcaagctgggcttctacgcctacttgggcgtcctgctggtgctaggcctgctgctcaacagcctggcgctctgggtgttctgctgccgcatgcagcagtggacggagacccgcatctacatgaccaacctggcggtggccgacctctgcctgctgtgcaccttgcccttcgtgctgcactccctgcgagacacctcagacacgccgctgtgccagctctcccagggcatctacctgaccaacaggtacatgagcatcagcctggtcacggccatcgccgtggaccgctatgtggccgtgcggcacccgctgcgtgcccgcgggctgcggtcccccaggcaggctgcggccgtgtgcgcggtcctctgggtgctggtcatcggctccctggtggctcgctggctcctggggattcaggagggcggcttctgcttcaggagcacccggcacaatttcaactccatgnngttcccgctgctgggattctacctgcccctggccgtggtggtcttctgctccctgaaggtggtgactgccctggcccagaggccacccaccgacgtggggcaggcagaggccacccgcaaggctgcccgcatggtctgggccaacctcctggtgttcgtggtctgcttcctgcccctgcacgtggggctgacagtgcgcctcgcagtgggctggaacgcctgtgccctcctggagacgatccgtcgcgccctgtacataaccagcaagctctcagatgccaactgctgcctggacgccatctgctactactacatggccaaggagttccaggaggcgtctgcactggccgtggctccccgtgctaaggcccacaaaagccaggactctctgtgcgtgaccctcgcctaagaggcgtgctgtgggcgctgtgggccaggtctcgggggctccgggaggtgctgcctgccaggggaagctggaaccagtagcaaggagcccgggatcagccctgaactcactgtgtattctcttggagccttgggtgggcagggacggcccaggtacctgctctcttgggaagagagagggacagggacaagggcaagaggactgaggccagagcaaggccaatgtcagagacccccgggatggggcctcacacttgccacccccagaaccagctcacctggccagagtgggttcctgctggccagggtgcagccttgatgacacctgccgctgcccctcggggctggaataaaactccccacccagagtca

SEQ ID NO: 729450 - DNA, 1708 bp, Homo sapiens
  misc_feature (927)..(928): n is a, c, g, or t
tccgatcaggctgatgcaggtgctgatgagtaggagaggtatcaaagatatattggccaaacccattacagtactacttggttcccggtagggcttgctgggctggggactggaggggaacgtggagctccttctgcctcctttcctgccccatgacagcaggcagatcccaggagagaagagctcaggagatgggaagaggatctgtccaggggttagacctcaagggtgacttggagttctttacggcacccatgctttctttgaggagttttgtgtttgtgggtgtggggtcggggctcacctcctcccacatccctgcccagaggtgggcagagtgggggcagtgccttgctccccctgctcgctctctgctgacctccggctccctgtgctgccccaggaccatgaatggcacctacaacacctgtggctccagcgacctcacctggcccccagcgatcaagctgggcttctacgcctacttgggcgtcctgctggtgctaggcctgctgctcaacagcctggcgctctgggtgttctgctgccgcatgcagcagtggacggagacccgcatctacatgaccaacctggcggtggccgacctctgcctgctgtgcaccttgcccttcgtgctgcactccctgcgagacacctcagacacgccgctgtgccagctctcccagggcatctacctgaccaacaggtacatgagcatcagcctggtcacggccatcgccgtggaccgctatgtggccgtgcggcacccgctgcgtgcccgcgggctgcggtcccccaggcaggctgcggccgtgtgcgcggtcctctgggtgctggtcatcggctccctggtggctcgctggctcctggggattcaggagggcggcttctgcttcaggagcacccggcacaatttcaactccatgnngttcccgctgctgggattctacctgcccctggccgtggtggtcttctgctccctgaaggtggtgactgccctggcccagaggccacccaccgacgtggggcaggcagaggccacccgcaaggctgcccgcatggtctgggccaacctcctggtgttcgtggtctgcttcctgcccctgcacgtggggctgacagtgcgcctcgcagtgggctggaacgcctgtgccctcctggagacgatccgtcgcgccctgtacataaccagcaagctctcagatgccaactgctgcctggacgccatctgctactactacatggccaaggagttccaggaggcgtctgcactggccgtggctccccgtgctaaggcccacaaaagccaggactctctgtgcgtgaccctcgcctaagaggcgtgctgtgggcgctgtgggccaggtctcgggggctccgggaggtgctgcctgccaggggaagctggaaccagtagcaaggagcccgggatcagccctgaactcactgtgtattctcttggagccttgggtgggcagggacggcccaggtacctgctctcttgggaagagagagggacagggacaagggcaagaggactgaggccagagcaaggccaatgtcagagacccccgggatggggcctcacacttgccacccccagaaccagctcacctggccagagtgggttcctgctggccagggtgcagccttgatgacacctgccgctgcccctcggggctggaataaaactccccacccagagtca

SEQ ID NO: 729451 - DNA, 886 bp, Homo sapiens
ggcacagtggcggctgcagaatgagatctgcttgcctggatgccaaggctggagggcagtaagcttcggtatcctcagaggcagggggctgccacctttgcactaagaaggaattactgatttctaccatttgagaaaaggagtgttgaccacatggaactccgaataggttcatgcacatggaacaaagccctttaggagaaaagcccgttttttgctgtctgcctgatactggatggttgagaaacaatcgtggtgggcagtcacgccacacttgtgcgggcctaggacacaggaaggtttagccctggcctacagggagggtgggcaagcacagcaatcttgtcccccaaaagaacatcagtggccgctggtgccaagacccacgggaaggttagagctctgggttacatttgtggagagagacacagacagcggcagagacagagacgtagtaatccaggctgtgtggcataagaagataaagcggccccccagcccggggcccctcccatggacctcatggtaccgagcctccattttctcatctgttcagtgaggatgaagcctcatctcccagggtttttgcaaagacagggagactggccgggcgccgtggcttacgcctataatcccagcaccttgggaggccgaggcaggcggatcacaaggtcaggagtttgagaccagcctaaccaacatggtgaaaccccgtctctactaaaaatacaaaaattaggcaggcgtggtggcacgcgcctgtaatcccagctactcaggaggctgaggcaggagaatcacttgaacccaggaggcagaggttgcagtgagccgagattgcgccactgcactccagcctgggtgacagagcaagactctcaaaaaa

SEQ ID NO: 729452 - DNA, 1037 bp, Homo sapiens
ttatgggaacatttgggaaatgttttccagatgttttattttttcccttttatagtttgttgacatttaattttacttaaagatgacaattttaatcggaaatgttagaggtacaacatagtgaggttctagctagctttatacttttgaaaaatatttttgtttctactgctttttacaagtactagtcctctcagtgatactggtggtgttcagtatgaatccatagaaagaaaacaaaatttgttttttaaaaaaagcagagtaatgaatgaatttcagttttgaaaacaacataatttgaaaacactgttatactaacatggcaaggtgttaattaaatataagagtaaggtagtaagttcttttagagcacctgtttaaatttactccagtaatcatcttaaggattgatagtcaccatcacttattggcttaaaagttatatttcatggaatattatcagtgttaaatccaagctttgtggagctttaagtgatggtggtgaaaaagttggtgtttatgagagagtggtggggtgtctagtcattagtgaagttaaacatcaacctgttttagaaagaattttttagtcttgcctaaagtaaaccagaagtgtctagtgtttaaatctttatttagaatgcttctcttaaaagtattttttgttttgggtagtattaaataatcagtaaataatctatttcagtagtaaataatgaattaagatgatgatgaatgaggattaacacactggtctggagactggggttttatttcagtgggttagctgtgtgtgacatgttgggcaattactcagctgttttaacagcttccagatatgcagtatggtgcctgtactactcaaaagttgattttggtttaattcatctttaaggtacctcccagctctaaaactatgattctaggctgtgtaatggggttattcctactttattctctttccttttttaagggttcattttatacttaataagcatccatttcttgggtcacctacagtctttggtcgatcc

SEQ ID NO: 729453 - DNA, 568 bp, Homo sapiens; identical to SEQ ID NO: 728376

SEQ ID NO: 729454 - DNA, 505 bp, Homo sapiens; identical to SEQ ID NO: 6877

SEQ ID NO: 729455 - DNA, 144 bp, Homo sapiens
tttttttccagagacaggggtcttggtatcttgtccaggctggtctcaaatgcctgtagtcaaatgatcttcccaccttggcctcccaaagtactgggaataccaggtccaccatgagccaccatgctcacctctaggtcgacg

SEQ ID NO: 729456 - DNA, 550 bp, Homo sapiens
aatctgcagcttccaaatggatatgagaagtgagagggaaggggatggcggggcgggttagaccaccactaagagatggggaatgggaggggtgtgtggaagagagaccaagtcttcaaagaatgccttagagtgaggacccacgggactgtctgctgaaaagggctggagaggcctttgggatcagcttcgtcgtattcccgataaggaacagcgcctaaagtgaagggacgcgtccagtcttttagctagttaatattaaaaaacatcgtctcatttattgaccgtcatcctatgagtattacctcaacatcagtgcttgcaacagtcccattttaccaaaaaggaaactgagtcacagatgttctgtgatctgcacacagcaagtggcagagctgtttgggggcccaggtctgtcggctccaccaccccagggttgacccaaaatgacgcatgaaaggctggcattataagatgctgtttcttgtttagacgaagtgatactgttacactggaagcactaataaaacccaggtataaataaaagggt

SEQ ID NO: 729457 - DNA, 977 bp, Homo sapiens
ggaatatggtgcccaggtcagctagccatgccacgccagtccagctgccaacccacccgtcactggccatctcatcacctgctggagggagtggggtggtgcagatgaaaccagcgatcagcttggctgcccttgcttcctagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggcttttaagtaggaggttggagaacacacgtttttggtctaaaccgggggcccctctctttgcccactgaacccgcggcctgcgtggtgctgagactgcctctggccgcgtccgcttgggacagggcctgagcggtggctgatcccacctggatgtcctgggccggctcccacccgacgcccgccatcccgggacgtggtggggagaggctggcgctgctccttgccatgcttggcggccgctgctgcccggctgggggtcccgagtcgcacacgccccgcaagccctggccaccgacccggagggaacgccctgggctacggtccccaaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggcccgcttcttcatcgcacttgcggccccggctgcccggggcctgcgagtttccagccagggcccgggactctggcgcggtccggccgcgaggaaggaaggcgcggcccgggtgggggtagcggcaggcctgcggctccggccacggggcgggggcagaaaaacgac

SEQ ID NO: 729458 - DNA, 4358 bp, Homo sapiens
gttgatcctacaacaacacactttcctaaggatgatgacaactcgcatcacccctagaacggctggtatgaaccgagtttccacacagtctggctggcattgcagtcaggagatgtttggctacttcacatgttttgaacactagtaaatcttaagcttcctgagtcgagaagggagagaaatgcatgcacgtgatccactggcctgtgtgggattccttgtggcatctgaaggccgtgattcaaaggtcccctgacaaccttcccataaatgaaccaactgatcctcacaactggagagagaattaacaccttccatgggacaaagaaaaagcacattctggcctgctggcaagtcacctgtcgtttccagctcatcttcatcgctctgtattcctactctttagtaaatatgaactattaaaagcttctatgagatgcgctatgcgtgcttctgggatcagtcttttgcctgacatagcgaaagctcattttagttcagtgtggaaaaccagacctcaccagctcatcacaactaaacccataaggacggagcagcggatcactcctcgtctgactcctcccacagggagacctgattctccatcagaggctgatgccagaacccagacaatcagcctcagagagatccttccaggacatgctgtcattagccctgcggttcactactgcacatgtccatgattcaggactggaactcttctcatcgactttaaagatcctggttgagagaaaaggccaatctgagtgctgggtgcatctactgaattggaaatgatccaatggctctttagttagggtgttatgtcctgaaaataggtgacaactgcaaaccatcctctggtgtccagagactttaacaaggtttgtttcacagagactgagggcagaaaaaaggaaatggcctaaaaaggtgggtttgctgtgttgcctcacactacttgattcatggttctgattctaaaaatctcacttgatacttgatttcatatgaaagacgtgtaaaatgcctgggtagaggcggcggcggcggcggcggcgggctcggaggcagcggttgggctcgcggcgagcggacggggtcgagtcagtgccgtttgcgccagttggaatcgaagcctcttaaaatggcagatgatttggacttcgagacaggagatgcaggggcctcagccaccttcccaatgcagtgctcagcattacgtaagaatggctttgtggtgctcaaaggctggccatgtaagatcgtggagatgtctgcttcgaagactggcaagcacggccacgccaaggtccatctggttggtattgacatctttactgggaagaaatatgaagatatctgcccgtcaactcataatatggatgtccccaacatcagaaggaatgacttccagctgattggcatccaggatgggtacctatcactgctccaggacagcggggaggtaccagaggaccttcgtctccctgagggagaccttggcaaggagactgagcagaagtacgactgtggagaagagatcctgatcacggtgctgtctgccatgacagaggaggcagctgttgcaatcaaggccatggcaaaataactggctcccaaggtggcagtggtggcagcagtgatcctccgaacctgcagaggccccctcccccagcctggcctggctctggcctggtcctaggctggactcctcctacacaatttatttgacgttttattttggttttccccaccccctcaatctgtcagggagcccctgcccttcacctagctcccttggccaggagcgagcaaagccgtggccttggtgaagctgccctcctcttctcccctcacactacagccctggtgggggagaagggggtgggtgctgcttgtggtttagtttttttttttttttttttttaattcaatctggaatcagaaagcagtggattctggcaaatggtccttgtgccctccccactcatccttggtctggtcccctgttgcccatagccctttaccctgagcaccacccaacagactggggaccagccccctcgcctgcctgtgtctctccccaaacccctttagatggggagggaagaggaggagaggggaggggacctgccccctcctcaggcatctgggaaggccctgcccccatgggctttacccttccctgagggctctctccccgacacatttgttaaaatcaaacctgaataaaactacaagtttaatatgaaaaaaaaagaaagaaagaaagacgtgtaaaatgccaagaactctaggaaacagggacaaaaacacttcaaagagaaagttcatgcacttgtttctgaccacccagggcacccttcagcacacggtgtctggagtggcctgaagcaaggagtgtcttgtgaggtgcagaggatgcaatgggagcagggtcctgtccccaccctaaaggagttcacagtttaacgcaaatgagaagccagtgaggacatcactactcctgctgtgaacttgggaactagaaacacaaaacctgagcctggagggaagctaaggaagcattctgctctggagtagacatgagtgcatgtgaagcttctgatctcccatgagagcaatggggacatggggcagaatctaaaacccatgactgaaagcaccaaattgctaaaatggcaataaagagacatgaggccaagatggagaagaaggaacccaggacgaaggtcagcctcacatttggggctcatttccctcagtttcatcactgaatttcagaagggactaactgagatgtaaagaagcagagcagcttttgcaccatgtggaggactagatggaaaacaagtagactgagggtctgctagtgacggtgacccctactgaagtccactggctttggttgggacccagaagagtcacacgccaggaatagaggtggacaggaaacaccctgacttttgtagggactgaacctcactgataacctcaattgcggatggtatggagggtgtctaggtgtgctaggacccctgcccattccccagaaatagactcccatcttttctgcagcaagataacatgctagtcggcctcaattcattgctaaatatttttaacgagtgtcttacatttagccaaaaagactagtcatgtggcaggaaaaatacaatgtcatatgaccaaaagctaaaagactgtgaaaatgaatcccgaggtgacccaagcattgaatttaacaatgccagtacctggacctccgcttgcccctaaaacattacaatcaagaatgtaggaagggaaaggaaacacgaagattaatcaagcaggaaggacaagctcagttttgcacccactgaatttgccacaaatattgtggaaaatattctcggggacattgcagttgtctactttggttggcacatggttcatacaacagtgtttgtgtcagtgaacatcttactcttcctcggcagtctttctttgcccagagatttcgcaatgactgttgaccttcatcatcaccttttggactttggcttgcactttagcttctgtagatctccataatgtaaagaggtattttgggtccattttaattcctgcaaaggataaaatccttctattcgtgtgcatataagtggacctgagcccttggttagggtgtagagaggagacggggagaaacctgagggccagaagctgttctttcccttaaaagggcaaactcatttccacactatggggactctgacagatagcataccttcctggctacggctattggacctgcaggctttcccctgtaaatccgtgttctgtcattgacattttgtgactgtaagacagacttgagataagacatctagaaaacaataattgaacaatgatgtgaatatatttcacacaactgaactgtacatttcaacaaggttaagatggtaattatcacgttatacatattttaccgcaggttaaaatgtttcacaggttgaaaggaaagcaactaccttcagttctctgagttcaagaatttgtaacatttcaccccctgctccttcctgatcttctgtggagcatcttttttccatccatgctctactcagagcccactttcccttccctgacaccagcttcactgaggctggttggaacctaacacaaaacattctcagtaatgactgaattcccacaaagaattccatatagaccgcatatgagttgaatcttctaagacatgaaatatttgttctcttcttggctaatatgcaatgcaaatcctgttgcaaatgtacgtcatatacctctgaaattcctgacgtattcaatgaaataacatctttaaagtt

SEQ ID NO: 729459 - DNA, 403 bp, Homo sapiens
gcctgagaactgggaggaagctggagaaaagatgccctctgaatctttgtgtttggctgcccaggctcgccttgacaccgaatggttgaaaacagatatacagatgatagtgtcgaaccaagtggaacaaagaaagaagatctgaatgacaaagagaaaaaagatgaagacgaaactcctgcacctgtatatagggccaagtcaattctggagacctgggtgtgggtcaagcaaccaggtaatcttctgagttttggcattttggaaagcttgatctgacgctccttttctaaataacttggatggattattcgtattttttggtaacaatttaaaaaaatgtaattaaaaaaatttaaatattgtggtaaaatatacataccttaaaacttgcaaaaaaaat

SEQ ID NO: 729460 - DNA, 507 bp, Homo sapiens
atgatagtgtcgaaccaagtggaacaaagaaagaagatctgaatgacaaagagaaaaaagatgaagacgaaactcctgcacctgtatatagggccaagtcaattctggagacctgggtgtgggtcaagcaaccaggaaacggaagcccaaagaggaggggagcttacagcaggccctggactagggattaacacaaaaacaacagcaacaaatctgatttaagcttcacacatctactcaggagactgaggcaggagaatcggttgaacctgggatgcggaggttgcagtgagctgagatcgcaccattgcactccagcctgggcaacagaatgaaactgtctcataaaacaaatataacatgaaatggtaacgtctttctttaaaaccaaagaaaatatgcaaggcggatgtcttcctgtcacttcgcacagtctactcccatagcgcctgagccccagaccccaaactcactgtcctgctcggggacccccagaccacagtgaac

SEQ ID NO: 729461 - DNA, 534 bp, Homo sapiens
  misc_feature (285)..(285): n is a, c, g, or t
aaacagcttccccttatagaaatttgccccttgggacaaaaaatccgccaagtggggttcctcagttacgtgccagttccccgcaattcgatacctgagctacatgtcaccaagccaggtgggctggttttctgaccaccaggaccaactggtccaaccttcaatacaaggaggctctggaggccaccctggacaggctggagcaggctgggatgtgggaaagcctggtggcctggcctgtggaccgcctgtggaccgctgggagctggctacctccgagctggnggtggtatccggcatctctgccaaggatggcttcatctccggcattgtctacctgtaccgaaagtggaaggcgacccaggttgaggaagtgagatccagcccccagcccccagctggcccctgactccatgtggccttagctgggcccatctgctgggcctcctctgcctcccctgtaaaatgggacctccgaaccaaccctgcccctcagaaatgccctgcctattaaatgagctcccagaaaaaaaa

SEQ ID NO: 729462 - DNA, 535 bp, Homo sapiens
cagtcagattttatttttgcttaactaagacaaagtgaataattcactgtgagccaaattctttcttgattcctctttttggagcagtccatctttatgggaaaaccagcctagaatggtgatttcagtttcaggtgatttcgatagaattgtatttggctcagaaatgataagactggggccaagaaaaattttaaactttttttttttgtaatcatattactagtttgatttcatatgaacttcctttgttgactttctttgccattaatttaaaagttccagtatcctcaatatttgatgtcttatatgtacagaatcctttccagctgtaagtcatcagcaagtaaaaaatttagtatggcaatagttttcataagaggttttttaaaacagaaaaatgttgacattgccagcctctgggttgcattttgggatatgctacatttcaaaggtatcttttaaatctgaaggcaaagactttttcaacatctgaatattctgatttacagaaattaaaaaaaaaaaaccccgg

SEQ ID NO: 729463 - DNA, 641 bp, Homo sapiens
gaggaagcccccctggggatttggtttggtcttgtgatcaggtggtctatggggctatccctacaaagaagaatccagaaataggggcacattgaggaatgatactgagcccaaagagcattcaatcattgttttatttgccttattttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttatactgtgtaattgtaagtggaca

SEQ ID NO: 729464 - DNA, 1231 bp, Homo sapiens
gtccttttccgtgctacctgcagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttccccgtgaacacccatgggaggtcatgcctgatctgtacttctacagaggatcctgaagagattgaaaaagaagagcaggctgctgctgagaaggcagtgaccaaggaggaatttcagggtgaatgggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaaaaaaaaaaaataaaaaataaaaataaaacctccgggggttttttgtgggggggggaaaaaggggttttgaaaggcgctgggtcatggggtttcttggacccaatttttttgtacaaaggggggaaaatcggcgggccccctaaaagggagcgaataaatcgaaaagcggttaactgttaggatgggaac

SEQ ID NO: 729465 - DNA, 213 bp, Homo sapiens; identical to SEQ ID NO: 405627

SEQ ID NO: 729466 - DNA, 1895 bp, Homo sapiens; identical to SEQ ID NO: 405633

SEQ ID NO: 729467 - DNA, 465 bp, Homo sapiens; identical to SEQ ID NO: 405629

SEQ ID NO: 729468 - DNA, 2059 bp, Homo sapiens; identical to SEQ ID NO: 405632
  misc_feature (1908)..(1908): n is a, c, g, or t
  misc_feature (1911)..(1911): n is a, c, g, or t

SEQ ID NO: 729469 - DNA, 1404 bp, Homo sapiens
gtctgacttcctcccagcacattcctgcactctgccgtgtccacactgccccacagacccagtcctccaagcctgctgccagctccctgcaagcccctcaggttgggccttgccacggtgccagcaggcagccctgggctgggggtaggggactccctacaggcacgcagccctgagacctcagagggccaccccttgagggtggccaggcccccagtggccaacctgagtgctgcctctgccaccagccctgctggcccctggttccgctggccccccagatgcctggctgagacacgccagtggcctcagctgcccacacctcttcccggcccctgaagttggcactgcagcagacagctccctgggcaccaggcagctaacagacacagccgccagcccaaacagcagcggcatgggcagcgccagcccgggtctgagcagcgtatcccccagccacctcctgctgccccccgacacggtgtcgcggacaggcttggagaaggcggcagcgggggcagtgggtctcgagagacgggactggagtcccagtccacccgccacgcccgagcagggcctgtccgccttctacctctcctactttgacatgctgtaccctgaggacagcagctgggcagccaaggcccctggggccagcagtcgggaggagccacctgaggagcctgagcagtgcccggtcattgacagccaagccccagcgggcagcctggacttggtgcccggcgggctgaccttggaggagcactcgctggagcaggtgcagtccatggtggtgggcgaagtgctcaaggacatcgagacggcctgcaagctgctcaacatcaccgcaggtgagccctctccatgtgcctgcttccgtaagatgggtcacaggcaaggctgaggtcgctggggtgggtcggggcactgctggatggactctggccacctctggcccagcctcgggcagctttggggatgctggcacttctacacacagtcagctgtgagcctgggccaggaaggtttctgtccacctctagtgtcccaaccatgccagcctagggtccccactggtaggtgctggatgatatgaattcaagctctgtgtcccccacctcctcttggacttcgctctcccctcattcactctgctcccgccacactggcctgtttgctgttcccacaacatttgctacgctgctgcttcttcagcctagagcgctcttcccccaaatatctgtgtgactcacttccttcaggtcttggctcagatggcaccatccgcatgaggccttccctgacccctccattaaaattgctgcccatgagcacaggacatggtaaagaaaacaaacaaaaaaatgaaaaataaaagaaagaagaaaaatttctgctcacatc

SEQ ID NO: 729470 - DNA, 511 bp, Homo sapiens; identical to SEQ ID NO: 405631
  misc_feature (41)..(41): n is a, c, g, or t

SEQ ID NO: 729471 - DNA, 675 bp, Homo sapiens
  misc_feature (41)..(41): n is a, c, g, or t
  misc_feature (524)..(524): n is a, c, g, or t
  misc_feature (527)..(527): n is a, c, g, or t
ctactactactactaaattcgcggccctcgacttttttttntcagttctctagtatctttattatccattccgggcctctctcctgcctgccctgcctcagccaggccctgagatgggggaaaacgggcagtctgctctgctgctctgaccttccagagcccaaggtcagggaggggcaaccaactgccccagggggatatgggtcctctggggccttcgggaccctggggcaggggtgcttcctcctcaggcccagctgctcccctggaggacagagggagacagggctgctccccaacacctgcctctgaccccagcatttccagagcagagcctacagaagggcagtgactcgacaaaggccacaggcagtccaggcctctctctgctccatccccctgcctcccattctgcaccacacctggcatggtgcagggagacatctgcacccctgagttgggcagccaggagtgcccccgggaatggataataaagatactagagaactgaaaaaaaaaaaaanaanaaaacaaatacacaacaagggggggcgcaaaaaaactcccgagggggcccagattaacggacacagctttttcacaagggcccaagagggggatatacagagaagcgccgcggtaaaacggcgggggaaacgggcgggcttgtgaaga

SEQ ID NO: 729472 - DNA, 1824 bp, Homo sapiens
  misc_feature (41)..(41): n is a, c, g, or t
  misc_feature (1673)..(1673): n is a, c, g, or t
  misc_feature (1676)..(1676): n is a, c, g, or t
ctactactactactaaattcgcggccctcgacttttttttntcagttctctagtatctttattatccattccctcagctgcccacacctcttcccggcccctgaagttggcactgcagcagacagctccctgggcaccaggcagctaacagacacagccgccagcccaaacagcagcggcatgggcagcgccagcccgggtctgagcagcgtatcccccagccacctcctgctgccccccgacacggtgtcgcggacaggcttggagaaggcggcagcgggggcagtgggtctcgagagacgggactggagtcccagtccacccgccacgcccgagcagggcctgtccgccttctacctctcctactttgacatgctgtaccctgaggacagcagctgggcagccaaggcccctggggccagcagtcgggaggagccacctgaggagcctgagcagtgcccggtcattgacagccaagccccagcgggcagcctggacttggtgcccggcgggctgaccttggaggagcactcgctggagcaggtgcagtccatggtggtgggcgaagtgctcaaggacatcgagacggcctgcaagctgctcaacatcaccgcagatcccatggactggagccccagcaatgtgcagaagtggctcctgtggacagagcaccaataccggctgccccccatgggcaaggccttccaggagctggcgggcaaggagctgtgcgccatgtcggaggagcagttccgccagcgctcgcccctgggtggggatgtgctgcacgcccacctggacatctggaagtcagcggcctggatgaaagagcggacttcacctggggcgattcactactgtgcctcgaccagtgaggagagctggaccgacagcgaggtggactcatcatgctccgggcagcccatccacctgtggcagttcctcaaggagttgctactcaagccccacagctatggccgcttcattaggtggctcaacaaggagaagggcatcttcaaaattgaggactcagcccaggtggcccggctgtggggcatccgcaagaaccgtcccgccatgaactacgacaagctgagccgctccatccgccagtattacaagaagggcatcatccggaagccagacatctcccagcgcctcgtctaccagttcgtgcaccccatctgagtgcctggcccagggcctgaaacccgccctcaggggcctctctcctgcctgccctgcctcagccaggccctgagatgggggaaaacgggcagtctgctctgctgctctgaccttccagagcccaaggtcagggaggggcaaccaactgccccagggggatatgggtcctctggggccttcgggaccctggggcaggggtgcttcctcctcaggcccagctgctcccctggaggacagagggagacagggctgctccccaacacctgcctctgaccccagcatttccagagcagagcctacagaagggcagtgactcgacaaaggccacaggcagtccaggcctctctctgctccatccccctgcctcccattctgcaccacacctggcatggtgcagggagacatctgcacccctgagttgggcagccaggagtgcccccgggaatggataataaagatactagagaactgaaaaaaaaaaaaanaanaaaacaaatacacaacaagggggggcgcaaaaaaactcccgagggggcccagattaacggacacagctttttcacaagggcccaagagggggatatacagagaagcgccgcggtaaaacggcgggggaaacgggcgggcttgtgaaga

SEQ ID NO: 729473 - DNA, 1660 bp, Homo sapiens; identical to SEQ ID NO: 405630
  misc_feature (41)..(41): n is a, c, g, or t

SEQ ID NO: 729474 - DNA, 1169 bp, Homo sapiens
  misc_feature (41)..(41): n is a, c, g, or t
ctactactactactaaattcgcggccctcgacttttttttntcagttctctagtatctttattatccattccctcagctgcccacacctcttcccggcccctgaagttggcactgcagcagacagctccctgggcaccaggcagctaacagacacagccgccagcccaaacagcagcggcatgggcagcgccagcccgggtctgagcagcgtatcccccagccacctcctgctgccccccgacacggtgtcgcggacaggcttggagaaggcggcagcgggggcagtgggtctcgagagacgggactggagtcccagtccacccgccacgcccgagcagggcctgtccgccttctacctctcctactttgacatgctgtaccctgaggacagcagctgggcagccaaggcccctggggccagcagtcgggaggagccacctgaggagcctgagcagtgcccggtcattgacagccaagccccagcgggcagcctggacttggtgcccggcgggctgaccttggaggagcactcgctggagcaggtgcagtccatggtggtgggcgaagtgctcaaggacatcgagacggcctgcaagctgctcaacatcaccgcaggtgagccctctccatgtgcctgcttccgtaagatgggtcacaggcaaggctgaggtcgctggggtgggtcggggcactgctggatggactctggccacctctggcccagcctcgggcagctttggggatgctggcacttctacacacagtcagctgtgagcctgggccaggaaggtttctgtccacctctagtgtcccaaccatgccagcctagggtccccactggtaggtgctggatgatatgaattcaagctctgtgtcccccacctcctcttggacttcgctctcccctcattcactctgctcccgccacactggcctgtttgctgttcccacaacatttgctacgctgctgcttcttcagcctagagcgctcttcccccaaatatctgtgtgactcacttccttcaggtcttggctcagatggcaccatccgcatgaggccttccctgacccctccattaaaattgctgcccatgagcacaggacatggtaaagaaaacaaacaaaaaaatgaaaaataaaagaaagaagaaaaatttctgctcacatc

SEQ ID NO: 729475 - DNA, 469 bp, Homo sapiens
actaatctctagcctgaactccactgttacctctcagctacttcatttattcattctttcaacaaatagctatccagcctctcccctccctttccaagttcaggacaccagcctcaacactgaagatacagcagtgaacaagcaaagccccttctctcatttactctgcatccttttcagaagaggtagacaataaagagatacagaaataatatgtcatgtggtggcaaatgctaggaagaaataacaaaacaagaaaagggaaagagaatggttggctaaggaggcagcatctctggtaaagtaacatttaagcaaagaatcaaatgaaacaaaggggccagtcgggggaaattggtgttagactggtaaactcagagatggaaacaggtgttgtcctgcagcatcactgaggcagtgtggcaggagtggaacaggattggaaactcgagagacagaagaaatttga

SEQ ID NO: 729476 - DNA, 1441 bp, Homo sapiens; identical to SEQ ID NO: 542585

SEQ ID NO: 729477 - DNA, 780 bp, Homo sapiens
ctactcatgctgctgttgctcccatgggcccccattgagagcagcctcttgtccttacagaccttggaaactggaagaaggggcatagaggttccccatgagtttacgttatctgttaggatgaacactggcactggaagcgtgatgccatgtggtttaacagaaatgccatctctctaatggtgaatttagttacaggtggtcctctagttgcagagtattaactgtgttcctacagttttttaaaaaaaatcttgaacagatccaaattggcacttttgctctttttagcgattttaactgtggagaaaatgggttaattttgtgattctgttgcagagcttcagccacaagtgtgctccatggaggatgatgaatatttcattttctgtatatacccaagtccccactgtatgcttagggatccccccagttattacttaacatcttttattttcttcattcaaacatagcttctaaccaaaccatcataaattcattttcgtttcttgatctctgcgtgtgttttttcaagagttcccaaaagtcctcactagcaggttgttaaggatctttctctgtgtcagtgttatgttaactgatgactgtaggaataaatgtgtgcgccgggattttattagctgctatttgcagcatcttttttatatcagctctgtgggagcgtatgtgtgtatatgtgtgtgtgtttgctctccatggttgttgcttcaactaggcaatttgacatttcaagaaaacaagaggcccatcctagtatga

SEQ ID NO: 729478 - DNA, 621 bp, Homo sapiens; identical to SEQ ID NO: 596769

SEQ ID NO: 729479 - DNA, 521 bp, Homo sapiens
ggtacctgtctataaggagtcctgcttatcacaatgaatgttctcctgggcagcgttgtgatcttggccaccttcgtgactttatgcaatgcttcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctccttctggcctctaatagtcaatgattgtgtagccatgcctatcagtaaaaagatttttgagcaaacactagaacctaaagcaagagcaaaggcgagat

SEQ ID NO: 729480 - DNA, 879 bp, Homo sapiens
ggtacctgtctataaggagtcctgcttatcacaatgaatgttctcctgggcagcgttgtgatcttggccaccttcgtgactttatgcaatgcttcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcaccctgtaagtctcaagccagtgctggccaagagggggacatagctgtcctctgaggaacagctactccctctgtgcaaaattccaatcttcaggggttaagtacggttcagttttcatagactttataatagagtagtttcagattcacagcaaaaactgagcagaggtaccagaaatttcccatgtgcctcctgccctcaaacatgcagactccctgttatcaacatcgtcccaccacaggggggtattctgtatgactgatgaactacctgtgcacatcattatcacctgggtccatagttcatgtagggcttcctcttggtgtgtggaatgggggtaagttcaggacctatttctttcttttaacacatgtgggcagtcacaatggtcagctgtaattccagcattgggggcgaggggggaccaggaggcgggacgaagcctcctaggaaagtggaaccggttctctaaaacaaaagaaaaaaaatgtggggcccgccgagaagttaaacctgggggggcgccaagaaaagaaagagcagagcaagaccggcagacaggggtcccaaaagccgggggtgacagcagctggttgtcgagaacacgcgcgacgcgaaacacacacgagccagcg

SEQ ID NO: 729481 - DNA, 518 bp, Homo sapiens
atggcggcccagccgtgttccagagctccctgtcgggtgccctcgcccgctttatataaattcgtctgattcactttgcattagaaagtaacagtgtttgtttgtacaaaagagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctccttctggcctctaatagtcaatgattgtgtagccatgcctatcagtaaaaagatttttgagcaaacactagaacctaaagcaagagcaaaggcgagat

SEQ ID NO: 729482 - DNA, 827 bp, Homo sapiens; identical to SEQ ID NO: 541266

SEQ ID NO: 729483 - DNA, 1861 bp, Homo sapiens
gatctcggctcactgcaagctccgcctcccgggttcatgccattctcctgcctcagcctcccgagtagctggtactacaggcgcctgccaccacgcctggctaatttttttgtattttcagtagagatggagtttcactgtgttagccaggacggtctcgatctcctgacctcgtgatcctcctgtctcggcctcccaaagtgctgggattacaggtgtgagccaccgtgcccggcctcttaagactaccttagaaagtagattgcaaaaaaactttaaacatgtatgtatttaaaaatttaataacaaaaccccccaaattctgtcatgatcttgatcattagaaagatttatgtaattggagaatttcagaaatatcttggtggcagaactagatgccttttgaggttcaatttaattctaacatcccgttaaaatttaatgtacaatatgtagagaaggacagcaactacacactgtacaccctaagactgatttttaaaaaagcaacatcaacttcaacatccaagtatcctatactttacacagtgcctggtatgtaatagttgcttaatgtttgctgaatgacagtgtgatcaaaggagtgttgttacatctgtcactctgaggtccttctggtgatgttgccatatcttataacatcaacaaatgttttcttaaaaatgaaattttcaggtgcattggctcacacctgtaatcccaacattttgggaggctgaagtgggagaattgcttgaggccaagagttcgacaccagcctgggcaacacagtgagacaccatctctaccaaaaaaattaaaaaattagctagtcatggtggtgtgtgcctttagtcctagctattcccaggagtttgaggttgcagggagtatgattgtgccactgcactccagcctgggtggcagagcaagactcggtctctatttttaaaaaaagaaagaaagaaaaatttgccttcactgccagttctacattgtggaggatactttgttttggcccctagagggagcgctagcctcctctataaatctcatcctcagcactctcctccagggttttcttacgctacattaaaagagaattgagaagaaactgttaaggtcaaaaacgtttcatgggcatgtttgtaggagcgtggatcaatccagtgagtgtggatcactgaaatcaatatgttgaatggatatctgtgctctcacgttcattacaacattcttcagaatcccaaatatacaatcaacctgtgttcatcaacagagatggatgaagaaaatgtggtatatatgaacaatagaatactattccacctaaacagggagaaattctgtcatttgtgataacgtggataaatctggaggacattatgctaagtgaaataagccaggtacagaaagacaaatacctcatgacctcacttatatgtggaatctaaaaaagtcaaactcacaaaagtagaaactagaatgctgattaccagaggctagggaggtggagaaggaggaaattgggagatgttgatcacaaaatacaaagtttgaacaaaaaaaaaaaaaaagaaaaaatacaaaatttcgacagacaggaggaataggttttgagatctattgcactattgattatagtcaataataatgtattctatatttcaaaataactgagtaaatttcaaatgtatcaccataaaaatgataggtaagtgaggtgatggatatgttatttggcatgatttatcattccacaaaatgtacatatattgaaacatcgcattgtatcccataactgtatgtaattatgatatgtcaatgaaaaataatattactaataaaaattttaattttc

SEQ ID NO: 729484 - DNA, 539 bp, Homo sapiens
gctaattttgtatttttagtagagatggggtttctctgttttgatcagggtgtctcgaactcccgacctcaggtgatccactcgcctcggcctcccaaagtgctgggattacaggcgtgagccaccgtgcctggcctgcttgttgttttcatctcatcctgatttccaaatacaggagagaagctgaattggtgttcactaacaagcacaggagctttgttatatttacagtgtcattcttggcaaaacctgaagggtgtgttcgtggggtgatgaggttcagtcacctgtgatctgtgcatctggccagcactgtggtgacatccttaggaatccatggggagagagaaagcattcaggagttagtgggtcacgtttgacaagggccaataaagaaatatgcaaagacaaaaaacaagaagaacattgtcatattttctaccttttgtttatataaatttatatcaatgattttagcttatgttaatatgcaatgtatataatatgctaacatttacaatatatgtttatagtttaaa

SEQ ID NO: 729485 - DNA, 1749 bp, Homo sapiens; identical to SEQ ID NO: 28218

SEQ ID NO: 729486 - DNA, 704 bp, Homo sapiens
tcattggcgtcatctcacaaggccctgagctggcaggaaattgaggtctcaaggggaaaagccacctgcccccagtgacaaccaggaagtgcaagactctgacccaacgcccatgcctgccatccccaaacatgggctcaaaacccccttcccagggacggctgtgtccacccctcagcaggaggaggagaccccacagcaccgggtgagaggtcagtgctgaagccagggaggcagctctcagcagggcacctgtgtggagccagggaagccagggccacacttgcagggtgaagtggggaactcggaaggctgggcagtggagcaaaatgcttggtgccctgcgggaaccggtggccaaggctacactgggatgaagggagccgtggagctgcagaatctgcgggtggccctcagtggcaggcagccaggccaacaggggctttgggctgcaggtcagcccctcccctgctctggaacttttggagggccattacaaaggacatcagccccaagatactcctctgaaattctgcctgaaaggcccttcacattccctaattggcacttacaacattccagaacattctatggtaccttaagtttctcctccccctccaaagggcccttgaaccttaaggatagggcagaaggggctcctcaccctggcctcgagggcttaagatccagctgaggactcctag

SEQ ID NO: 729487 - DNA, 390 bp, Homo sapiens
ccctctgcacccccgtttcctcccctgtaaggtgggaataatagcgtatgtctctaggattaagtgagccagtcatgcatgggccgagaaccaggtttggcatattgtagctgctcagtggacgttagctgttatgattggaccacaacgtgcttccgtttcaattctgtgggccttttggaggtcctgctggatgctaagcaccgaaacctcaacccggaacaagaccagaacaacctgagcaacaacaggaccagcgatggctctccctgctggaggattctggaagtcacctggctggaccaagccctctccgtgttctctgtcagcccactccccagagccgctaggcctgatgtgcacaagcagactaataaaggcttgaggaca

SEQ ID NO: 729488 - DNA, 472 bp, Homo sapiens
tcattggcgtcatctcacaaggccctgagctggcaggaaattgaggtctcaaggggaaaagccacctgcccccagtgacaaccaggaagtgcaagactctgacccaacgcccatgcctgccatccccaaacatgggctcaaaacccccttcccagggacggctgtgtccacccctcagcaggaggaggagaccccacagcaccgggtgagaggtcagtgctgaagccagggaggcagctctcagcagggcacctgtgtggagccagggaagccagggccacacttgcagggtgaagtggggaactcggaaggctgggcagtggacaacaacaggaccagcgatggctctccctgctggaggattctggaagtcacctggctggaccaagccctctccgtgttctctgtcagcccactccccagagccgctaggcctgatgtgcacaagcagactaataaaggcttgaggaca

SEQ ID NO: 729489 - DNA, 387 bp, Homo sapiens
cccgtccttcctctcctagcctaaggcgtgcaaacagagcgccactgggaggctgaaacctttaggccgatgcttgcttgcaaggtcaggcaagctggattctggtccccacctttgcagagagaacagcgatgttgtgcgcccatttctcagatcaaggaccggcccatcttactacctccaagagtgcttttctctctaataagaaaacatctactttgaaacatctactgggcgagaccaggagtgatggctcagcctgtaattctggaatttcgggaggccgaggcaggaagattccttgagcacaggagttccagaccagcctgggcaatgtagcaagacgctgtctctatttatacaataaaatttttttaaaaaaggaaa

SEQ ID NO: 729490 - DNA, 1076 bp, Homo sapiens; identical to SEQ ID NO: 728382

SEQ ID NO: 729491 - DNA, 608 bp, Homo sapiens
aggatgtcgccactcagaaggccgagacccagcggtcttcaatagaagtccgggaggccgggacgcagcgttcggtggaggtccgggaggccgggacccagcgttcggtggaagtccaggaggtcgggacacagggttctccggtggaggtgcaggaggccgggacccagcagtctctccaggctgccaacaagtcggggacccagcgatcccccgaagctgccagcaaggcagtgacccagcggtttcgcgaggatgcccgggacccagttactagattatgaaggcatctcaggccctggagccagagccagtcaggggttaaagtgaaagcccgtatttccgcccagaagctggggttggggagaggatgtggattttttgttttaccctttctgttgcatggttgcaaacacaaacttgagttctaataaagaattgcaaagtggaagcccgccccccgcctcccccccgcctcacttaagtccaggaagctggggtggcgaggaaggatgatgtggattgtttttgttttacaccttctgttgaatggttgccaacacaaacttgagttctaataaataattgcatttccctaaaaaaagtat

SEQ ID NO: 729492 - DNA, 659 bp, Homo sapiens
cttgagtgaattatataactatttaatagaaataataaaacatcgatacaaatataaaagacataatcagtataaaaggcttatatttataaaaatactttaggtaacagttttcccctgagggttgaccatgcgtgttgcatccataaatattgctcggctctgtagctcactctccaaagttcagagttcatctttaaaggaagtggtgctggccccggtcgtgtgacctggccgaagtggctgcctcaggctggcacctgggcttgatagaatgaagaagagaacagcatcagtggggcctccgaaaaatctggagaagatttttttcttccaaatatggaagatacaaagaccaaggatgacaggctagtgatcaggtcatgtgactggtgtggcagctcactggtttttctggacccagtcccaactgtcttcattctctttccggttcttctcagcttcgataatttctttgtaccttcggcgaaagaagcccatctgaaaggcagaaagaaagagaagctgagttagaagtgctgaagaatcagccattgtgaccccaaggcagtctgtccctgggtaggtgtgacctgcactcacagggctggggaggcttggaggacccctcggattagagaaaacactggcaagaaaaa

SEQ ID NO: 729493 - DNA, 285 bp, Homo sapiens
gaagagaagcatgaggttacatctgtaatctccctgcagcagagtcaactgcataagaaaccaaaagacacacctgctccatgccagcttcgataatttctttgtaccttcggcgaaagaagcccatctgaaaggcagaaagaaagagaagctgagttagaagtgctgaagaatcagccattgtgaccccaaggcagtctgtccctgggtaggtgtgacctgcactcacagggctggggaggcttggaggacccctcggattagagaaaacactggcaagaaaaa

SEQ ID NO: 729494 - DNA, 1475 bp, Homo sapiens
ggcacgaggcctcgtgccgcccagcagcccgtgggcaggcgcggcggagcgagcggggccggcggcgggcgccgagggacgccgagggacgccgaggcctcgggcgggggctggcccggggttccagatgttggatgtgatccttaaacaaagcaaagatgtctgccgtcgttgaaagttgtttctaaaaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcgcatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgcttctaccacttcttcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccagtaggagagcttcgggagtgggtgcccagggttaggtgtgggaggcatggggcaggaccatcagtaaagacagggccaggtgcagtggctcctgcctgtaaccccagtgctgtgggaggccaaggtggtaggatcgcttgaacccaggagttcaagtccagcctggacaacgtagggagacccttgtctctacaaaaaataaaaaaattagccaggt

SEQ ID NO: 729495 - DNA, 1411 bp, Homo sapiens
ggcacgaggcctcgtgccgcccagcagcccgtgggcaggcgcggcggagcgagcggggccggcggcgggcgccgagggacgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcgcatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgcttctaccacttcttcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccagtaggagagcttcgggagtgggtgcccagggttaggtgtgggaggcatggggcaggaccatcagtaaagacagggccaggtgcagtggctcctgcctgtaaccccagtgctgtgggaggccaaggtggtaggatcgcttgaacccaggagttcaagtccagcctggacaacgtagggagacccttgtctctacaaaaaataaaaaaattagccaggt

SEQ ID NO: 729496 - DNA, 616 bp, Homo sapiens
caactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccacctttgacgacccctatgccctggtggtgctggctgaggaggagctggtggtgattgacctgcagacagcaggctggccaccggtccagctgccctacctggcttctctgcactgttccgccatcacctgctctcaccacgtctccaacatcccgctgaagctgtgggagcggatcattgccgccggcagccggcagaacgcacacttctccaccatggagtggccaattgatggtggcaccagcctgaccccagccccaccccagagggacc

SEQ ID NO: 729497 - DNA, 1245 bp, Homo sapiens
ggcacgaggcctcgtgccgcccagcagcccgtgggcaggcgcggcggagcgagcggggccggcggcgggcgccgagggacgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcgcatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgcttctaccacttcttcagcagccagcaactggagaacatctggtggcagcgggacggccgcctgctcgtcagctgtcactctgacggcagctaggggaccgccactgcatctcagtgatccacgatggccagcagacggccttcgacttcacctcccgtgtcatcggcttcactgtcctcacagaggcagaccctgcagccagtaggagagcttcgggagtgggtgcccagggttaggtgtgggaggcatggggcaggaccatcagtaaagacagggccaggtgcagtggctcctgcctgtaaccccagtgctgtgggaggccaaggtggtaggatcgcttgaacccaggagttcaagtccagcctggacaacgtagggagacccttgtctctacaaaaaataaaaaaattagccaggt

SEQ ID NO: 729498 - DNA, 685 bp, Homo sapiens
cgggggtctcagcctggttcttccttgttcctcgtcctctgaggtagcaactgcctcatcttttccatctatggagtgtggaatatgtgccctacttcattcaggaatgttggacaaaccagctatttagagagtgaaggagaggaacttccgagagcaaccggcccccaagagaaacccagggactcctgcccttcggcagctttgtccatgtgctgctcacaccaaaaagcactcgagggtgacctgcaccaaaaatgcattgccgtagtctgggcacagtggatcacgcctgtaatcccagctctttgggaggccaagagaagttagaacacttgaaattagctaagcgagaatgccatcagcagtgcatcgatctcagctgcatccaggtgtatcagttgaatggcagagggactagaaattacatttcacgaagaaaatttacagaactaaagatatttaggctgcaaaagaaaagactaaggcactgtgctaagttggacttacagagatgaataagatttggccacatcttcaaggagctcagaccttcatggacataccaaatatatacagaactaactctactgcttatcataatgagagctgtgctatggatatttgaaagttagagagatttattttcaacagaataataaagtcaactttcacaaactggtga

SEQ ID NO: 729499 - DNA, 870 bp, Homo sapiens
gccaggacttctgcacctgaaccttttcctcccccttaaaaaatgagtcagtccagtacataaaccaatcgacttaaaatttacatagttactaaaaagatctgagaatgtttagacttgtattagtttttaagtgaagttggtttctcatttcttaaaacagtccagagacttgaggcaataaatgactctcagcttctcctattcatgagtccatcttgtcacacttatctcatgagaaaaaaactagaaagaggcagaaatgagaaaaaatgacttcctcgggcaattcgaaggcagaaaagttgtttgagaattatcctcattatcttcctgaccacctcacataccctgtaggtggaaagatttaattcttcactacttcttagactgatgggactgaagtgtaatgtttcttgttcaaagtcatagttcactggatgtttttcaaacaggaatgttggacaaaccagctatttagagagtgaaggagaggaacttccgagagcaaccggcccccaagagaaacccagggactcctgcccttcggcagctttgtccatgtgctgctcacaccaaaaagcactcgagggtgacctgcaccaaaaatgcattgccgtagtctgggcacagtggatcacgcctgtaatcccagctctttgggaggccaaggcactgtgctaagttggacttacagagatgaataagatttggccacatcttcaaggagctcagaccttcatggacataccaaatatatacagaactaactctactgcttatcataatgagagctgtgctatggatatttgaaagttagagagatttattttcaacagaataataaagtcaactttcacaaactggtga

SEQ ID NO: 729500 - DNA, 1036 bp, Homo sapiens
gccaggacttctgcacctgaaccttttcctcccccttaaaaaatgagtcagtccagtacataaaccaatcgacttaaaatttacatagttactaaaaagatctgagaatgtttagacttgtattagtttttaagtgaagttggtttctcatttcttaaaacagtccagagacttgaggcaataaatgactctcagcttctcctattcatgagtccatcttgtcacacttatctcatgagaaaaaaactagaaagaggcagaaatgagaaaaaatgacttcctcgggcaattcgaaggcagaaaagttgtttgagaattatcctcattatcttcctgaccacctcacataccctgtaggtggaaagatttaattcttcactacttcttagactgatgggactgaagtgtaatgtttcttgttcaaagtcatagttcactggatgtttttcaaacaggaatgttggacaaaccagctatttagagagtgaaggagaggaacttccgagagcaaccggcccccaagagaaacccagggactcctgcccttcggcagctttgtccatgtgctgctcacaccaaaaagcactcgagggtgacctgcaccaaaaatgcattgccgtagtctgggcacagtggatcacgcctgtaatcccagctctttgggaggccaagagaagttagaacacttgaaattagctaagcgagaatgccatcagcagtgcatcgatctcagctgcatccaggtgtatcagttgaatggcagagggactagaaattacatttcacgaagaaaatttacagaactaaagatatttaggctgcaaaagaaaagactaaggcactgtgctaagttggacttacagagatgaataagatttggccacatcttcaaggagctcagaccttcatggacataccaaatatatacagaactaactctactgcttatcataatgagagctgtgctatggatatttgaaagttagagagatttattttcaacagaataataaagtcaactttcacaaactggtga

SEQ ID NO: 729501 - DNA, 734 bp, Homo sapiens; identical to SEQ ID NO: 4385

SEQ ID NO: 729502 - DNA, 429 bp, Homo sapiens
gagcaggtgtacagagagggactactatcatataggctgtcaatatttaactcccgggacagtacctcaataaaagtccttaaattaataactcttgggggcagaagaaagatcctgagatctgctttattctccttgtgttcttccgcagagctttaatcacatactaaaggatcacttaatacttaagtaaatacttgaatcaatgacacctggaggcacattcccaactctacactcttttccaagtccaattccaacttttcagtcagcatgcttaaatgagtctgccagagtatcccactactatctaaacttctgagtatctagaacttccctgatacttttccgctgtcaatattcttcttgccttttccatttacgtttagaccctcattctcccagtaacccaaatttgaaacctcaggg

SEQ ID NO: 729503 - DNA, 522 bp, Homo sapiens
cacctgtaatcctagcactttgggaggctgaggtggaaggatcacctgaagtcaggagttcgagaccagcctgaccaacatgacgaaaccccgtctctactgaaaataccaaaattagccgggcatggcagcgcacacctatagttccagctattcaggagactgaggcaagagaattgcttgaacccaggaggcggaggttgcaatgagccgagatctcaccactgcactccagcctgggcgacagagcaagacctcatctcaaaaaattaatttatcaatttaattaaataaaaaaaaaaaactttatcccttccttacctccccagagtcataggaaaagagatcacagggcatgtgtgctccagtcagacactgggaatgggaagggaatggaggccactctgagaccaagctcacaacagggtagagctgaaaggggaagcactctaggccttcttgaatagaagtgcttcccagttgagagcacaccagtcccattggcaaggctccctaaataga

SEQ ID NO: 729504 - DNA, 991 bp, Homo sapiens
gcctctacaactgctggcacccgaataatcctaacaaaggaatttaagtagctgacactgtgataagagcatcctgtgaactacccaaataaggaggaaaacgaacgcagctgagcatgggatgccatataaaaatcacttaaaccagtcgccactccttgtttcctgagttgtcctgtgctggaggtctgctcagacgaaggtctccatggcgttagaagtcttgatgctcctcgctgtcttgatttggaccggtgctgagaacctccatgtgaaaataagttgctctctggactggttgatggtctcagttatcccagttgcagaaagcagaaatctgtatatatttgcggatgaattacatctgggaatgggctgccctgcaaatcggatacatacatatgtatatgagtttatatatcttgttcgtgattgtggcatcaggacaagggtagtttctgaggaaactctcctttttcaaaccgagctgtactttaccccaaggaatatagatcatgaccctcaggaaatccatttggagtgttccacctctaggaaatcagtgtggcttacaccagtttctactgagaatgaaataaaattggatcctagtccttttattgctgactttcagacaacagcagaagagttaggattattatcttctagtccaaacttgctctgagctaaaggagaaatggaaacttgaagctggtgttatgtattttgcaggaaaacagtttcattttttcatagcaaaaatatagttggtgtatatctctccttaagtctctggtttctaaaaaccctacttcagtaaaggtcctgattagttgattagtgaatgtgtatttctaaatatttgtattcagtaggggtatggctgattaatttaacattaactattaggtaattcatattatacatttaagttctttctgttctgtgtagaagattcagaaatatgtcttcaaagacaatgacttgatct

SEQ ID NO: 729505 - DNA, 492 bp, Homo sapiens
gtagctgacactgtgataagagcatcctgtgaactacccaaataaggaggaaaacgaacgcagctgagcatgggatgccatataaaaatcacttaaaccagtcgccactccttgtttcctgagttgtcctgtgctggaggtctgctcagacgaaggtctccatggcgttagaagtcttgatgctcctcgctgtcttgatttggaccggtgctgagaacctccatgtgaaaataagttgctctctggactggttgatggtctcagttatcccagttgcagaaagcagaaatctgtatatatttgcggatgaattacatctgggaatgggctgccctgcaaatcggatacatacatatgtatatgagtttatatatcttgttcgtgattgtggcatcaggacaagggtaagaacagtgattgtttgtaaaaaatactgcatgttttgtcagacttttatgcctagtattaaaattgtcttttaaaaaaataatg

SEQ ID NO: 729506 - DNA, 686 bp, Homo sapiens
gtagctgacactgtgataagagcatcctgtgaactacccaaataaggaggaaaacgaacgcagctgagcatgggatgccatataaaaatcacttaaaccagtcgccactccttgtttcctgagttgtcctgtgctggaggtctgctcagacgaaggtctccatggcgttagaagtcttgatgctcctcgctgtcttgatttggaccggtgctgagaacctccatgtgaaaataagttgctctctggactggttgatggtctcagttatcccagttgcagaaagcagaaatctgtatatatttgcggatgaattacatctgggaatgggctgccctgcaaatcggatacatacatatgtatatgagtttatatatcttgttcgtgattgtggcatcaggacaagggtagtttctgaggaaactctcctttttcaaaccgagctgtactttaccccaaggaatatagatcatgaccctcaggaaatccatttggagtgttccacctctagtgtttgatgcagaaatcatggggagactatctggaattagttcttctgtaagcctatctgctcaaatcctgtaccaagagtccacgaggatctagaaggcgtagtatgctggctctatgccatactcctgaatgactattctgtatatgatcatgatattaaacagtggtaaaactga

SEQ ID NO: 729507 - DNA, 472 bp, Homo sapiens
agaagttatgatatttgctgttttttgaataaaagaatttgactctctttaaaccctaaagcttgaaatttagcatttatctcacatgagacaaatgtttaggaactcatgtttaggaactcatgttcctgcctgaggcaggaactgaaacaccagatcacttgcatcgagaccgtgagactccctatgtttcatccatcatgattgcgtccttatccctccctgatttcctgttttctcgcccttctcgctacataagccccccaattttggtcggggagacggatttgtgatttcatctcctccctcatgaatactcatagaatttttccaaacctactgaatctgtatgtaaggttgactctgtaaggcatatatatattccagctccccttcactgccacagagcgctcattccatcctgggattacttctccctctgaaaataaagtctttgttacttcctgaaaaa

SEQ ID NO: 729508 - DNA, 612 bp, Homo sapiens
  misc_feature (555)..(555): n is a, c, g, or t
actccctttctgggggcaactcctataaacagatttagcctaagactcgcgtgttgaaattgacttgccccattcctgccagttaagaggattagcgatacaggtggtgaaaaagaaacgatgacacccctaagacctgagccccttctgggccccacactccacctgtagaactctgatggggccttgtgcggccgaaccacaatccaagagaggtgttcacatcatgtgtcgctagccacagccatctcaaggggaaatgccccaaatgtagaagtatctgacaccaggactgggggttggagcactggatgaacagcgtgtgtgccactctttcactgtgcaccgtcctaagaaagaagcctgtttccctttgaagagcctagtgctgactgcccaattcaatcggaccacgcagggcagtctgaggattaaaagatgctacctttaattccttcggctaattcagaagtatgtgaaacacaacatactcattaacatggaagaactggatgtgtgtgcatgtgggtgtgtattatttatttttcagagacnagtttcaccatgtgcccagctggtctgactcctgggctcaaccgtgatcctcccacc

SEQ ID NO: 729509 - DNA, 931 bp, Homo sapiens
  misc_feature (874)..(874): n is a, c, g, or t
ggtggtgtgcctcggtgagtgactatggtagggccgtaggaacatgtgcgggcggtgggctggcagcgttaagccgggcggattctaggcgtggcgggtatgcagaccggtggtacggtcgttgaggaagagccggctgtgttgttgttcacggcggaattcggccggttggcgattacggtttggatccatggtgctgggcccatgtaaggctttcttagacaagtgaggcggcatgtgggtgttcggacggagtatcgttagaattaagatgaaccaagttaagcaaagtgcagcttctgactcagtttttggaagacagatcactggttacccatggaagggaacagaagaaatgctttagaagagctgaggcagaaattggccatgcagagggctcctagaactggtgtcccatcaccatctctggttttgtcagatgacacccctaagacctgagccccttctgggccccacactccacctgtagaactctgatggggccttgtgcggccgaaccacaatccaagagaggtgttcacatcatgtgtcgctagccacagccatctcaaggggaaatgccccaaatgtagaagtatctgacaccaggactgggggttggagcactggatgaacagcgtgtgtgccactctttcactgtgcaccgtcctaagaaagaagcctgtttccctttgaagagcctagtgctgactgcccaattcaatcggaccacgcagggcagtctgaggattaaaagatgctacctttaattccttcggctaattcagaagtatgtgaaacacaacatactcattaacatggaagaactggatgtgtgtgcatgtgggtgtgtattatttatttttcagagacnagtttcaccatgtgcccagctggtctgactcctgggctcaaccgtgatcctcccacc

SEQ ID NO: 729510 - DNA, 476 bp, Homo sapiens
ccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaaggaaatatgaaac

SEQ ID NO: 729511 - DNA, 376 bp, Homo sapiens
ggattgcgcagaacagtttgtaacacgtggtaggaggaagtttaagggatcacaaatggggaagggatatccttttctcagcgggccccacaattgaaacatttcaaagtatggctcagagaaaatgcgttttaacatgagtttgtgtttctctaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaaggaaatatgaaa

SEQ ID NO: 729512 - DNA, 526 bp, Homo sapiens
tgaatgaccacaaggagatttgattatacatgtgaacacctcagaaggcacagcccacccagaaggcagacaggtcaggctgctttttcttcattgcttggattcaatcctccgggcggctcaggctcaaacataacttaagcatgattaaactttagaagaagctgccaggaagactgtgaaatcttcatgcccaaggatccctaaaattaggagcaacaaccacttggctcagacggtttatggaggcaaaggtttggatgggattagagatttctaaatgtgagttcgtgtcctctgccagaccaccttacttccaccattcctcagcaaatcaagaaaaacaggagaaaagacatgcctttccataagttaaatctattctgttttaattctatattatatctgctgtacaacttcttttgtttgtaacaccatattgttgctagtaactggaaattaattttcacatgcctcagcttagaaaaataaaaagcagccctgcatcaatcccaaaaaaaaaaaa

SEQ ID NO: 729513 - DNA, 667 bp, Homo sapiens
cggaaatctgggcagatttgggatctagagcagggaggtctcagggttgaggcctgaagtctagcacggcacacagcagggctgagagcagaatccagggtcatgtctgattcccaggccggttaccgcctctctgaccccagatgtctcacctgtcgaatgggtacatttgggaacagcacccactctacgaagccaccatgaggacgaaagagaagggtcactgagcaggtttttttcagctctgagcagctctcctttttcagctcttgccgcatctcggactgtcccaatgacagccgtagcaagaagagataagaaacaagacaagttcatgttgtccagttttgaggtcttgaaagaagttgcaccagtatgagaatagtggatcagttttctctaggatccagaaagcatatcaggcagccttggggtgaggaaaggagcccggcctctccagcagccacacaggcctgcagtaggatggggttggggctggccatgtggatcacttgggcctcatgaggggaaaggaaataccagggggcagaggaggagcatgggggcagctggttgcctaaggagaaggcacctcagggaaggggactgtattcgtttgttttcacactgctataaagaaatacctgagattgggtaatttaaaaag

SEQ ID NO: 729514 - DNA, 719 bp, Homo sapiens
atgctcccttgcaaataattatgtctcccacccccagaggatttaaatgacttggggctcacgctgcttgtgataatagacaaaactccagcgttcccacaagattaataatgttcccttttcttcttttctatgcctttccatcgttacaggagatgttgctgagatgggtgcattaaagtttaggctttccagagtttatattgctaacaacttgaaaggaaaaaagctaactagagaactgactggtcttatttgttttagattctgggctttactaagacttcctactctcagaatctctggactataaacgctgggtggggtgggagctgggaatgttattctggaaaattaatcacaaatgaaaagaaaatcaactctaagactccagttagaagatttttgaaaatggcagaacatgactggccttcattcaagtcagaatatttaaagcaatccttgctaagaagaacttgattttgtataagcagtcccttaaatacagttgcttctcaagaaaaccacacacaattgatgtttgaatggctttatttacaaacatctcactccgtaagcctctgcaggtatttctagcctcccaggggccactgtcccgtttcacctgtaatttggatcacaattctgtttgttgtcacacacatcatatgaactgcttttcatgctgcttttatccacaaagctttacaagctttaat

SEQ ID NO: 729515 - DNA, 673 bp, Homo sapiens
tctgctccctggacacagtagttctcaaactggacagtgtcaatcagcatcctccgggaggtctggggtggccccggaaatacatgtgtcccacctatcccagcaggagatgttgctgagatgggtgcattaaagtttaggctttccagagtttatattgctaacaacttgaaaggaaaaaagctaactagagaactgactggtcttatttgttttagattctgggctttactaagacttcctactctcagaatctctggactataaacgctgggtggggtgggagctgggaatgttattctggaaaattaatcacaaatgaaaagaaaatcaactctaagactccagttagaagatttttgaaaatggcagaacatgactggccttcattcaagtcagaatatttaaagcaatccttgctaagaagaacttgattttgtataagcagtcccttaaatacagttgcttctcaagaaaaccacacacaattgatgtttgaatggctttatttacaaacatctcactccgtaagcctctgcaggtatttctagcctcccaggggccactgtcccgtttcacctgtaatttggatcacaattctgtttgttgtcacacacatcatatgaactgcttttcatgctgcttttatccacaaagctttacaagctttaat

SEQ ID NO: 729516 - DNA, 628 bp, Homo sapiens
tagggagccctctgatggaagagctctccgcttaagaaggtcaccactcccttacactcaggagatgttgctgagatgggtgcattaaagtttaggctttccagagtttatattgctaacaacttgaaaggaaaaaagctaactagagaactgactggtcttatttgttttagattctgggctttactaagacttcctactctcagaatctctggactataaacgctgggtggggtgggagctgggaatgttattctggaaaattaatcacaaatgaaaagaaaatcaactctaagactccagttagaagatttttgaaaatggcagaacatgactggccttcattcaagtcagaatatttaaagcaatccttgctaagaagaacttgattttgtataagcagtcccttaaatacagttgcttctcaagaaaaccacacacaattgatgtttgaatggctttatttacaaacatctcactccgtaagcctctgcaggtatttctagcctcccaggggccactgtcccgtttcacctgtaatttggatcacaattctgtttgttgtcacacacatcatatgaactgcttttcatgctgcttttatccacaaagctttacaagctttaat

SEQ ID NO: 729517 - DNA, 291 bp, Homo sapiens; identical to SEQ ID NO: 9175

SEQ ID NO: 729518 - DNA, 331 bp, Homo sapiens; identical to SEQ ID NO: 9174

SEQ ID NO: 729519 - DNA, 579 bp, Homo sapiens
cagcaggccaagttaaccaatcaggttccatatcttcattagtgttatatgatccatatgacctccccttcctttcacatgggctggtctgacaatatttattggcacatgaacaagcctcagcatcacagtgacttgctgttcctggagaattgtgaagtacgctttgcttatcttcaaatacttccttctcactactcaaagtgtctgtgttctcactttccgagtcattttcagtatcttgagacccctccgacatttcctcttcagactggactccaagacatttaaatcgccacattgagactatacgtaacatggacctggaaaagcttaaaaatatgaagaggattgaactggctgccatctgtgcatcttcatttatgaaaacactcctcatagacttaaaacaaatgacagagaacaaattagtcagcttcttctaaaatacagtggtctccccttaccctcagtttcactttctgcagtcaactgcagtccgaaaatactacatacaattagatattcggagagagagacaccacatttacataaatgttatttcagtatactgttaaa

SEQ ID NO: 729520 - DNA, 524 bp, Homo sapiens
ttattttaccaaggagcaaaactgagtaagtttcctgacgaaaataatgagtgtctactgttctagggcctttaacaacaacaacaacaaatttacattaacgcacattatgtgccaggaattgcaagatgcataagattagtttttaaaatgtgcctgctagagctgaacaggtaacgagagttcgaagccgggtccagagctatcttctgtaacattcttctgggtcgagtccctgccccgctacgagactatacgtaacatggacctggaaaagcttaaaaatatgaagaggattgaactggctgccatctgtgcatcttcatttatgaaaacactcctcatagacttaaaacaaatgacagagaacaaattagtcagcttcttctaaaatacagtggtctccccttaccctcagtttcactttctgcagtcaactgcagtccgaaaatactacatacaattagatattcggagagagagacaccacatttacataaatgttatttcagtatactgttaaa

SEQ ID NO: 729521 - DNA, 3420 bp, Homo sapiens
atcgggccgcctccagagccagagtaggctcagagactgcagcgcagctgcgtggtggaagaggatttatggacagaaaaaataaagtgacatacacaaaacagaagatcccaaagaagcaggccctgggacaaggatttggaattggcttggagttaattgaagggagcaacagtacagaagtagcaaatttagataggaaagtgagagggacaataaagggtgcattgacagttaagtcagtgcttgtgagtgctgaggttcgaaacattaattccccagaacttctggctgcctgccctgaacacaggcagaacaggctccaccggccagagaaagccctcagcaaagaattacaggtgctggaagttggaagtgttttaaataggcaccaaaatggcaatctcttcccatgttgtggaaaagacgtcaggccagtagcagacagtgctaggttcaggcttccaatattcttacaccaactttcccagtgaaaagaaaaaaaagaagccactttttcaaccactcaaatgaaattccagggaggattctgttgccttggtatccctacacctcttataccaacatggccagagagatggggttctctgatagctagagactggctcatctaactaccctgagttgaatttctcacaaggaagaactgttcagttagcagaaggaaagtgaaagaaagtgtaaagggaagccagaaattttatcttgcttagaagttaaagagtatgcacatgaaggtaaatatttgaaataggaattttgggctaatatggaaggacgtgtcttcattagagtttaatattagcaaacaaataacatacccaattgtttcagcagaaaatcactctgtacactgagtttggaggtcctcattcttgtaggttttgcatataatcacactctgtttatttcccctgaagttcatggaaacagaaatgtacatcatcattatgacacctgcaggatgcactcctaagagaagactacctgaaaggcgtgtacactggtctagcagttgagatcagctagtgttccatctatcttctgtcatgtcagggaagactctctgatcctctcataatttacctattgttgatttcctgaatctttttaaatcctttgcaactgaagatggtctctccatcagagaagcaattaaccaaatgcctgactacagcgtatatagcatctgttataaaagcatgaaaggttaacttaaatcctggcacacaaaggagatgtcagaccagaacaaatcagcatggaaatacctggaggagatacaaggttaaggtggagcatatgtacagtcaagaggatgttcatgactagtggaatgtgtttttcagattgcaaagactggaaggtgcaggtgacaaggagattaaacaaggtcacttgttttctttccttctctgaaataaagaagaagtggccgtatcacacaatttcgacccatgggatataaatggaagtcgactgtgatttttcccagtcattgctttctgttaatgagatctgttttatttctcttttcttttttcgtcctactaaaaatgcatgtgattgtcatagctgaaacagccttgttacttcgaagagaaaactagcaaacatagtagctaggccatgtgatactgctgaactagtcatgaaaatggactaaaacactctggcttagggtaataacctgcaagttactcattccaattgaaaaatgagataagcatgaattatataaagtcatgtctaccattaatatttgataagaccattaagcatttttgcatcatatcatgcttagatttctcttaccaaagtctttgatccatttttcaatcacttccattttcttactaactaaagacaccaaactagaatgtctcttagtgcagggagtttgctttctccataggggatatggccattgggaagtacatctgttcttgctgtttgaggtttctttgttagcttattcctcccgcacaaccagtatcaattgtcccctgtgcatatactcacttcatttctgccaaattttgccagatgttagttgcgttactgagacaagaagatggccaatatccaaagtcccagatcaggtatctcctgccaatgctcaccttaatttctaggggatacaggtatacagaaaatccccctatatagcaactcacagtgacaatttcagtgtcaagccagttttatcctagtatgctgttatatttgcatataataaaggtgcctagcataatatctttgctgtctccaaacccaggattataatatttaagtctttttagtttattttccaatttttttcacatctatgcatctaagtgaaaataaatgtgatgggattgatgtaaatagcaaatgccattacatctagaccatgaatttctaattaaaaaagtcagaatgccaagaagagaaagttgtgtagatctcattgttttgagaagactagtaaaggacacagccagacagagatgagctttcagggggaagccaggagaataaatttgctttaattgctcccctttcttccccagatctcttctaagatgtcttgatcgactgaccccaaagccagagggtaccaggtcaaaaagcaaggtactaagggggttgggggtaaatttggaatacctgatagaagacatctcttattacttccctttcaaaattcagtcaatgaaaactcacccatgtttatgtgcctgttattgcactaaaactggatatacttcagtaaatgaagctgactcatagtctagtccatgggtcacctggtgggcagtgtagcattataaaatgaaaaagtgaaatcaataagtgctagtactagagggcaagaacatatgcagaataaataaacagaaatcacaaatgaagtattattctgttttgtttgtattttcacaacagatggttgaatgaaaaactccaataaccacagaagactgatttaataatggaatactatcagtaaagctcatttagaatctgtaattagatttcatccttgattatatgtgcaaatacctcctaagaaaataaccgtttaatagcttaattttggtttagaagccatttccagactttgaatctaatgttctaaatggtttctaaatttttgtgtagtatgatattctatgaaaacaatatgcattattaagttaaaacttattatttcttacattatttctaagaaaacaaacaatactgacattagagagaagcaaagtttctatagaaaacctattacactgtggtataaatcaagatgaacctgcagacatctattttaggtatgtattaaagttaatgtaataagactggcaccccaaatgctactattaaaagttttatatcaatgacaatgctattactact

SEQ ID NO: 729522 - DNA, 940 bp, Homo sapiens
agattagactcctcagaagctaattgactagggaaggatcaggaagacaagacacatcaaaaaggggagggaatctacaatggaaggacacaagaaagatcagctggattaagtagtcatgattatgcaaagccatatccagagaccaaggtgtaaagcaggtcggagaaaatggaaatctcaagattggctcagtcaaaaagaaacattatcagtttgaacatggaccttgaaagggatacgcagagaatagatgaagcaaatcagaaacttcttctcaaaatccaagagagggaagataagattcagaggctggaaagtgagatcattcagacgcggggcctggtggaagatgaagagtgggagaaggagaaccgcaccacgatggaaagggaaagagccttgcaggagctggaggaagaaacagccagacttgaaaggaagaataagacgttggtccacagtataacagaacttcaacaaaagcttacaaggaaatcacaaaagataaccaattgtgaacaaagcagtccagatggagccctagaagagacaaaggttaagttacaacagctggaagcttcctatgcatgccaagagaaggagctgctcaaggtaatgaaggagtatgcatttgtgacccagctctgtgaagatcaagccctctacataaagaagtaccaggaaacgttgaagaaaatagaagaagaactagaggctctgttccttgagagagaagtatcaaaactcgtgagcatgaaccctgtggaaaaagagcataccagccaaaataatgagggtactcctacccaaaagacagcaagattattcagtaaaaaatgggcctcctccttttagtggcaagatggctgccaacaatccagatctcgtactaccagattggcaacctttgcagaataaaagtcttttccaacaggtt

SEQ ID NO: 729523 - DNA, 503 bp, Homo sapiens
  misc_feature (36)..(36): n is a, c, g, or t
ggtcgacgtggtttgaaaagtagagggcttgttaangcacgggatgctgattcagtaggccttgagtggggataatttacatatccaacaggccaggtgatgccctggcttggggatcacattttgtgactgatgcagagtactgatggtcatccagtccccttccttcggtgtttgagaccacttcatctggaccgagctaaagtctaggaagaaataaagtttcaaacccagtagagttacctcaaagatacacttgagacccttttcagaagatggcaccgaaagtgaagaaggaagctcctggcccgcctaaagctgaagccaaagcaaaggctttaaaggccaagaaggtagtgttgaaaggtgtccacggccacaaaaaaaagaagatccgcatgtcacccaccttccagcggcccaagacactgagactctggatgccgcccagatatcctcggaagaccacccccaggagaaacaagcttgaccactatgctatc

SEQ ID NO: 729524 - DNA, 843 bp, Homo sapiens
aatcacttgaacccaggaggtggaggttgcagtgagccgagatcatgccactacacttcagcctggccaatagagtgagactctgtctcaaaaacaaacaaacaaacagaaaaaaaacaaaaaacaaagaaccagtttgggttttggcagaaatcacatcaggaatattacacgaccccagtaggtaaccctgagtgctcaggtctgagctgaggtctcagtcttttatggcttcatgaaaggactgtgccctcagggaggggaccatggcttggcttgtggggtcttggtgatgactgccatctttcttcatcaccacacccagcttcttgctggcatttgcgaggagacagcagcagataagaggttcaccctttatctcccagtgagcaagatgcttccctgttcagagaggaagtaacactgcttatgcttgactgctgtttttttttttttgtcttttgtttgcttttcttttgattggaattctgtatttaagatgttaagttgtgtcagcttacatatggaacattccaggagaggtgactggccccccaccctgcttggcagtggatttctgcatcaccagcttcagaagtgtccctgttcgctagtctgttgtttgcttgctttgtaaatactttggtcccaagctgagacaattgctgtgtaaaacgggaagagtcaatcttgaagggtattatttttcagaagaatttgccgtgtgccttcaccgaaggcagtcaagtctgcagttggatttttctcactagggaatgacaggaaacggggataattttgcactgtggatatattacaggagttgtctatacgattatagta

SEQ ID NO: 729525 - DNA, 699 bp, Homo sapiens
ctctaaacaggatccaaataacattgttgcctcctaaccagcaggtgggagctcaagagaaagactagacttgttccacattaaataagtaatagtattttttgccttgaacatcttgatcataatatcaattaaatgtgtggccctgattcaatagctaccatttattgagcatctattttgtgccagacttgctgctggtatttgatagtgcagtgcctgacaagtagacacactggcttaaatgtcattgttactggtattattgttacaatgatgttttaatcctcccaatgtaattaagcctttatcataaagatcataagatgttcactttacttatttccttgtccttttcttcctccgtgcatgcttgcttgcacgagggaagtcactagtaattgattaacttcctaccctaacccccagggctgcctgcaagattgatgaactgtttttctttcaaagaacaatgatccttaggtcatgcagacctccttgatagcatctaggagtttgtttgggccgaggaactcaaacagttttgagtattgggggaatccatctcctgcatacctgctttgctcataaaagcccccagttatgttaaaaggcagattggatttgagaggctgcttctcctgccttcttgctttagccgagtcaaataaaccttcctctgcttctaagtgctgatgt

SEQ ID NO: 729526 - DNA, 531 bp, Homo sapiens
gcctgtcttttctgtgggatacacaggacagtgccatgattctagtagatggtagatgtgagccagcccgaaggaacatcaaggagagttccaggaatgaaccgtgaaatccctaaggatccaaaaggatatgcagaaagaagagcagcacgtcatacccaagaccaacatctctcagtgtttcacgctaacccaaggagagacactagcagtcttctctgcaggaccccttgaatttacattgaattccatccccagccgagcaggtgcttaaagtcaacaggggacactccattttcttggaatttcattctggcaaagagggtgtgagcagcaataaggtgggtcttcctgaagaaccaaccaaactcaggagctaccaggctgcttgtttctgtgaaaatgttgtgagtgttggatgtctgcatgtgtgtgtgccattgtgtgcttaggggtgtgtgtgtgtgtgtgtgtgagtgtgtgtgtgtttgcctttaactggagtctgcttaaaggactgtggataatgca

SEQ ID NO: 729527 - DNA, 516 bp, Homo sapiens; identical to SEQ ID NO: 17692
  misc_feature (510)..(510): n is a, c, g, or t

SEQ ID NO: 729528 - DNA, 1228 bp, Homo sapiens
actggcagttgggagcctgatggaggacaagtagggcctcgaggacaggtgcgtgacagaagcacaggaaaaaaaagaaaaatgaagaaataaaaacacgagttcatcagtaaagaggtaccctggcagcataaatattatgataagctaaaagctggaatcatctggaaaaataaataagactcctcatgtccttttcggtccataaccagaagggcagcaaaaggcctttgccactggaacctcttctttttctccaagtcccacgtagcaattacctgcactttcaagaagagaaacaacgactacacctaaagaaattccttcttgataggatgtttctagtggccaagatacaagcaaatgtagaaagaaaagatgttgctgactactatgaacaaatgtttcagtcagttttgaaacatcacctaggagaagcagtgacaggattgctgctcatctatcccacttccattctgcatatcctcgagtcctccagcgacactctctacaaagttcttttagattatattggccatgtcaaagatgaaacagtattttttattcaacaaatgaaaattatagtcatttctcataacattccaatgaggctttttatgcaatggcatgtttcagtgataaaagttccagttatgtatctcgacgatgtgacacagtcacagtccctaaaggaggtcatcacagattttctcacacaaactcataaactgtcactctacctttgccagactatgaaagtaggcactaaaggaccaggcgataacttacaccaagttgcacctgacctactcctcccagaacaaatcataaagtacttgtgcaaatccgaagaattcatggacccggcaacatttataaacatgtataatagacccatacacatcactctggattctgaggtggtatggcctgctccttcacgtttctaggattgagagggataatgtgcccatgtctcttaaggagtttgtgctacttaaataaaaaaaacatttttaaagttactggtgtcttttaaaagaaacagaacattgcaatatacacagaggtaatatattaatctttatagagtatgttgagctaaactttaaaatgtatctatttgttgtggtattaagttcaatacattattttactaggtagatgggtttaataagtttatcataagctctcaaatattaacatcattttcatgaattgacacttt

SEQ ID NO: 729529 - DNA, 1025 bp, Homo sapiens
actggcagttgggagcctgatggaggacaagtagggcctcgaggacaggtgcgtgacagaagcacaggaaaaaaaagaaaaatgaagaaataaaaacacgagttcatcagtaaagaggtaccctggcagcataaatattatgataagctaaaagctggaatcatctggaaaaataaataagactcctcatgtccttttcggtccataaccagaagggcagcaaaaggcctttgccactggaacctcttctttttctccaagtcccacgtagcaattacctgcactttcaagaagagaaacaacgactacacctaaagaaattccttcttgataggatgtttctagtggccaagatacaagcaaatgtagaaagaaaagatgttgctgactactatgaacaaatgtttcagtcagttttgaaacatcacctaggagaagcagtgacaggattgctgctcatctatcccacttccattctgcatatcctcgagtcctccagcgacactctctacaaagttcttttagattatattggccatgtcaaagatgaaacagtattttttattcaacaaatgaaaattatagtcatttctcataacattccaatgaggctttttatgcaatggcatgtttcagtgataaaagttccagttatgtatctcgacgatgtgacacagtcacagtccctaaaggaggtcatcacagattttctcacacaaactcataaactgtcactctacctttgccagactatgaaagtaggcactaaaggaccaggcgataacttacaccaagttgcacctgacctactcctcccagaacaaatcataaagtacttgtgcaaatccgaagaattcatggacccggcaacatttataaacatgtataatagacccatacacatcactctggattctgaggtggtatggcctgctccttcacgtttctaggattgagagggataatgtgcccatgtctcttaaggagtttgtgctacttaaataaaaaaaacatttttaaagtta

SEQ ID NO: 729530 - DNA, 457 bp, Homo sapiens
gcggagagggggcgcgctgacgtctcgccggcttaacctgttgctctcgagactgcgtcggagcccgcaggcagggccgcgggaagccggccgggccgccgccgccatgctcggccgtgtgcgcgccgccgccagccacgggcttgcagccggacgcccggactcggagacacgatccgctgaacgcccgcaataagaaagaaaacccaccccacgctgctctccacctcaacgaggtccggaatgggaggcggggtgcggttctcgtccaagttctaccccatttgctttgtggctgcatccgaaacggacgtgccccgggaaggcgtccacgctccaagacaaggttgcctcagtgcagtttctacagcccgagtttaaactagtcctttgcattctacccagccctctgcaatgcggatgtattttaattcttaaattctttatggaacaaatt

SEQ ID NO: 729531 - DNA, 1349 bp, Homo sapiens
agcggctcttccgcggccgcggtgggaatggaaacatctgccccacgtgcaggaagccgggtggtggccacgacagcgcgccactccgcagcgtaacctcgcagatcccctgcgtgtgtcctcgcaagactagctcaccgaaatggccgcgtccagtcaaggaaactttgagggagatattgagtcagtggaccttgcagaatttgctaagcagcagccgtggtggcgtaagctgtttgggccagaatctggactctcagccgaaaagtatagcgtggcaacccacctgttcattggaggtgtcactggatggtgcacgggttttatattccagaaggttggaaagttggctgcaacagctgtgggaggtggattttttctccttcagcttgcaaaccattctgggtacatcaaagttgattggcaacgagtggagaaggacatgaagaaagccaaagagcagctgaagatccctaagagcactcagatacctaaccaggtcaggagcaaagctgaggaggtggtgtcatttgtgaagaaaaatgttctagtgactgggggatttttcggaggctttctgcttggcatggcatcctaaagaagatacctcattttcattgttcctggttttttccagccagcagctctacactccatcacaggacattgagtccctcctcctcttctcccatgccttcctccctgctgtggcaaatccgagtggcttctataagcatccgttggtacaagttaatgtggcaccatgagcctgactggcttctataagcatctgttggcacaagttaatgtggcaccatgagcttgatggcggcagaagagacaatagtccttagctcttcttccagtacgccccctacttagtcagtctgtaggtcatcaagaaggtccctctacccctatgcaagacacttacaagaacacattgcaagatagctgaccgtggaggatgagtggatcctgaaatgttgtcccgaactgttgatttggaaaagaaataagcacatagataaccttattgtgtgctgcatggaaaggaactgaatacaattgcctttaagcattaaaaaaaaaaggatgaaaaattggggtgtcacatttgcaaaatggatggacaaatgtggtcagggcagatcaaggatcatttcactgattacaagccaggtgcacgccctgtcccaggcatttagaagaacaggggccagacttacatgtggtcacagttttggaagagaagatctaattggctgaacttatgtcatatgctgcttgctggaggttgtgggaacttccatttatacccttttgattagaagtacaggtgacaacct

SEQ ID NO: 729532 - DNA, 468 bp, Homo sapiens; identical to SEQ ID NO: 286164

SEQ ID NO: 729533 - DNA, 338 bp, Homo sapiens
ctcgtgtaggacgcccaacatctggacgcacacagcatgactactagtgctgagcagccacccacaatgaattacctcacaggattgctggtcaaagacactcggagagactccaggcatgtgacaagtctctcatctgcagaccccattttcagctcatgaatgaattcctgagattcaccatccaacggcaggaaatgaattgtgtaagttcaaaagaagatcaggtgaagtggtacgaaattcggtgtttttcatgttttttgtttttattaatttactataatgttattcaaaacaacattcccaataaagcaaaacaaattagcactgtaaaa

SEQ ID NO: 729534 - DNA, 509 bp, Homo sapiens
gagggcatatgcacaaagacattaaatgtaaaagaaatggcctgtgctgagcaacagagaaagctgtatcagagataaaaccaaacagtaagcttcctatgacacagctccagtggaagaagagaaagcaccacctcattactgcaaggtggaaacagaagtccaagagagattctttgttaccacttgacatggatgggaatctaggcactccctgatggagagaagaaggactgcctcattatgctcaccatgtaacctacaatagcaccatggaagggggatgtggacgtctgttatcactgggtggttgtgaaagccctgactctattggcttctttggacataatgccagtggggagggggaagaatgcctcattaatgccatctgtgggtagaaatccaggctacccactttgctttttgatagtgtggtgggggatggggccacatatttttttctgcgatatttagcagaaatacaaagcagttattgccaacaaaaactg

SEQ ID NO: 729535 - DNA, 1766 bp, Homo sapiens; identical to SEQ ID NO: 465413

SEQ ID NO: 729536 - DNA, 1253 bp, Homo sapiens; identical to SEQ ID NO: 465415

SEQ ID NO: 729537 - DNA, 1703 bp, Homo sapiens; identical to SEQ ID NO: 465414

SEQ ID NO: 729538 - DNA, 587 bp, Homo sapiens
gttatcaccgcaataataaaaatcgaaatgcggagaatgcatcctatatccacgttcaaagagatgctgtcaggactgtcgcgttgaatgcaccttcccgcagcaggcccacgcatgggtcctacaataaagtccatgctaacagggaacccaaacccaacctcagtccagacaaatatacgtcaacatcatataatgattcagcctggcgaaaacgaattcctttttcaaaaacatattcaaaaagtgaaaagatatatccagagccaagaagaaatgggagcaagtaaacctggaggttgagagagagaaaaatgagaaaaaattgccagacatcatctgatttacaatcaaaaatgaaaattcaaagaatgagatactcaagtactccatgttatgtagtggatagccaaagatgataaaaatgcaaattctgaaaataagatgcaggaagtacattgtgctctttcaaaactgataaaaatgcaaattaccaacagctgccagtgtatttatgtaggtctggaattcattccgtgcattactccaaacattttaataaaatttaaaagtttgacaattaaaaa

SEQ ID NO: 729539 - DNA, 859 bp, Homo sapiens; identical to SEQ ID NO: 18003

SEQ ID NO: 729540 - DNA, 1700 bp, Homo sapiens
aggcacatgctgccaggggggaactgaactcagggaatggggcccccagctcccattggggtcggcgaacctggtgccaccccttagacaaagtcccagtctcccagaggcttttaccagctggccccattccttctgctgctgggtataataaggtcctctcaacgctgaagtgcctgtgaaacacagcccagaggagttctcattggtcctatgggctttgtcttcctctctgccccacccagataatcgctgctgcccctccactcccaagatgcagctgtgattctccatccccacacatccctcatcaatggttgactgcaaagaagtgagaagccaagcttagattcatgctcatgcctgaacaccctgagagcctggtgctggagggctgggtatccccttggcctgccaccagcacctgcacccacaccaggctggagccacgctctgcgcacagaaggtggccttgatttctcaggcacagctgacctcagagatactggtcctgactctgccaggtctcttatccctagtcttgttgccccagttccttctggattcaaggcgatgttgcctcaaaacaaggaccaggtgctgccacagacctcagtgctccctgggcgccccacttggggcttctcacaacttgtggactcctctcctcacaacctacagcctctctctccccatcagggcctccctccctctcaaccaccgttctcttccactcagctccactctaacaggcagacatggcgctggcatcagtacagggacactgggtccgggtcccctggagtggtggagagatgcgtgccaagcgagaaggatcctgcacagttcagggacccaggggccctggcccaggccctggtggtccagctggggcaccgccgcatcgcacacgacctgcggctactgcttttgcagcacctgtggctaggcagaaccggccaggccccagtcgtggagtatcctatatgcctggtgtgcctccggccccgcagcccctcctgccccctccccaggtacaggactggaccccggctgcttgctttccctcaactactgccctgtgtgcagggccaggaatctgggccactccggataggcatcggcttcggcctccgcctgcctcagggccaggccagggccttgcatctgctgcccgagaaaaggccgaaggaagcagggcctcagggcaaggctactcaggcctaccaggagcttcaggtctgcaggccttcaatcaccaaactccccacgatgtttctccgggcctccacctcgggcaccaaaacaggtcactacctccctgaagcccaggccttgccctggcccaaagaggccagtttctctggagctcattctccaaaagtcatcagtctagttccagagccacggaggccccctggaacaccccctccaaacccaaccctcccaaccaggccccagatctcggggagtccccgagacaccctgaagggctggctggccggaggagtgcacaaaggtcctcatcagatcagaaacccgagggagaatggagtgtcaggcgcagaagatacctgcccgggagccaaactgccccctctgaggccagcaaagcagctggccacccaccaagccaccagcccaggagtgtgaagccttgagaaagggaatggcagacaccacccctgccaaaagtgggc

SEQ ID NO: 729541 - DNA, 781 bp, Homo sapiens
ttcgcgcagtttggggtgggccagatgggccggaggtgtagccaggaacggacagatgtccgtctcttaagtcttaggttttaatcgtgaagctgatccctggttcattgtgatccttctcacgctgtccatttgacataagaaacccgagaaaggaatgtacttgtctgaagtcccacagtctgttagtggcacagtcaggactagagaatttagctcctgaagccgagatcaatgctctttctgccacatcagcctgagaactttgagttttgcagtgttttggggaagatgctcccgtgaaacaatgaacaggaaaaacctgaagaagcctcacattttctgctagcgagaaaagccaaaatgtcttccacagattatctatttgcaatgaataaaaaaggatttaattttagtgatggagattaactgcccgtgaatcaccaccttacacaaaactgaaacctttgacaatacaaagggtaacttccttagtgtttctatacctttgcttactatcaccgaggctagttggcttttcacagccatttcttcatctcttcatgatccttgcgacccagctactctacccaatggagacacagggctactctcacaaaccacttgataacgtctagcacaccagccttaaaacctaagcatcaaactgtgtcctagcaaaattacaaattgttacatgtcgtggagtttgggaattggtcctgaatagctggaaccacaaatgttaaatctgtgattgcttcaagccttctgcataact

SEQ ID NO: 729542 - DNA, 858 bp, Homo sapiens; identical to SEQ ID NO: 18247

SEQ ID NO: 729543 - DNA, 984 bp, Homo sapiens; identical to SEQ ID NO: 18248

SEQ ID NO: 729544 - DNA, 655 bp, Homo sapiens
atcaccatgtacagcttcatgggtggtggcctgttctgtgcctgggtggggaccatcctcctggtggtggccatggcaacagaccactggatgcagtaccggctgtcagggtccttcgcccaccagggcctgtggcggtactgcctgggcaacaagtgctacctgcagacagacagcatcgcatactggaatgccacccgggccttcatgatcctgtctgccctatgcgccatctccggcatcatcatgggcatcatggccttcgtgggtggcagtgctcatgacgttcttcgcagggattttctacatgtgcgcctaccgggtgcatgaatgccggcgcctgtctacaccccgctgagcccaaatgtgtcccccaacttcatctggaagttaaagtgaggccactgaagaggaggaggagggtctagaggcctgaaatcctggttcctaggggaatgagggggctcagttctggactgtgggtttgtggggggaggctgactcctggtcctaggctggaaggaggaagaatagggcccatgggagggagctgagaagactcaagtccccgtctgcctggcaggttgttagaaaaatggactatccattagagcaactttctggggcctaataaaactgatgtgaaactactaaa

SEQ ID NO: 729545 - DNA, 575 bp, Homo sapiens
aaggagaatttcctaagaaatgcacatgtgcaacaagtatagatttaacagctatataaccttccttgggtagcagtaattagcaaggcaaccatcacctaaaatttgtagtcaacacaagctgaagcatgctcattaatcaatagtaagggagagtcccacaaacctgggatgggaactatgtggagaaaggcagaaatggaaaaaactagacaaaagaagcccagaccgaggtgttgataacaaaacactgcctactgatctgcatgagacactccatctcagagtctacttcctgaagaactcaacaagtaacaactcgtactaggaacaattcaaagcagcaggagattcataggaatttggaaaatatgcttatttaccatcaagctagcaataggatcctaatatttaatttgatgggtacagatagactctggtacaaaatggtagtctagttgttaaaagttccactagtgtgtattggaatggtgcatagtagtggaaaagaatgcactggctggtgcgttatgtcaatggtttgataaccatgaaaaaaacagttaattataaaa

SEQ ID NO: 729546 - DNA, 689 bp, Homo sapiens
ccagcataggggagctagaagccactttccagccacctgccgttgggttttttcatatctgtacataatgccgagtgcaacgtttttgcacactcattgactatcaactggttgtctatgactcaaattacataatgaatccagcacataaattatttactcagatttaatgccagcaactgttatctttgtatttttttcccctctgccagctaatctggctcatttcattggaattttggtcatgcccattctccttcggcactaaattaactccataacgtagtataaacagaacaagcttgtgtgtgatatgcttaactgttaatttacctaattaaactaattcaattaaatcatttacatctttttggtaacatgccagttgataccacagcagaagtggaatgtttcagaagatgattgttcagcaaatgaatggaaaaaaaataaaaggaaaacaaaatgagacaaccgtccaaatctcttggcttgaaaattaaatgatactgaaaaaatgcagctttcacggggcactgtgattagatatttttctgaaatcaattttctctacaaattggtattttaacagagtgatcacaatctattgtacaaaatattttaaacactatttgtacattcacatatttggtatgtttaagtaaagtgtgcttgttcccacaaaaagg

SEQ ID NO: 729547 - DNA, 441 bp, Homo sapiens
acacataaaattaaccatcacaagttcaccccttctcagttgggctcccatacacatcttcaaccatactgaatctccaaatactgacaataacatggccatagttccacctaacatgatgctgctatcctgcatacaccaaaaatgctctgtttctttccccagaagaggatgcaaagtctttgggtgacatttacttttcttgatatcctgtaccttaaatatatgatgtaaagctaacaatacctaaatactataagtcaatatatcttatgttatatgataaagggatgagagggaagaaagcaaagatatttgagatagaaacacacacacacacacacatttcatgtagcttcaggtttctctgataaacattctgaaattgctccttgaattttcagtacctaattaaaggtatggtagtttctctttacaaaa

SEQ ID NO: 729548 - DNA, 519 bp, Homo sapiens
tggctgctatgaccgcacacccaggatattacatacatcaggtatcaggacctcccctgtcagatgattcaggggctgatttgcctcaaatggaacaccagcactgagaaccattttggttctgaactggatgatgctcttgcacttgagatgacatcttcttgcagcaagagtgctgatatcccaagaggagagattcatggttttgatcatttccttctgaactgcctgcattttctgaggaaggccttctagaagaaggaaagacaaagacttccaaatgtttcaaaggaagattgaacaaatggccctccccaactgttatcccattacctttcacgtccaccgatgctatttcaagacatatccagtggaataacagtgatatggttcttgttacatgaatgtgtatttactgttaggagattgtatattttaagttaccatgattaaaagtgtgtaaaaaagggggacagagagaaatactataaaaggccatgttactcatgcattgaactt

SEQ ID NO: 729549 - DNA, 513 bp, Homo sapiens; identical to SEQ ID NO: 15556

SEQ ID NO: 729550 - DNA, 386 bp, Homo sapiens
gtctacaactaatggatctcctccttagttcctgttggatatcttgggatggggtcatgagggtagaagcgtcaccacgaggactgcttttactctcagggtcacctgcctagtaaattgtccagcagggaggagaataaatttcttttattcccatccatatgactatgtcatctacagcacagcttcagttggggaagatattagcagacatcatcactgaacccagaagagagggtggtgcccatgagtggagatgccagggtctatggctgaaactgggaacttggaaatcaagtgagacccaagcaaggaaaccaactgccaaagcaaggaaaccagcttggtttggcaaacagctgatgaaataaatgtgacgtagaaga

SEQ ID NO: 729551 - DNA, 506 bp, Homo sapiens
tgtgggaccaggtgctgacagtttttaaggatatacaaaaggagctgcaggaagatgctcggattcgagggatgagcaactgctccatgacacccatgacatcagcacccaggactggaagcataaggcctccagattccttgatgaccccaaagttgagaagattgcagttcagctctggagagcagccatcaggaggccgtatccacaacctgaagacacagctcttcagtcaatcagcttactaccctggaccctaactctacaatcaaggaagaaggacatctctgcttccgccagcacagcttcagttggggaagatattagcagacatcatcactgaacccagaagagagggtggtgcccatgagtggagatgccagggtctatggctgaaactgggaacttggaaatcaagtgagacccaagcaaggaaaccaactgccaaagcaaggaaaccagcttggtttggcaaacagctgatgaaataaatgtgacgtagaaga

SEQ ID NO: 729552 - DNA, 550 bp, Homo sapiens
tgtgggaccaggtgctgacagtttttaaggatatacaaaaggagctgcaggaagatgctcggattcgagggatgagcaactgctccatgacacccatgacatcagcacccaggactggaagcataaggcctccagattccttgatgaccccaaagttgagaagattgcagttcagctctggagagcagccatcaggaggccgtatccacaacctgaagacacagctcttcagtcaatcagcttactaccctggaccctaactctacaatcaaggaagaaggacatctctgcttccgccaggctcatctgacacctaacccacctggagaagaagactgtctcagcacagcttcagttggggaagatattagcagacatcatcactgaacccagaagagagggtggtgcccatgagtggagatgccagggtctatggctgaaactgggaacttggaaatcaagtgagacccaagcaaggaaaccaactgccaaagcaaggaaaccagcttggtttggcaaacagctgatgaaataaatgtgacgtagaaga

SEQ ID NO: 729553 - DNA, 383 bp, Homo sapiens
ggataccagctctggtcaccatggaccccactggatgagagtttccaatggctgcggcacacgacacctacaccttcctccaagcacccattcaaggcctccccctgcttcccacacacaccgtccgaccttgaagtgcagctgtgctttcaagaggtcactctagtcctagacagcccattcctggaatctggaagatggagtttcaccacattgcccaagctggtcttgaactcctggactcaagcaatgccttgcctcggcctcccaaagtgttgggattacagcggtgacccacaatatctggcctttgtagcgttcttgtaactaggttaggtataactcagaaaatggaaataaacattacatatacaaagttaaca

SEQ ID NO: 729554 - DNA, 835 bp, Homo sapiens
ggataccagctctggtcaccatggaccccactggatgagagtttccaatggctgcggcacacgacacctacaccttcctccaagcacccattcaaggcctccccctgcttcccacacacaccgtccgaccttgaagtgcagctgtgctttcaagaggtcactctagtcctagacagcccattcctggaatctggagtgagtcccaagttaccctgccacacatcagagttgcgcacgatgaacaacaaaggactggtcaggaagccccagcccatccgcctcagtggagtagattctgtctttggcagggttatcacagctcagccaccaaagtggaccgggactttcagagtttcagacaagtcagccttttgcaaaatcattagcagggagcaccagtggcccattggactgaaggagcctcagattcagatgacagtcactatgtgcaaacagatgctgcgctctatcctcttgctgtatgcaacttacaaaaagtgcacctttgccttgcagcactccaagtaaagggtcctcatttgatccccatttactcacaccatgccctttggtatgtacctaaagcttacagaaacctgtccatgtaaatgaaactgtgacattgtcccagccatcttgcttttgtttcaagcagtgatgattcaggagcccctttcatcccttcccctccaaaaaaggaccaatgatagagaacaaggaagaacattcccattgtaaggttgaaccatttagagtcaaactagcattgacatgtccatgtgataaccgttaaacaaatgatataaaccaatgagcctagtgtgaactcacataa

SEQ ID NO: 729555 - DNA, 472 bp, Homo sapiens
cagccagcctccagcgctgctaggctactccgagcaggggagaaaagacgccggtccgccggggaccaggagggagacgtgaaaccagaggcccgggggccccctctccgcctgtgcgacttgtagtctcgtaccagacgcgtccgcttcactgctgaatctgaaaacgtgggctcttgagagctgcccttggaaggagctgtgctttctgcctcatctttaacttttcgtttattcagcaaatatgtatcaagttccgacttcgtggaagagattgtgttagacactgggagtaatagaaacataattaagaagcaggggtcccggacctgaagggcctgagcgtcgggtaaggaggcaacgcttacaccgaacctgtgctgagataaataacgaacagttctggctcttagagttggcctgggggaacaaaaattcaaaaagaataaaaccccaaacaaacaggagaaaa

SEQ ID NO: 729556 - DNA, 778 bp, Homo sapiens
cagccagcctccagcgctgctaggctactccgagcaggggagaaaagacgccggtccgccggggaccaggagggagacgtgaaaccagaggcccgggggccccctctccgcctgtgcgacttgtagtctcgtaccagacgcgtccgcttcactgctgaatctgaaaacgtgggctcttgagagctgcccttggaaggagctgtgctttctgcctcatctttaacttttcgtttattcagcaaatatgtatcaagttccgacttcgtggaagagattgtgttagacactgggagtaatagaaacataattaagaagcaggggtcccggacctgaagggcctgagcgtcgggtaaggaggcaacgcttacaccgaacctgtgctgagataaataacgaacagttctggctcttagagttggccaaaaaaaaaaaaaaaaaaaaaaaaaaaaaaattggggggggggttggagctgagaaaaagggttttaaaacacaattgcgggggggcgcgcgggggcccaaggtgtggaacacgggacacacggggcgcaaaagggggtcccaagggaaacccggggccaaggcaacaagggaggggaggttcttacacacaattaaaaaagggcgggggggggaacaacggaggggtttttggagaaaaattccagaagggggaggttataaggagaggagaataaaagggggagtttattcacagggggggtaaaaggaagagatctcaaaatattcaaatttaagccaggagtggggggtgatg

SEQ ID NO: 729557 - DNA, 312 bp, Homo sapiens
  misc_feature (3)..(3): n is a, c, g, or t
  misc_feature (5)..(5): n is a, c, g, or t
ggngngtgtgtgtgtgtgtgtgtgtggggaagggtgtgggtgctgggatgggggtgaatttcaagttgaaacacgatgatgtggtctgcttgctctctgcttagacaggctttaagaccaattggattttcatggaggccaggacagagagtggtaattgatggcttgtgtacagacaagcatttatccaggttgcgttatccaaactgatttgttaaagctccaggtcacgttcttacactaagaaaatcattcagtaaacatgagacaagtttaggaaaaactaataaaataaacctgtcttaaacttga

SEQ ID NO: 729558 - DNA, 808 bp, Homo sapiens
aaatcaatgagcgttggccaggcacggtggctcacacctgtaatcccagctgtttgggaggctgaggcaggtggatcacctgaggtcaggagttcaagaccagcctggccaacatggagaaaccccatctctactaaaaatacaaaaattagcagggcatggtggtgcatgcctgtatcccagctacttgggaggctgaagcatgagaatcacttgaatcctggaggcagaggttgcagtgagctgagatcatgtcactgtactccagcctgggcaacagagtgagactgtctcaaaaagaagaagaagaaaaaaaatgcagtgagtttatgttgttacattgtaacatctcagcgtagctgtatgcattactctatagcatacctacttaagttttatgtcattcttgaactgtgatttttttttctatttgctttcatagtttggtgggccattgttatggactgaatgtttgtgtcccatcctcacccctaaattcccatgttgaagccccaaccttcactgtggagctggggctgctaaggaagtaattaaggttacacgaagtcacagtggagaatctgatctgctaagactggtgtccttatagggagagaccccagagagcttgttcccttcctccctgtgcacacaaacaagagggcatgggagcacacagagagatggcagccacctacaagccaagaggagaagcctcacaatgaacccccccccccaccctgctggcacctatgtcttcgacttccagcccccagactgtgagaaataaatttctgttggttcagcc

SEQ ID NO: 729559 - DNA, 1077 bp, Homo sapiens; identical to SEQ ID NO: 122701
  misc_feature (3)..(3): n is a, c, g, or t
  misc_feature (7)..(9): n is a, c, g, or t

SEQ ID NO: 729560 - DNA, 283 bp, Homo sapiens
cccgctgccccggggcaagcggagggccatggaggcgcagatgcagtcggaggcgctgtcacttctcagcaacctggccgacctggccaacgccgtgcactggctgccccggggcgtgctgtgggccggccgcttcccgccgtggctagtgggcctcatgggcaccatctcctgcctgccagctggcgtcttgtatccaaatcaagatgaggaagagggggcctgtcgtgccttgagaaagctggaacgggaatcaattaaacattgtggtgctggcacctgg

SEQ ID NO: 729561 - DNA, 444 bp, Homo sapiens
gatgagcaggtgagaccaggtaattaccgaagaaagagagtgatgtgttcattgaagtctactcatggaggaaagaagctgtcccttagcgaagaataaaactgtggactgacccccacccatttgcgaagaaagtactgggtcttcagctttcattgttcagccggtggtctttgtggacaacaccaggggcccctcctgctgaagactgtctggacttcctgattttcactcctgtataaaccccctcccccattactacctttgtctccttggggaaaaaaaatgtttttcacttaagcaaaataataactacccagtatttgtttctggagtgaaattgtaaacttcattgtacattcttcctggctttgatgcttatcgtgaagagttcagtgaaaataaattgtttttatgaaagcagagaaaccatttgataaacac

SEQ ID NO: 729562 - DNA, 482 bp, Homo sapiens
aaccagagttcgtaattctaatgacctctccagatttatggctgcagcattcccaagaaggggtagggaggggcatataatgagctaccctcaggggatcagaaagaaaagggaagctgtcccttagcgaagaataaaactgtggactgacccccacccatttgcgaagaaagtactgggtcttcagctttcattgttcagccggtggtctttgtggacaacaccaggggcccctcctgctgaagactgtctggacttcctgattttcactcctgtataaaccccctcccccattactacctttgtctccttggggaaaaaaaatgtttttcacttaagcaaaataataactacccagtatttgtttctggagtgaaattgtaaacttcattgtacattcttcctggctttgatgcttatcgtgaagagttcagtgaaaataaattgtttttatgaaagcagagaaaccatttgataaacac

SEQ ID NO: 729563 - DNA, 443 bp, Homo sapiens
aatcccaggccagagatcttggatgcaggctatttcaacatgggaaactgaaatcgggcatatccctgcggaagaagctgtcccttagcgaagaataaaactgtggactgacccccacccatttgcgaagaaagtactgggtcttcagctttcattgttcagccggtggtctttgtggacaacaccaggggcccctcctgctgaagactgtctggacttcctgattttcactcctgtataaaccccctcccccattactacctttgtctccttggggaaaaaaaatgtttttcacttaagcaaaataataactacccagtatttgtttctggagtgaaattgtaaacttcattgtacattcttcctggctttgatgcttatcgtgaagagttcagtgaaaataaattgtttttatgaaagcagagaaaccatttgataaacac

SEQ ID NO: 729564 - DNA, 677 bp, Homo sapiens
gacacactctcctgccttatggaagactttgcatcagcatgacgagaagtggtggctgatgactccaaggcaccctaggctgtgatcctggaactgaacatctgatgagtcaatacagggcacggagtaggactttgaagtcctccattggatcttctcggaagatgagggaaatgagagagtgtggagagagattttgtaagtccggtctggaagtggtcattgttcagaatccagccacgtgggtacatggaactgtaaggctatttcaacatgggaaactgaaatcgggcatatccctgcggaagaagctgtcccttagcgaagaataaaactgtggactgacccccacccatttgcgaagaaagtactgggtcttcagctttcattgttcagccggtggtctttgtggacaacaccaggggcccctcctgctgaagactgtctggacttcctgattttcactcctgtataaaccccctcccccattactacctttgtctccttggggaaaaaaaatgtttttcacttaagcaaaataataactacccagtatttgtttctggagtgaaattgtaaacttcattgtacattcttcctggctttgatgcttatcgtgaagagttcagtgaaaataaattgtttttatgaaagcagagaaaccatttgataaacac

SEQ ID NO: 729565 - DNA, 426 bp, Homo sapiens
ggttagtggtagggtgaaaattccaaccatgttaccatttattgtggtcctactgtgtgccaggcactgtgccagctcctttacaaaccctcatctcatctgatcttcacaaaacactctgtggctccacccaatatctctcaggcatctacaaaggctctctcttcctccgtcagagtctggactgggttcactggtccttgttttattgactgagcagatgtgattgacaacagctgtgcctaggggttaacctagtgccccctgctagatcaagtacctgactcccagcccagaattgcccatctcagcaaaggagggtggcattgtgacttttgtggatcataggcactttcatcttcatgagtcccttcgtccattaaaataaatagatttttatgtctgtgttggtgtaaaaatgaaaat

SEQ ID NO: 729566 - DNA, 674 bp, Homo sapiens
acagtgtccagggagcacaaggcctgggggcccacaaacctgggtctgtatgcccactcttcattagcagctccaggaccaagtgcggtcagttttctggaactcgtttccatatctccactgtgatgtaaggatgtgcatggatcctaaatgtgagaagctggcaatcaccaggtccctggcaagtgctcagagtctgagctaccatcaaaatcaagggcacagggggaggctaactgcttctctgaatactctaagggaggcagatctaggccaggtgaccagggtttacaagtcccaggacagcaggttgggcttggtgcacggaagaactgatgagcagcttcactcatgcagcaggacagatcaggacaaagccatgctggagttggggccacacatctgctgaaaacccccaacactctttttcccagcagcagcttccaagcaattcctgaggccctcccaccggctaaccagaaaggaacccaccattggtctccttagtaacgacttccaaggccccttgcacatctgaaaagcgcacagtgtgatttccagacccaagttagacagcgatttcttcaaagtgcaacgccctcaattaatgaaccctctgggaatgaagtaccttctaacaaaaacattgttcaaaataaagctggaaaaaaacc

SEQ ID NO: 729567 - DNA, 3862 bp, Homo sapiens
gggggtgggcggagtcctctcgcaacatccgccaggtagcttcttagttgctgcccctagctctaggagctcctgagtgcacacgccgtacccgtcccttgtcgggaatcctgtcgcaggtttttaagcaacagtcctcaggagggccaagggagtctgacggtgatgtcttcccccaggctcattcccctgtggaaagatttaaaactcctcctaaatgacaccataaataaaagcaagcaaccttcggaagacccaaagaactgcctgattgtgctgagtgaccggtcccaggcactgttcaaagagtctcgctatcctcaaaatatgccgtgtgtatgctattacttcagtgatgcccacttcttcgcctccctctcttgggtgacatcaaacacaaaagaaatacaagctgtagcatggatgaagagcaaaactgaggacatggttgagaaaagaacattctccatgactgaacgattgccacccatccagtccatggtccatgcaggctcctttcatatcctcgtggtctactgtggtgacctgatcctgcgactctttggggaccactttcgggcattcaaacccctgggtaaagtgccctgccgcttcaacatcagctgcctctgctatgacccggaaatgaagatgcttcttgtctggcatcctgggggcagtggtgtcctgggtcattgagctaggtggcacgggcctccaaatagcccacatggtctccatgccaggtgatgagcttgtccaggacatcgtgctgaatggtcccagtggctccctcctggccctgtgtgagacggtggtgagggtccttatgcaccagggcaagggccagctgggagaggtaaagaggttcacgtccaccagcagcggctcctccatcacctgctgcttcacctgttttgatcagggctttctctatgctggaaaccaagctggggaaacccaagtttggagcctccagcagggccatccactccacagtttccaggcccatcaatcaggagtgatctgtatccgcagccgaccagaggcccacaccctgctaacagctggtagtgacagcctaatcaaggagtggaacctgacttcagggagcctgcttcggcggctagagcttggtgaggagctataccggctccagtttattgacagcattactttcttctgccaaactgcccatagtttttccttgcaccgcctgccctgcttctacagcctcttcaatgtctgtggctctgctccccagcagttgcgtcgggtctgctgtggaaataactggttccggatcctgtgtaccactgaggatggcttgttgcgctttgtgtccccagtaacaggggaccttctggttatcacctggcccttctcaatcctggaccaggctgtggattgggcctacgacccaggtaaagaggagctctttgtagcaacaggcagctcagaggttctggtatttgacacaacccgctgcccttgcccagccaagtatctcttaggcacctcaccaaattctcaggactttgtacaatgcctggcttatgggcatttcaacttggggcggggtctagagggactgatattctctgggcaccagagtggtgtgataagagtgctctcccagcacagctgtgctcgattagaaaaattcatgcactttggcgctgtactggcactctccacgctgtctggagggatttttggtggccaaggaaactctctgctctgttcctatggaatggatgactatgtgcacctgtcagaagctgtgcttgatggggtcaaagtacaactgcggcctctcgccagcattctcagcagctgtcacctaacacatctgatactcttgccccagtctgtaggtgccatcacagagacaaactgcctgcgtctctggaagttccatgattttctgtcctctgggtcacagaatggcttgaaattcatagaaacactgcccctgcacctgtgtgccatcacatcctttgatgtctgcctctccttgagtctttttgtcacaggttctgccgatggctctgttcggatctgggacttccatggcagactcatagccattctggactcatcactgcactttggcccagtctgttttgcaaatgaccggggtgacctgcttgtgacttttaaccagagtctttacctagtgtcctgtttaaaattgcttcccccagccctgctgactcgcctttcctttatgagcatatcagatgaagtactggaagtccctaagcctttcataccaagcttcttcttctcctttgagaccatgtttgtgcccaagtacatctaccctggacaagcgcaacagaaattagtgggtctggagaaacttgtcaacaaccgggccattgcctttgaccattctgtgccacatgtgatagaagaagatgaggaagggagcccagtgttactgcgtttcctccatgcattattctttgcaggacatggaagattggatgcaggtgagcaaacgttaccaatgccattatgtgcttcctccccagctacaactgactagctgggatggactcaacccctatcagatattgcgatactactttggtcatgggcgggaatggctttttgcccctgactgctatatccccaattcagtgattcgtgcccgtctttggccagagggcaccccaatatacctacagtgcaacctgcatgcaccccagcgggagctggaatgggacaggtctcaagaattctttttctggcacagcaggtaagagctataagtaatacagaatatccaaagaataaggaggaggatgaacacttcctagaaatgagactttccaaggatgtaacctacagtgtccttacagatggagcaaaccgaagttggctgggaagaaagatgagtgaaataaccattaatagcatgattgagacaatgctcaatattatggtccatgcttccttgctgaagtaccagtgctgtgttggtgcactagggcaaatctttgcctcttaccaggtgtccccagccctacgctctgagacagcccgtcggctactgaatgatacaaccaattccaacccgctgatccgaggactagcttgggaagggctgaagcgtctaggaatgattactcatctttttgccatgcctctggctcaaggattaatggacaaggatgaaagagtgaggatcaagaccctaagcctcatggctgagattggaatccactctaggacctcactcttacagctgacccaaaaacaagagacttttcgggagatgcagcagcagatgatcggggaggaacccctggaccatctactggggatgcgggccacagatctccaaatcctttccactcaagtggagcagagattgaatgaaaacctgaccctgtcacatagagatgaaaagccggctttttctttagatgtctcaatgccttctgaacttaaatcctccctgaaacctcctacagtttctgaagaatctgaagtggccatcaagcccagcaaaggccaaagacgaggccaagcaggggtcaaaaagcatagccaaaaatggttgcggggtctcaagaagacgaaagagagagactctaaacagatgagcacagagccaggcctcttagaggatgaaagtgggactgaggccgcaccattgagatggaggaagcatccgtctattcccaagtggtcttcaagcaccagtgtaataaagctctcaaaagatgttgattctcaagagaaagatatctcgaaggatcacattgcattgaccctgaagaggctgcagaaaatacgtgacaaaagagacaagaaagcaacagctcagaaactcaaaaagaagcacaaa

SEQ ID NO: 729568 - DNA, 457 bp, Homo sapiens; identical to SEQ ID NO: 377522

SEQ ID NO: 729569 - DNA, 1174 bp, Homo sapiens; identical to SEQ ID NO: 377518
  misc_feature (239)..(239): n is a, c, g, or t
  misc_feature (779)..(779): n is a, c, g, or t

SEQ ID NO: 729570 - DNA, 523 bp, Homo sapiens
aggaaatgaactctattaacttgagtgagcttaaaactagatccttccccagtcaagcctccaggtgagaattcaatcctggctggcacctggattgcagcttacagaagacccagctaaggccatgtctggactttaaatccacaggaactgcaagatggtatcagaagtgggacctgcagtggggcatctagcaacccccaggagcattgagtgaccaggcttgggacccaccgggcgcagggtgtccattgttctctcgaagcaactgagaattgtggatattcttcattattccatcatcatctcaaacctcttgggtatagtgtttgactactactgtgaccataaattccaataaaacctaggaaaaatgaaaccactacattaactgaaaggatatcagagagacttctctactgcttgggatgcttgttcagagtataatttccatagcagcaagaaaaggaatttttgtttgtggatactttaaagtaaataaagctattatagaaggcaaaag

SEQ ID NO: 729571 - DNA, 535 bp, Homo sapiens
aggaaatgaactctattaacttgagtgagcttaaaactagatccttccccagtcaagcctccaggtgagaattcaatcctggctggcacctggattgcagcttacagaagacccagctaaggccatgtctggactttaaatccacaggaactgcaagatggtatcagaagtgggacctgcagtggggcatctagcaacccccaggagcattgagtgaccaggcttgggacccaccgggcgcagggtgtccattgttctctcgaagcaactgagaattgtggatattcttcattattccatcatcatctcaaacctcttgggtatagtgtttgactactactgtgaccataaattccaataaaacctaggaaaaatgaaaccactacattaactgaaagggtatcctcctctcaccttcagtgcccggatgcaggaggtaactccctggtgaggaagacctaagtatatggccatagattcataaggagaatggaagagaaaagtgcttttaaaagtgataaatttgagaaaaact

SEQ ID NO: 729572 - DNA, 597 bp, Homo sapiens
aggaaatgaactctattaacttgagtgagcttaaaactagatccttccccagtcaagcctccaggtgagaattcaatcctggctggcacctggattgcagcttacagaagacccagctaaggccatgtctggactttaaatccacaggaactgcaagatggtatcagaagtgggacctgcagtggggcatctagcaacccccaggagcattgagtgaccaggcttgggacccaccgggcgcagggtgtccattgttctctcgaagcaactgagaattgtggatattcttcattattccatcatcatctcaaacctcttgggtatagtgtttgactactactgtgaccataaattccaataaaacctaggaaaaatgaaaccactacattaactgaaaggaaggaagatgattccaagtcatgttatttccaaggaagcaacaataacttcactggacccctgctgatcttaaagtgcagcatgaaaaacagtcttggagacttctagagatgtccaaagtatgcctacggggagcaatagggataccaggagaatctgatggtagacgtatattaaaaaagctatttacatgttaaa

SEQ ID NO: 729573 - DNA, 916 bp, Homo sapiens
aggaaatgaactctattaacttgagtgagcttaaaactagatccttccccagtcaagcctccaggtgagaattcaatcctggctggcacctggattgcagcttacagaagacccagctaaggccatgtctggactttaaatccacaggaactgcaagatggtatcagaagtgggacctgcagtggggcatctagcaacccccaggagcattgagtgaccaggcttgggacccaccgggcgcagggtgtccattgttctctcgaagcaactgagaattgtgggacccatgaaggagcatcaagctcagcctcagatattcttcattattccatcatcatctcaaacctcttgggtatagtgtttgactactactgtgaccataaattccaataaaacctaggaaaaatgaaaccactacattaactgaaagggaaggatttgacagcttcttttgggcatatcagaatcgccagcatcactactcttgcactgtgcggccattattaagtgaaataaggattacttgaacacaagcactgcaatgccgctacagtcaatgtgataacccagctggtgactaagtgaccaaggacggggagtatctacagcggggagactctggaaaaagggaggattcacatccagtgccactggggcagggcagaatgagagttcatcatgctacaaagaatggcacagaatatacgacttgtgagtggattatctctggaattttctgttgactacatttgtactacagttgtatgtgggtaacaaactgtggaaagtgaaacttcgggtaagggggaggctaccgtagatagcccagtatttcttattttgtggatttgtttatctttctgctcacatccttttccttctgcattaccattttagtaaaaatagatagcatcca

SEQ ID NO: 729574 - DNA, 677 bp, Homo sapiens
aggaaatgaactctattaacttgagtgagcttaaaactagatccttccccagtcaagcctccaggtgagaattcaatcctggctggcacctggattgcagcttacagaagacccagctaaggccatgtctggactttaaatccacaggaactgcaagatggtatcagaagtgggacctgcagtggggcatctagcaacccccaggagcattgagtgaccaggcttgggacccaccgggcgcagggtgtccattgttctctcgaagcaactgagaattgtggatattcttcattattccatcatcatctcaaacctcttgggtatagtgtttgactactactgtgaccataaattccaataaaacctaggaaaaatgaaaccactacattaactgaaaggatgtgcctgtcacagtctccaccagaagctttatcttactacagagtccagatgcattaaggctgtgttcgagccatgatcttcctctgaagaagaaatgaagaagaaatttatcttatttttggatatagtgttcttagttggcagtttaattattatttttacttcatcactttgtatacgtcatcgcactttctcctggcctataagatctctcctgagaaattttacgttctactttactggaacttcattaaatattatttgcatcatttttc

SEQ ID NO: 729575 - DNA, 586 bp, Homo sapiens
tttcttccagccagatattgtattaagtgtctagatgtttcccccgtccctagtttggttgttcttccagattccatgccagcaaggccactggtgaccccaataggtacctttgtgcaaattagaaaaagatgctcctagccgggtgtggtcccagcactttgggaggcagaggcagaggcaggcagagcacttgagctcaggaattcaagaccagcctgggcaacacggcgaaaccccgtctttacaaaaaatacaaaaattaggcaggcttggtggtatgtgcctgtagttccacctacttagggggctaaggcaggaggattgcttgagctcaggaggtctaggctgtagtgagccgtgatcacaccactgcactccagcctgggcaacaaaaacttaccctgcctctaaaaaaaagaaagaaaagacaatcctgcctcaagacacttttttatatttagagacggagtcttgctctgttaccaaggctggagtgcagtggtgctctcaaggctcactgcagttttaacctgggctcgcagttttaacctgggttcaagtgattctcccgcctgagcctctc

SEQ ID NO: 729576 - DNA, 1793 bp, Homo sapiens; identical to SEQ ID NO: 23731

SEQ ID NO: 729577 - DNA, 836 bp, Homo sapiens; identical to SEQ ID NO: 23734

SEQ ID NO: 729578 - DNA, 1579 bp, Homo sapiens; identical to SEQ ID NO: 23733

SEQ ID NO: 729579 - DNA, 506 bp, Homo sapiens
ggcgcttgcttcaggtggagtctgttagtttttgagaaagagttagggcgagtttaaggggcactgtggcagctgtgagataaagtctggttcctccccagctggctcaggaaatgttcgcggatacaacggcggccccctctgggcatacctgcctgtggagcggagagtggacggtgtgagggggaccgggagaggcaccaaatctggcctgggggcccgagaagcttcctctcagtgaccacaatatgaatgggaacagcaagatggcaaaagcttgctgagtggtacagcgccagcctgggtagtggcctccccagcaagttgcatgtcactagcttcctgtggctgtcactcctgggcccaggcacctccgaagatcagcacctcctcatgggctcaagcgaggacaggagcccgtcacccatgagctctcaagggcagagccactgtcctgtctcgatggctccaccgtgactccagtggactttggacagtggggagca

SEQ ID NO: 729580 - DNA, 509 bp, Homo sapiens
ggcgcttgcttcaggtggagtctgttagtttttgagaaagagttagggcgagtttaaggggcactgtggcagctgtgagataaagtctggttcctccccagctggctcaggaaatgttcgcggatacaacggcggccccctctgggcatacctgcctgtggagcggagagtggacggtgtgagggggaccgggagaggcaccaaatctggcctgggggcccgagaagcttcctctcaggtggggtggcgtgagagtcgaggcctggaggtcggggagggttagctacgtgaagaggggattctgccgcgcttcaggtgcctggaggggatgcccgagctcttccgcagggctagggtgaagccagccagggcctgggggaaaggtagcagaggtttgccatggcttggtatttgagggactttacacatcgtattaagggtttgagcttcaacttggggtcgtcgggagccattgaaggttttttgttgtttgttttttgagacggggt

SEQ ID NO: 729581 - DNA, 800 bp, Homo sapiens
tggaaaatccctatgtcacctgaccaattcctcctgactgttagcgccctgcagcacgcccgtaattccggggaatttgcctatccctgtaggccccaaacagaaattactgatgtctggggaccttcaatttcatacccaaggaaggtcttgaatttcaaaggaaaatcaatccaacgtgcagttgatcggttgagattgagcaatcctcctatagatgtgaaacgaaccagtattccccttgaaatccagaaactgcagcccaacttgaagatctctttgcacagtcctagagcccagtccaccatacccgagcccatgattatccgctccaggttctctggcagcttaaagggtggagaccaagtgaccagttcaattgaaagggctgtgtgcagtacgggtcccctgaccagtatgcaggtcattaaaccaaaccgcatgctagctccacaagtgggcacagccaccctgtctcttaagaaagaacggcctcgcatctatacagcccttgatccttttagagtgaacgctgagttcgtgctgttgaccgtgaaggaggagaaggagcaccaggaagccaagatgaaggaatatcaggccagggagtccactggagtggttgatccaggaaaagccagcaaagctgcatggatcaggaagatcaaaggcctgcctattgataatttcacgaagcaagggaaaacagcggcccctgaacttggacaaaatgtatttatctaaaccagccttgggaaattacagtgttttacaataaacagaaagccaagcggaaaaaa

SEQ ID NO: 729582 - DNA, 542 bp, Homo sapiens
agagggcagggatcccggccctgtgcaggactctgtggctcctggtagaagacaaccacccttacagatggaagatgctggaatacgggttctcgctgcaagtgtgtttgagccttggagccaggcagtgtttgcgtgtccccctgggaccctggaccaccatgaggagagcttgcagtcctcacaagtgcagcctctcaaaggtcaagggtcaggagggtcagggacaccgcctgcaaggacacacatggctcctgtagccaagtggccctgtgtggcctacaaagatctgctgagtggagaccagccaggagcagcttcgcccagggctgctgaggaggaagccattgtggggaacagggtcagaacatgaccctggaccgaggtcgagggggcacatccagacgcacacgaaactgaaacctgtgaaacccaggaaaatggcacctccttcatgctttccagaagaaggggtgcatggagcagggatcccggttaggtcttaaaaatctcgccacaaagcgtattttctcagaaaaata

SEQ ID NO: 729583 - DNA, 801 bp, Homo sapiens
tttggacgcagaccaagattgacaagcaaacttaatacctcaccaacacaggtctctgtaaatgtagctaaaacattctcagaaaatgtacataaaacgatgactactgaaaatagagtatcttcaaggagtatcgaaagtaaagatatcttaacaaatctacagtctgacctattgtcatcttcctgcttaaaagaaagcacaggtgaagtgagcaaagatgcagtcattgtaaagcaggagaaaaataatgaatattgccttcaggatattgatgataaattgtcagaatcagcagaggatgatggtgaagatgataccaatgatgaagatgatgatgaagatagtaaccctaaaaagaatactcaggccccactagagttaatggcagaatttctgagagcagaaatggcccgagagtaccagctggcaaaaaaattatgtcagatgatcctaatctatgaaccagaaaatcctgaggccaaggagtttttcacacttattgaagaaatgttgctgatggagaaaactcagaatcatgagcaagacggtgaaaacagtgatgaagacagcagtggtgagagtaaaggagaaagcgatgaggagctgagtgacgagagctctgacgaaggtgaagatggatcatgagtgttgctgcaatacttgaagcttcatgtattttcattaatgtataccatgcaaatataaagacaagtgacattttagtctaattcttccttatttggtacagtttcttttaagttatctatattcttggcttaagactcttcctaatattta

SEQ ID NO: 729584 - DNA, 656 bp, Homo sapiens
gtgaagtgagcaaagatgcagtcattgtaaagcaggagaaaaataatgaatattgccttcaggatattgatgataaattgtcagaatcagcagaggatgatggtgaagatgataccaatgatgaagatgatgatgaagatagtaaccctaaaaagaatactcaggccccactagagttaatggcagaagtaagttttacttgtgcatataattgaagaaactttaaaatattgaaataactaaagactgaagatttaaaatcactactgtgagaactaaaaaagtagatctcatggaggcagaacatagaatggtggttaccagaagctggacgggaagaagggagataaagagaagtccattaaggggcacaaaaatacagttagatggaaggaataaattctagtattcagtagtacagtagggaaattatagttaacagtagtttattgtatactttagccagaagagaaaaattgtaatattcccagcacaaagaaaagataagtgtttaagatgatggataatccaattgccttgatttgatcatcacacattgtatacaagtatcaaacatgtacccccaaaatgtatacaatattatatatcaataaaaaataaacatttttaaaaattaataaaaagatccttgtcca

SEQ ID NO: 729585 - DNA, 373 bp, Homo sapiens
gtacccgtggagatccaaactcctctcacccaagccccaaagcacttctcccaatgctgctgccgtgcctgaatcccgcccacgcgtgagaatcaccccattattacagaagacccctgtcaaatgcacacgcgttaaccacgtgttacccaaggacgactcagtcatcctttaggactcggtgatacattagcacagatgaacctggcactgaggtgggatgaggtggggagatcttttggccgcaggtcatttaggatattgttattactgcaaagaccacagaacagccatggtttagtcacttattccttgccaggagcttcgtctcattgtctcttttaataaacaatattttgagatcaaaaaaaaa

SEQ ID NO: 729586 - DNA, 388 bp, Homo sapiens; identical to SEQ ID NO: 719969
  misc_feature (74)..(75): n is a, c, g, or t

SEQ ID NO: 729587 - DNA, 531 bp, Homo sapiens
tccaatttcagagaccacaaggtcgggagcgcctgcggaggcttctgaactgggaggagtttgacgaacagagagactcccggaggagcatcctgctggacaccctctacgagagcatcatctttgcagtgggcaaaggcttcccatgggtggaggtggcccaggtggtcaagttcacagaagagctgctaagggaaaccaaagtgacaaagagaaaggaatactcttacagggaagaagctgacagctgcctccttagtcaaatgatccaagtggacattgtcagtaaaaggccacacacagaatcccgtgtgcctggtcagacgcagtgagcagccagcattctcctgtgatggttccaacaaagactcatggcccgaatctaatcaagagaaaacagcaaagtaggaccatggctcaaagtagccctcctgccagcttcaaatactcgaaggccataagagcccagcaaagactgataaacctttccaaactgaaagaggcgaagggatgtcttcacacgtgaaaaaa

SEQ ID NO: 729588 - DNA, 624 bp, Homo sapiens
tccaatttcagagaccacaaggtcgggagcgcctgcggaggcttctgaactgggaggagtttgacgaacagagagactcccggaggagcatcctgctggacaccctctacgagagcatcatctttgcagtgggcaaaggcttcccatgggtggaggtggcccaggtggtcaagttcacagaagagctgctaagggaaaccaaaggctgctccattactgaggctgtgacgatcctggggaacaagcttagagattaccggggccatttcaacaccacccacctgctggccctctgtgactacttccaccacaccttcatccgccactacaaactctaccagtatgtcctgggccaggaccagcaggtcgacctgaccgttgcccacctggaggtgtgcatgccacccctatcccgccccccatcaccagccacgcaggccaggaggaagccctgaagccccaaagagcgagcaaaggaaagaaagcgaaggcaaggaagtagaaggtcccgactgccacacgagactgactggggaccagccacccataaccatgacttgcggcacggtgagctcagcacccacagagagacttcttgtgattaaaagaaacaaacccataaaa

SEQ ID NO: 729589 - DNA, 1550 bp, Homo sapiens
cggcggagggggtgatatgactacatacatggcagaaagtggaaacctcccagggatattgttcccacgatcctggagggaagaagatgatgttactttcaatatgacagaagacacagagacaaagtgtaaagatacaacagtgggtccaggggaccggcgctcagcacaccaaggacctgcaccggcaccagcctctgagttccttcagtttttattgattatgattttcattattttagcagaaaggaatgtagtaggagagcagggtgatgataaggagagtctgcagaagacatctgcaagaggctttcctcttttactaatccacctcagcacagaccctttacgggtgtcgggctgggggacagtcaggtctttctcatcccatgaggctatatttcagactatcacatggggagaaagcttggacgataccctgctttcaagggcagaggtccctgcggctttccacagtgcattgtgcccctggtttattgagactagagaatggcgatgacttttaccaagtatactgctgatggacacgcccccactgatattgtttttaatgcagcgtgggaggggaggatatgacacgcgatatcgcaagtagtagaaacacccctttgatagtgttcttaatattcagggaggaagaagatgatgttactcccaatacagacggatgtacaccctctgtacaccgagggtgtacacccgtctgtgaaggagttcgtaatctccagaggtggagatgatattactcacaatatggtaaacaggctgtgagtccatcgcggatcctcagagccaggtggggaagaggggctggctgtcagtcccctcctcgcggggggtgcctcccccactgctatggggatcccaagagccagtgggggaagaggaccatggcctaaaccaggactatcccaggaagcctgggacatatttgtaccccatctctatttaatgcctttatacaattctttacttaattctaccagcctttattgagcctgctttctttgtctagctgagtgccacgtgctgacgtcactaagatcaatacagcaaactctgaaagatggacagagagacaggagatggtcctttataatgcagtgtgatctgtgctgcaatagagatggaagagtgttctgatcggctggaaaacaacgcacatgggaagctgtacagaaatgagtggggaaagttttggaagctagaagttcaaaacgaggtgttggcagcaccatgctctctccgaagatgctaggaagaatctgctccatgcctttccattcgcttctggggtttcctgcaagccctgacattccttggcttgtagatgcatcaccccagtttccgcccccatcatcacatggcctcctctctgtgtgtgcctctgcgttccctctattcttcttctaaggacaccgacaccagtcatagtggattaagtgtccactcctaaccaattacatctgcaacaaccctatttccaaataaagtcacattctaagattcctagggagaacatgaatttt

SEQ ID NO: 729590 - DNA, 574 bp, Homo sapiens
gaccatggcctaaaccaggactatcccaggaagcctgggacatatttgtaccccatctctatttaatgcctttatacaattctttacttaattctaccagcctttattgagcctgctttctttgtctagctgagtgccacgtgctgacgtcactaagatcaatacagcaaactctgaaagatggacagagagacaggagatggtcctttataatgcagtgtgatctgtgctgcaatagagttttggaagctagaagttcaaaacgaggtgttggcagcaccatgctctctccgaagatgctaggaagaatctgctccatgcctttccattcgcttctggggtttcctgcaagccctgacattccttggcttgtagatgcatcaccccagtttccgcccccatcatcacatggcctcctctctgtgtgtgcctctgcgttccctctattcttcttctaaggacaccgacaccagtcatagtggattaagtgtccactcctaaccaattacatctgcaacaaccctatttccaaataaagtcacattctaagattcctagggagaacatgaatttt

SEQ ID NO: 729591 - DNA, 435 bp, Homo sapiens
gacttttttttttgagacagagtctcactctgtcgcctaggctggagtgcagtggcatgataaacactcattccagcctcaaccttctgggctcgagtgatcctcctgcctcagcctccaaaatagctgagactacagatgtgtgccaccatgcccagttaatttttgtattttttgtacagacagggtttcgccatattgcccaggctggtctcgaactcctgggctcaagtgatccttccaccttggcctccccaagtgctgggattacaggcatgagccaccacgtgcagccaggtttttaaaactttttatttctaaataactagaaatgtacagaaaactagaaagcatagtacagacactcccacatactttttacagagattcaactttttaacaattacatttgctttatgattctctgtgtgtgta

SEQ ID NO: 729592 - DNA, 620 bp, Homo sapiens
acaataatctgagttatatgttaatttctaaaagaataaatgaacccattacttcccagatttcacagaagccacttgcttggagcagactaccatgacaagccagtctcaggggatccaccagcttcttcaggcagaaaaacgggccaaggacaagctagaggaagccaagaagagaaaaggaaagcgattgaagcaagccaaggaggaagcaatggtagaaattgaccagtacagaatgcagagagataaagagtttcgactaaaacaatctaagataatgggctctcagaataatctctcagatgaaatagaagaacaaacactagggaagatacaagaacttaatggacactacaataagtatatggaaagtgtgatgaaccagctcttgagcatggtctgtgacatgaaaccagaaatccatgtgaactacagagccaccaactaaatgtacatcacagttttcaagaaaaaaaaaggtgtgtgagtgccacctggttgcttatggcttcgtatttttatgttgagaaatttgaaatgagaaccttaaatttacatttacaggaaatgtgacataactcatacatcggcactgaattaaacaaaacaaaatacaa

SEQ ID NO: 729593 - DNA, 687 bp, Homo sapiens
tattcattatttataagtagatgcaacacctcatttatacctccttatctcatacagaagagctaagattggcagaaatgatttcacagaagccacttgcttggagcagactaccatgacaagccagtctcaggggatccaccagcttcttcaggcagaaaaacgggccaaggacaagctagaggaagccaagaagattctgcatctacttttcctaaaacgaagagactgggactgcttctggaaaaggaaagcgattgaagcaagccaaggaggaagcaatggtagaaattgaccagtacagaatgcagagagataaagagtttcgactaaaacaatctaagataatgggctctcagaataatctctcagatgaaatagaagaacaaacactagggaagatacaagaacttaatggacactacaataagtatatggaaagtgtgatgaaccagctcttgagcatggtctgtgacatgaaaccagaaatccatgtgaactacagagccaccaactaaatgtacatcacagttttcaagaaaaaaaaaggtgtgtgagtgccacctggttgcttatggcttcgtatttttatgttgagaaatttgaaatgagaaccttaaatttacatttacaggaaatgtgacataactcatacatcggcactgaattaaacaaaacaaaatacaa

SEQ ID NO: 729594 - DNA, 676 bp, Homo sapiens
atttcacagaagccacttgcttggagcagactaccatgacaagccagtctcaggggatccaccagcttcttcaggcagaaaaacgggccaaggacaagctagaggaagccaagaagagaaaaggaaagcgattgaagcaagccaaggaggaagcaatggtagaaattgaccagtacagaatgcagagagataaagagtttcgactaaaacaatctaagataatgggctctcagaataatctctcagatgaaatagaagaacaaacactagggaagatacaagaacttaatggacactacaataagtatatggaaagtgtgatgaaccagctcttgagcatggtctgtgacatgaaaccagaaatccatgtgaactacagagccaccaactaaatgtacatcacagttttcaagaaaaaaaaaggtgtgtgagtgccacctggttgcttatggcttcgtatttttatgttgagaaatttgaaatgagaaccttaaatttacatttacaggaaatgtgacataactcatacatcggcactgaattaaacaaaacaaaatacaactgttgctatatcttttctagtaataattatgaccttgtcacttaacttggagtaagtcaagaatgcaaaatagtaacatgttttttaacacttgaaagaaaaacatggtcatga

SEQ ID NO: 729595 - DNA, 722 bp, Homo sapiens
atttcacagaagccacttgcttggagcagactaccatgacaagccagtctcaggggatccaccagcttcttcaggcagaaaaacgggccaaggacaagctagaggaagccaagaagattctgcatctacttttcctaaaacgaagagactgggactgcttctggaaaaggaaagcgattgaagcaagccaaggaggaagcaatggtagaaattgaccagtacagaatgcagagagataaagagtttcgactaaaacaatctaagataatgggctctcagaataatctctcagatgaaatagaagaacaaacactagggaagatacaagaacttaatggacactacaataagtatatggaaagtgtgatgaaccagctcttgagcatggtctgtgacatgaaaccagaaatccatgtgaactacagagccaccaactaaatgtacatcacagttttcaagaaaaaaaaaggtgtgtgagtgccacctggttgcttatggcttcgtatttttatgttgagaaatttgaaatgagaaccttaaatttacatttacaggaaatgtgacataactcatacatcggcactgaattaaacaaaacaaaatacaactgttgctatatcttttctagtaataattatgaccttgtcacttaacttggagtaagtcaagaatgcaaaatagtaacatgttttttaacacttgaaagaaaaacatggtcatga

SEQ ID NO: 729596 - DNA, 707 bp, Homo sapiens
  misc_feature (688)..(688): n is a, c, g, or t
  misc_feature (706)..(706): n is a, c, g, or t
cgctaacggttaaaggatgagcctccattcactaacaatttcgattaaggaaataaccattggggatgggcgcggtggctcatgcctgtaattgcagcaccctgggagggtgaggtgggcagactgcctgagcccatcagttcatgtccagcctgggcaacaagagcaaaactccatctcaaaataaagtgaggggtgtttatccttacggtaaccatgaaaagaaacttccgacagacagaaaggcaaacagaacgggcagatgtgagactgcaagtatgactgtccatggtggtcagtttgcaaagcactgcttctcgtattttctctgaaagccacagtgcctcttagtgttctctagacaccaaatttcaggtaggccggatgcagtgattcctgcctgtgctcccagcactttgggaggcagaggcgggcaaatcgcctgagctcaggagttcaagaccaactggggcaacgtggtgagaccctgtctctacaaaaaatacaaaaattagccgggtgtggtggtgcacgcctgtactcctggctactcaagaggctgaggtgggaggatcacttgaccccaagagtttgaagctgcagtgaggcaagattgtgccactgcactccagcctcagtgacaaatgagattctgtcgacaaaaaaaaagaaaaaggcggccgctcgnattgtcggacgcggccgng

SEQ ID NO: 729597 - DNA, 5260 bp, Homo sapiens
  misc_feature (185)..(185): n is a, c, g, or t
  misc_feature (246)..(246): n is a, c, g, or t
  misc_feature (294)..(294): n is a, c, g, or t
ggtggacgaggacgctcagagcccagctctcgagagttcaagcaaccgacggttccccactgctcccaggagcggttacctgggcactctgtgcccctccttcctgttcgggcccaggccgaggacctgccagtagggctcagttgcctggagcccgttcagcccatcccccagttcactttgcntgtgggatctccccgttgctcctgcccgtggactgagtggcaggccatcctacaagcaccnggacacttgacatcagtggtgtcaagacaactctaagaaggttttccntgatcctgcaagccctgccttccttcctgggatcctgccttcaatttgattgcacaggtaccacagcaagccagtgctgtgtgctccgagttccagggcgtcctccagctcagccactgcactgagaacatggactctctgtggggcccaggagccgggagtcacccctttggggtccacaacacccggctgtccccagacttgtgtccagggaagatagtgttgagggccctcaaggagagcggggcagggatgcctgagcaggacaaggaccctagagtccaagagaatcctggtgatcagagaagggtccccgaggtcaccggggatgcacggcctgcatttcggcccctgcgggacaatggaggcctctctccctttgtgcccgggcccgggcctctgcagacagacctccatgcccagaggtcagaaatcagatataaccagacatcccagacctcctggacgagctcctgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcaggtcacacccagtgtgaaaaggcagcagatatagcaccagggcagacactcaccctcaggaatgactcctccacatccgaggcctctaggcccagtacacacaagtttcccctgctgccacgcaggcgaggggagcctttgatgctgccacctcccttagagctggggtaccgggtcactgttgaagacctggaccgggagaaggaggcggccttccagcgcatcaacagtgcactgcaggttgaggacaaggccatctcggactgcagaccctcacggccttcccacactttgtcctcacttgcaacaggggcttctggtctgcctgccgtttctaaagcacccagtatggatgcacagcaggagacacacaagtcccaagactgcctgggcctactggaccccttagcatctgctgcaggggtcccctctacagctcccatgtctgggaagaagcacagaccaccaggccccctgttctcctcctcagatccccttcctgccacctcttctgattcccaggactcagcccaggtcacctcgctgattcctgcccccttcccagctgcaagcatggatgcgggcatgagaagaacaaggcatggcacttctgctcctgcagctgccgcagcagcccctccccgctccacattgaaccccacgttggggtcactactggagtggatggaggcccttcacatttctgggcctcagccacagctgcagcaggtgcccagaggtcagaaccagagatcccagacctcctggaccagctcgtgccccaaatgaaatgccatctcgagcccctacagctctacgggaggcctcccggaacaaaagcggaagaggggccagcctcatcccactgccagctgaccctcagttcctcaaacacagacccagggtgcatgcccatctccagcccagggcagctcccctgtaagctgggtgagctactgaagccaaggtgggaggcagctgacaacaccacccacggcccatgcagaggtggtagaaaggctggactcagcaggaacaccaaatcccggaccaggcagaaaccacccaagactgaggggctcgtgccagagcggtggccacagggctgaatggtcgctgagacagagatggaagccaggacaagggagcccaccgggcccagatagagacttcagaacccactcctgagaacagcggagccaggcgcttagaggaagaccaaatgctgccaggacacggattgtccagggattacattccagcatcttattagaggacggaagcagagggtgctgtttcaacgccaccaccaggagagaggcagaggggctgtgccgtgctagagtcctcagggagggagtgacctcgaccctggctgtgctgcaagctgactccagccttgggctcagcagcacccggtgaacagcagcaggaggagccgctagagcagctgctcatgggcagagcagcccttgggcaactcctgccaccaccccctccccagggagcccaaggcaggggaggctcagcatggaatgaaacaggggagtgagggacacaaggaggtgggaagtgggagggtcccagccccaccaagtacgcagagaccccctcgtcgtcctggacaccacaggggcacctgcaggctgggagaccaggtcctctgtgcatgggcccgggaggcagacctgccccaagggtgatgcagaggccacaggtgctgcacgctccagcgcccactctagacatcagcctccaggttgactaagggtcaggtcatgtttgaaaccatgcttggctggaccgggacccatggcaagagcacctgggcaccagtgtttagccctggtctgcaggaaggaggacagcagactttaggaccccacagcatggcagtgctgaccatttcacccacttggcctccttgaggaatagggatggggagccctctggggatgagcaaggccttccaggacaggctcggttctggtcccctgctttttgaggttgggttaaaatgccgaccatggcagaggggtcacagctcaggttcccacacctcacttttcacagcctccaagggcagcagtgcacatggaggagacgtctcccacgaggccaaggcctccaatgctcaccgatgccctctgcgaagctggggtagaactcgtcagtgaagaggggctcaggcagctcacggaagtacagcttcagcgtgcctgcgatggcgttcatgtccgtctcgctcatcatcaccgacatgtccttcttatctggaaagagcacggaaatgcagcggcctccttgaagatcctgataaatgaagaaaagacacagagaaggatgtgacatgcctgggccatggagcactctgagatctcatcgcggacaccactgcccacacctccatcccgtcctgcgcaggccaacactcactgacatcgaaggctgccttcagtgcctggatgtctgcggccacaccggccggacacgtggtagatgcccacctcctccatgcctcggcgctcgatctcctccacgcactggcgcacgatgtagggcaccttggacctctctctcctgtgggaggggggaatgttctcagtgtcctaacagccctgcttgggccataacacaggagacctgctccctatctgcgcacccggaggtggggtgaggacggtgacgaaggtacccaggtctggggctgcacacagagccttctgcatgcctgtcctccctctgcaagctctgtcttcacggcatgtgctttctcaggaacctttcaagcggccagaacccctgcgaatcacacatgacctttgcgggaaggtcaggaggcctgtctaagtcaagtcagcacgggaagggcatctgacagattccaggcctggggttagcagcctgtgcccccggctgggaggtcagacccggtgttggtcctgccacccacgtgctgtgtgagaggagaatccctgacccctgccctgggccttaacacacatccgacgaatgaatgaagggttgcctcagtaccggtgctccaagtcctgcgatgctaagtgcttttctcctctgagtcttagcaatggacaattccaatacctccacacaggacactagagtaagaaaccttcacagttagaacgcagtgctgtgcggaggccttaacttgagttctgttttgcacctggatttaccagcacatcaaagctgcttcgcaagccccctcattagcagggcttatctgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctggggaagcaaatgaattctcagaggaagtggtctgtgtctgcatgaactgctctcaaaccaacaaacaggcttctcttggcaacagactcatgacaaaggattcaagattgtttgaaaaaaaaaaaaggggagcagggaggcagaaagtcctggaaaagtaaattgtttattttacaataagaaagtgattacatattttttttttttacaatggtggaaaattagaagtcattgtgaaaatgatgtctacctgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcagagattgcccccgctacactccagcctggtcgacagagtgaactctgtctcaaaaaaaaaaaaaaaagaaaagaaagaagaagccattcccaacgttgctcatcaaattatgaccataaatttccaggatcagactaacggctaaagagactgatgcatcaacaccaggcagagaataaagcagatttttttgttgttgttctggagagcttctaggaacttgaaaaatacatatgccacactcttaagacccggtggttcttaatcagggatgttcattaaaatgctggaaaactgtaaagacttccaggtcccatccaaggagattttgcttctgattgactggctagtggcctggccattggtattttgaaaaatccctccaagtgattcttttacatcccagatagaaaaccctaaattaaaggtgaaaaaaccagacaccaagtggcatttaaataaatgtcaactttaactcc

SEQ ID NO: 729598 - DNA, 1480 bp, Homo sapiens
tgtcgtgtgagccttgctctcctggggaggctcaggctgacggctgatgtgggcattgccgagggtaacctgtggcccagtgtatatggccgggtctcctcaagctgcattcattcaagtaggacccagggtgcatgcccatctccagcccagggcagctcccctgtaagctgggtgagctactgaagccaaggtgggaggcagctgacaacaccacccacggcccatgcagaggtggtagaaaggctggactcagcaggaacaccaaatcccggaccaggcagaaaccacccaagactgaggggctcgtgccagagcggtggccacagagacttcagaacccactcctgagaacagcggagccaggcgcttagaggaagaccaaatgctgccaggacacggattgtccagggattacattccagcatcttattagaggacggaagcagagggtgctgtttcaacgccaccaccaggagagaggcagaggggctgtgccgtgctagagtcctcagggagggagtgacctcgaccctggctgtgctgcaagctgactccagccttgggctcagcagcacccggtgaacagcagcaggaggagccgctagagcagctgctcatgggcagagcagcccttgggcaactcctgccaccaccccctccccagggagcccaaggcaggggaggctcagcatggaatgaaacaggggagtgagggacacaaggaggtgggaagtgggagggtcccagccccaccaagtacgcagagaccccctcgtcgtcctggacaccacaggggcacctgcaggctgggagaccaggtcctctgtgcatgggcccgggaggcagacctgccccaagggtgatgcagaggccacaggtgctgcacgctccagcgcccactctagacatcagcctccaggttgactaagggtcaggtcatgtttgaaaccatgcttggctggaccgggacccatggcaagagcacctgggcaccagtgtttagccctggtctgcaggaaggaggacagcagactttaggaccccacagcatggcagtgctgaccatttcacccacttggcctccttgaggaatagggatggggagccctctggggatgagcaaggccttccaggacaggctcggttctggtcccctgctttttgaggttgggttaaaatgccgaccatggcagaggggtcacagctcaggttcccacacctcacttttcacagcctccaagggcagcagtgcacatggaggagacgtctcccacgaggccaaggcctccaatgctcaccgatgccctctgcgaagctggggtagaactcgtcagtgaagaggggctcaggcagctcacggaagtacagcttcagcgtgcctgcgatggcgttcatgtccgtctcgctcatcatcaccgacatgtccttcttatctggaaagagcacggaaatgcagcggcctccttgaagatcctga

SEQ ID NO: 729599 - DNA, 2162 bp, Homo sapiens
taaatgaagaaaagacacagagaaggatgtgacatgcctgggccatggagcactctgagatctcatcgcggacaccactgcccacacctccatcccgtcctgcgcaggccaacactcactgacatcgaaggctgccttcagtgcctggatgtctgcggccacaccggccggacacgtggtagatgcccacctcctccatgcctcggcgctcgatctcctccacgcactggcgcacgatgtagggcaccttggacctctctctcctgtgggaggggggaatgttctcagtgtcctaacagccctgcttgggccataacacaggagacctgctccctatctgcgcacccggaggtggggtgaggacggtgacgaaggtacccaggtctggggctgcacacagagccttctgcatgcctgtcctccctctgcaagctctgtcttcacggcatgtgctttctcaggaacctttcaagcggccagaacccctgcgaatcacacatgacctttgcgggaaggtcaggaggcctgtctaagtcaagtcagcacgggaagggcatctgacagattccaggcctggggttagcagcctgtgcccccggctgggaggtcagacccggtgttggtcctgccacccacgtgctgtgtgagaggagaatccctgacccctgccctgggccttaacacacatccgacgaatgaatgaagggttgcctcagtaccggtgctccaagtcctgcgatgctaagtgcttttctcctctgagtcttagcaatggacaattccaatacctccacacaggacactagagtaagaaaccttcacagttagaacgcagtgctgtgcggaggccttaacttgagttctgttttgcacctggatttaccagcacatcaaagctgcttcgcaagccccctcattagcagggcttatctgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctggggaagcaaatgaattctcagaggaagtggtctgtgtctgcatgaactgctctcaaaccaacaaacaggcttctcttggcaacagactcatgacaaaggattcaagattgtttgtacaataagaaagtgattacatattttttttttttacaatggtggaaaattagaagtcattgtgaaaatgatgtctacctgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcagagattgcccccgctacactccagcctggtcgacagagtgaactctgtctcaaaaaaaaaaaaaaaagaaaagaaagaagaagccattcccaacgttgctcatcaaattatgaccataaatttccaggatcagactaacggctaaagagactgatgcatcaacaccaggcagagaataaagcagatttttttgttgttgttctggagagcttctaggaacttgaaaaatacatatgccacactcttaagacccggtggttcttaatcagggatgttcattaaaatgctggaaaactgtaaagacttccaggtcccatccaaggagattttgcttctgattgactggctagtggcctggccattggtattttgaaaaatccctccaagtgattcttttacatcccagatagaaaaccctaaattaaaggtgaaaaaaccagacaccaagtggcatttaaataaatgtcaactttaactccacaaagcatctggttgcatgtggacagaaagagaaggaaagagggccctatatttggataacttagaaatgtgctccccctagcaagatatctaccaaaattaaaaccatatttgaggatgctggcactgcgagtaatatataaatgatgcatgtaacgtcatttaatatgatcttatttttaaaaatgaaaaaaaaa

SEQ ID NO: 729600 - DNA, 2205 bp, Homo sapiens
taaatgaagaaaagacacagagaaggatgtgacatgcctgggccatggagcactctgagatctcatcgcggacaccactgcccacacctccatcccgtcctgcgcaggccaacactcactgacatcgaaggctgccttcagtgcctggatgtctgcggccacaccggccggacacgtggtagatgcccacctcctccatgcctcggcgctcgatctcctccacgcactggcgcacgatgtagggcaccttggacctctctctcctgtgggaggggggaatgttctcagtgtcctaacagccctgcttgggccataacacaggagacctgctccctatctgcgcacccggaggtggggtgaggacggtgacgaaggtacccaggtctggggctgcacacagagccttctgcatgcctgtcctccctctgcaagctctgtcttcacggcatgtgctttctcaggaacctttcaagcggccagaacccctgcgaatcacacatgacctttgcgggaaggtcaggaggcctgtctaagtcaagtcagcacgggaagggcatctgacagattccaggcctggggttagcagcctgtgcccccggctgggaggtcagacccggtgttggtcctgccacccacgtgctgtgtgagaggagaatccctgacccctgccctgggccttaacacacatccgacgaatgaatgaagggttgcctcagtaccggtgctccaagtcctgcgatgctaagtgcttttctcctctgagtcttagcaatggacaattccaatacctccacacaggacactagagtaagaaaccttcacagttagaacgcagtgctgtgcggaggccttaacttgagttctgttttgcacctggatttaccagcacatcaaagctgcttcgcaagccccctcattagcagggcttatctgggggagctgctgatggagtcctcgctgctcatgcccacagccctcccagagtgctatgcgattgggggtggggcgtggtgtttagacacagataggagtccagggtatgactgatggaggccccggcccacgtgaccagcaaggtcagaggcccagccagattccatcctggggaagcaaatgaattctcagaggaagtggtctgtgtctgcatgaactgctctcaaaccaacaaacaggcttctcttggcaacagactcatgacaaaggattcaagattgtttgaaaaaaaaaaaaggggagcagggaggcagaaagtcctggaaaagtaaattgtttattttacaataagaaagtgattacatattttttttttttacaatggtggaaaattagaagtcattgtgaaaatgatgtctacctgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcagagattgcccccgctacactccagcctggtcgacagagtgaactctgtctcaaaaaaaaaaaaaaaagaaaagaaagaagaagccattcccaacgttgctcatcaaattatgaccataaatttccaggatcagactaacggctaaagagactgatgcatcaacaccaggcagagaataaagcagatttttttgttgttgttctggagagcttctaggaacttgaaaaatacatatgccacactcttaagacccggtggttcttaatcagggatgttcattaaaatgctggaaaactgtaaagacttccaggtcccatccaaggagattttgcttctgattgactggctagtggcctggccattggtattttgaaaaatccctccaagtgattcttttacatcccagatagaaaaccctaaattaaaggtgaaaaaaccagacaccaagtggcatttaaataaatgtcaactttaactccacaaagcatctggttgcatgtggacagaaagagaaggaaagagggccctatatttggataacttagaaatgtgctccccctagcaagatatctaccaaaattaaaaccatatttgaggatgctggcactgcgagtaatatataaatgatgcatgtaacgtcatttaatatgatcttatttttaaaaatgaaaaaaaaa

SEQ ID NO: 729601 - DNA, 3615 bp, Homo sapiens; identical to SEQ ID NO: 2119
  misc_feature (185)..(185): n is a, c, g, or t
  misc_feature (246)..(246): n is a, c, g, or t
  misc_feature (294)..(294): n is a, c, g, or t

SEQ ID NO: 729602 - DNA, 887 bp, Homo sapiens
aattttggcttcagtttcatgtaaacgttttatatatacaaaacagatatgaagcaaaacaaagtaatacaacacatttccaaaatgtaaaaatgaaaactgaacaattaaactagctgtataaatgttggcatgaacaaatagagaaaaattatatcaaatgattttgtggaaaaagtattctgattatgtacccaaaaaggaaagaaagagagagaaaagcaaggaaggaaggaggaaaacaaggaaggagaatggatggaaggaaacaagggaggaagggaggaaaggatggatggagggagggagttagggagggagagaaaaataaaaacaagcaaagaagtaagaaaaaagagagagagaataaaagggagggcagagggagaccatgttcaactgcatacctgggcctagtgttttagtggtcattatagtattgcttatgttgttatagacataaggaataagcaccactctcagctgtgatctctggaccatgactggatacatgattcagtataaatacccttcccatttgctgtccaaaatatctcgcttcacagctggaccctagttgtacctgtgtgtcataggaagcagagtgagtgggcctcccccatgtcctaggagagctgagagaaccttgctctcagccaggctgcttagctgaggcctggagatggcagcttgatcttcaggaaagttgtgggggaggggtggggaacagggtgcggctgctgccaggacagtgtgatattaggagggagatcaggagttaagctgtctttctcttgttcagaatacagtaaatttggtgacaggaaatgagagggggcggctctatcctgtgaaccagaggcagccacaaggcagattttcagtgt

SEQ ID NO: 729603 - DNA, 372 bp, Homo sapiens
aacaagcaaagaagtaagaaaaaagagagagagaataaaagggagggcagagggagaccatgttcaactgcatacctgggcctagtgttttagtggtcattatagtattgcttatgttgttatagacataaggaataagcaccactctcagctgtgatctctggaccatgactggatacatgattcagtataaatacccttcccatttgctgtccaaaatatctcctctgaaagctgagttctcgggtccttgtgaaggagggaagcttgcctgccttggagcgtgaaaaagtcttgctggacagaagtctcacggtttaaaaatgggaagggagaggattgagatcacactagaatgcacagaaaattctt

SEQ ID NO: 729604 - DNA, 1168 bp, Homo sapiens
cctggtccaaagtggacgagaatcccattgttaagacatgtctcattaagacttctctaagatggagccagcaaacagcccagtagcatcgaggctgctgcctgggaaagagtcccctcctctcccctgttcattaatgattatgggaggttttattccccccaacaaaagtgttaattagacatcatcggaacagggatattacacaaatgaattaaactcaaaccaatcaacaagctggctctgtgcttcaggtcccccgaacgaaaagggaattgaaggctgtaatgggaaacaaacggtaagatgtctttcctaatatcaaataataactaggaaggctgcctttgcttctagaacttgtcttcttattcttttctttctcccctccactacacacacacacgcgcgcgcacacacacacatgcacacacacgcactgccatgaggcttggagagttagggttccattcttgtgactgaaactgaaactggctgggactgcccagtggtacttctcaggtgccctctaggctcaggggccaagtgggatggaaggagtcagaagagcccagttccagtccctctctgtcactcaccaccttcctcatcagagaatagtgtgtgtaatgctcaggagttcacagggatgcagtaggtactcaatacttacctgctgtgtccaaatggctgggcgacttctggaagcattctgtgccctggcagcaaattcctgaggctgattgacccctgtggggagagtgggaagaactggagggaaaagagttttagtccttgtattttgagggatcccagttgcttggagggatagataaagaagattgaaaagtcttctaaaaatggacagatgaagccagtgcaatggctcatacctgtaatcccagcactttgggaggcagaggcaggaggagcacttgacccccaaaatttgagactagcctgggcaacagggttagaaaccatttctacaaaagaaaaacaattagcctggtgtggtggtgcatacccttggccccagctacttgagaggccaaggtggaaggattgcttgagcctaggtggctgagcctgcggctgtgatcacacaactgcactccagcctgggcaacagagccagatcctataaatgagaaaaagaaaagaaaag

SEQ ID NO: 729605 - DNA, 793 bp, Homo sapiens; identical to SEQ ID NO: 275972

SEQ ID NO: 729606 - DNA, 568 bp, Homo sapiens
tgtgtgagtgaacattgcagcccgagctctgcctcctgtcagatcagcagcggcattagattctcataggagcgcgaaccctattgtgaactgcgcatgcaagggatctaggttgtgcgttccttattccttatgagaatctaatgcctgatggtgggataatttttatcctgaaacgatcacctttccccttccctacctgctgtggaaaaattgtcttccatgagactggtccctggtgccaaaaaggttaggaaccactgctttatcagatcttcagaggggacagggaatcaaattcgtataagaatcacagttctttatgatgtatatgctattttttgctgctaatctccagattttgtggatataaaatatattgtcatctgattttatttttttccaataaaatgtgatttcagtgatctttattttttctatctttaagtaatatatccctatactactatctcatcacttgtttaatttttgctaataagaatttgtcagttttactctttttttcccccaagggagaggcagctgttgggcagattccttttttttt

SEQ ID NO: 729607 - DNA, 460 bp, Homo sapiens
gcgtgggtgtgagtgtgcctgtgtgtgtgctcgtacagcagttgttatcatgatgtacttactggctgtctaccgatggctttcctttcattctactattttttggttgacttctgtgagctgtgagtcatcggtggtaacattatgcattgaatggattagctggtacctaaaaatagccgaggccctcatgcaggcggcacatgagcctgtagagtcagtccctttgcagccaaggcagacccacttgccaacattgaacatgccgagcttggtggcgatgaatcctaatgtatcaaaaaatagatagttggtgactgccctgtgtgcagagcccagccctggatttgtgccgcagttgttggtaatacacacttcctgtctgttctggtgctggaaaggctccaacagagaaactatgtcaaaccacatttttgtttgtgggtctttgtacctctct

SEQ ID NO: 729608 - DNA, 447 bp, Homo sapiens
cctaatacgttaagctgcttctccccatcatcaagaaactgccgcatctgccatataaaggagatgtttctcattcgcccccactcatctcttcccccatgaaaacctcttccattttcaaaggatcttcggctctacttttcaagcaaattcaacaaatcagtgtatgcctgtgtaactggtaaatagtgaagggtaattatttcatgtgcttctaactcagaaacaatggaatattaacagcggttttctgaagatccagttggacaattttcattttcatcatataatggacatttatctcctacctgcattatccactgtcttccctcggagaccacaaatttcactgaaggcagcatctatgtcttattcatgcttgtgctctctacctcccctgacccagaaggacttattcttctttctgcacattttagtagatgtgtt

SEQ ID NO: 729609 - DNA, 443 bp, Homo sapiens
ctccccgcctaggtttgttcgcggggcggggcgaggcaggatatcacgtgaccctgcgagtggctcagatccgaactggcggcctttctccccttcccccaccccaggtaaagaatttgagacacaagagattgagtaacttgtccgagatcacggctgtgtggtgcagaagctggattctgatctgcggcgggttggctccagaacgtgagttgttgaacacaattctggtgaaagacaacccaagatgttcgttaccctccacgggggacctactgaagatgtgctgctttagttgaatcccacaccacattaagtctctggcgaggcttcagccaccaccccctccccagcctccgccaaaaaaattgttttgataatttagtggaagaatattaaattgattttccttcagaataaaggctacttttcagtttgcagtt

SEQ ID NO: 729610 - DNA, 458 bp, Homo sapiens
ttaatcgtctgttccctacattcgaattttagctccccttggtggtcctcaccgctgtaaatctatgtctagcccagtgcctggcagccaagtcttcagttctagttgtagatgttttataggtaaagaatttgagacacaagagattgagtaacttgtccgagatcacggctgtgtggtgcagaagctggattctgatctgcggcgggttggctccagaacgtgagttgttgaacacaattctggtgaaagacaacccaagatgttcgttaccctccacgggggacctactgaagatgtgctgctttagttgaatcccacaccacattaagtctctggcgaggcttcagccaccaccccctccccagcctccgccaaaaaaattgttttgataatttagtggaagaatattaaattgattttccttcagaataaaggctacttttcagtttgcagtt

SEQ ID NO: 729611 - DNA, 1656 bp, Homo sapiens
cacggcagagtcgcggccgcccacagaggagccatctcagggagctcaggccaccaaaaagaagaaggaagaccggcccccgacccaggagaaccccgagaaaatcgccttcatggtagcgctaggcctggttaccacggaacatttggaagaaatccagagcaagcgacaggagcggaagagaagaagcacagccaaccctgcctacagcggcctcctggagaccgagaggaaacggctggcctccaactatctcaacaaccccctgttcctcacagcgagagccaatgaggacccctgctggaagaacgagatcacccacgatgagcactgtgccgcctgcaagcgaggggccaacctgcagccctgcggcacctgcccgggggcctaccacctcagctgcctggagccgcccctcaagacggcgcccaagggcgtgtgggtgtgccccaggtgccagcagaaggccttaaagaaagacgagggtgtgccctggactgggatgctggccatcgtgcactcttattcatccctggaccgcctgcgggccctcctgagactgatacagggcgagcagctgctccaggtcaccatgacgaccactagccctgccccactgctggccgggccctggaccaagccctcagtggcagccacacaccccaccgtccagcacccccagggccacaactgaccccgagggaccagtcttcatacccacggaaagttattgggaccctgcttacacagcctgggggttctgtcggccttaattcataaacactatgaatttcagacaaaaattaaccagacagaggagaggagggaggaagagctgggcgagaggcctagagccaggaccaggtgggggtgcggccctgtgccctccaaattcacagggggtacctaggagccaggtggggtacgacaggctggggcacacagtctccccccggccacctcggggctgcctgggcctctggcttccaggccctgctctccacggcctccctctggcccgttggaggggcaggctgaggctgtggaggggacaagcacgccccccagaacgcagtctccactgagggcaccgcctattggtgtcctgtgggagggcgagctgagaacacatggactagctgagtggtagcggtagttgggacgagaagcggggtagtggatctaggtagttcctcaatgccccacgctcctaggaggtccccctggggtgggcgggcgggcctggggcactccgtcgcctttgcagaaccacctgggcccctttctgtcagtattattagggttacgaattgcagctgtttaacttgaaagacactgtcggaggtgagcatctgggcgccgggacgctgcagtgatccccgccagagcctgtgcccttcctgctccgtctttggggtcctcaaggctgcctccttccttttgccaatctcttggactcagtttgccgttgatgcgtttttctcatggagtttctgggcagagtggagctgcaaccctgttgtggggggcagcatttggcaggttttctccttggggttgaatcattcaacttaacgactgaagccctttcttgtctcctttggaagagccgataagtattccactcctcccttcttgccagtgcagacactatgc

SEQ ID NO: 729612 - DNA, 294 bp, Homo sapiens
gccaaaatgtacaagaccacactggatgtcatctttgtatttgcattcaaaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaag

SEQ ID NO: 729613 - DNA, 979 bp, Homo sapiens
gccaaaatgtacaagaccacactggatgtcatctttgtatttgcattcaaaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagctgaaggagtaaaggtgctgcaatggtgtaatctgtggccattgtggatttttcacaagaatattaataaactaaacacttcaaaaaaaaaaaaaaaaaaaccccgagtttttttttttttttttaatttaaatccccccaaaaggggtttttttccccgggagagttttgtagtccaccagaggggggtatttcgggaagaggattctggaggtatgcgcgccgggcgggccacgggggccctccacaactttttgggggccttcgcaggcagccaagggtgtccatcatataccagccaggggggcccgggctaacagacgggggtagcagaggagcgtcgtttgagactcctcccttccgttgggagaagcccctcgtacccaaatattttctcttgggtaatattatgccccccccgggggtttgggcaaaagaggcccaggcggagaagataacaaaatgctgggggccgaggtgacaccaacaccgctttttaacggagaacccggggggtggcttctacacccaaaagaatatcgttctcgtgccaaaagcataaaatggcctcccaccgagtctgtactggtaagaggggggcgcggatccaaaaacattctcccgagaggagccgacgcttcacccctgtatgacgaaccattggccgcggcttgtgctaggcggcccaaaggtggcgagagtattcttggggtccgaaagc

SEQ ID NO: 729614 - DNA, 452 bp, Homo sapiens
accgacgacttcagaggaaacaaacagtcattgatatccttcaccctgggaaggcaacagtgcctaagacagaaatttgggaaaaactagccaaaatgtacaagaccacactggatgtcatctttgtatttgcattcaaaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagctgaaggagtaaaggtgctgcaatggtgtaatctgtggccattgtggatttttcacaagaatattaataaactaaacactttcatgtgaaaacacaaaaacaaac

SEQ ID NO: 729615 - DNA, 1103 bp, Homo sapiens
  misc_feature (118)..(118): n is a, c, g, or t
  misc_feature (264)..(264): n is a, c, g, or t
atcagcgcatgtgtgtaaggaaccacctcaggccagagaaagagccatgtgagaagattagaaggcacagtggtgctgacacaggacctagggtagggcctgttcccaccaccctagntggaaaacctcatgatttatggggcactgggtagaaaacacaagtgagaaaccctagatgggcactgccacctgacacagctatacagcaggacctgaaaggatcacactgcatcctaggacaaagctcaaaagtacctctggganctacaaaaatattcaggtgcccaagaaggtaaaatgtacaatgtctagcattccagtagagaggcatgaaaagcaggaaaatacattgcaataatacagagaaaaattaatcacaactgacctggatctcagatgctagaaatagtagacaaagatgttatttcccagtgcaaataaagaaataaagatagcaaaaaaaaaaaaaaaaaaaaaaaaaaaaaaaaaaaaaaaaaaaaaaaaagaaaaaaaaaaaaaaaaaaaaaaaaaaaaaacaaaaagaacaaaaaaataaacacgaaacaaaaacaaaaaaaaaaaaaagaagggggggcgcacacaaaaaaacctacacctggaggagcacacaactaagctaccccgacaccacacttacgattgcgaaccggaggcctaccccacaaagaagggtatacaaaacaacaacgccgacccctcgcggatcataccaaaccagacgtgggaacacaacactacctcgatgcttgcagtctaggatgcagacagccacacacattttgtgggtgcacaaaaaattcaagatccgccaccaccaccgcaagatataggctacagccggcgggattaaaaaccaaccagatgtagtggatgagactaccaaccatcgtatagtcgcggtcagaagaaagagctcgccgacgtgattattaaaaattttaacggcgtcggtcttaaaattctgtcatctagatatagataaccaatcatacataaaagcaacgatgctacacactgctaccacaacattaacgtcgctagctacatgaccgctagacacagtagcgaccacagtagataaa

SEQ ID NO: 729616 - DNA, 2530 bp, Homo sapiens
ggcctggtccagctatcgtgctcggtattcagttttccggagcagcgctctttctctggcccgcggagcggtcccgcggccgagtaccggattcccgagtttgggaggctctgctttcctccttaggacccactttgccgtcctggggtggctgcagttatgtccgcgctgcgacctctcctgcttctgctgctgcctctgtgtcccggtcctggtcccggacccgggagcgaggcaaaggtcacccggagttgtgcagagacccggcaggtgctgggggcccggggatatagcttaaacctaatccctcccgccctgatctcaggtgagcacctccgggtctgtccccaggagtacacctgctgttccagtgagacagagcagaggctgatcagggagactgaggccaccttccgaggcctggtggaggacagcggctcctttctggttcacacactggctgccaggcacagaaaatttgatgagttttttctggagatgctctcagtagcccagcactctctgacccagctcttctcccactcctacggccgcctgtatgcccagcacgccctcatattcaatggcctgttctctcggctgcgagacttctatggggaatctggtgaggggttggatgacaccctggcggatttctgggcacagctcctggagagagtgttcccgctgctgcacccacagtacagcttcccccctgactacctgctctgcctctcacgcttggcctcatctaccgatggctctctgcagccctttggggactcaccccgccgcctccgcctgcagataacccggaccctggtggctgcccgagcctttgtgcagggcctggagactggaagaaatgtggtcagcgaagcgcttaaggtgccggtgtctgaaggctgcagccaggctctgatgcgtctcatcggctgtcccctgtgccggggggtcccctcacttatgccctgccagggcttctgcctcaacgtggttcgtggctgtctcagcagcaggggactggagcctgactggggcaactatctggatggtctcctgatcctggctgataagctccagggccccttttcctttgagctgacggccgagtccattggggtgaagatctcggagggtttgatgtacctgcaggaaaacagtgcgaaggtgtccgcccaggtgtttcaggagtgcggcccccccgacccggtgcctgcccgcaaccgtcgagccccgccgccccgggaagaggcgggccggctgtggtcgatggtgaccgaggaggagcggcccacgacggccgcaggcaccaacctgcaccggctggtgtgggagctccgcgagcgtctggcccggatgcggggcttctgggcccggctgtccctgacggtgtgcggagactctcgcatggcagcggacgcctcgctggaggcggcgccctgctggaccggagccgggcggggccggtactttgccgccagtggtcgggggctccccggccgagcaggtcaacaaccccgagctcaaggtggacgcctcgggccccgatgtcccgacacggcggcgtcggctacagctccgggcggccacggccagaatgaaaacggccgcactgggacacgacctggacgggcaggacgcggatgaggatgccagcggctctggagggggacagcagtatgcagatgactggatggctggggctgtggctccccccagcccggcctcctcggcctccataccctcctagaagggatggttctgggggcaaaggaggaggtggcagtgcccgctacaaccagggccggagcaggagtgggggggcatctattggttttcacacccaaaccatcctcattctctccctctcagccctggccctgcttggacctcgataacgggggaggggtgccctagcatcagaagggttcatggccctttcccctcctcccccctcagctgggcctggggaggagtcgaagggggctgcagagagggtagagaagggactttgcaggtgaatggctggggccccaaatccaggagattttcatcagaggtgggtgggtgttcacaatatttattttttcatttggtaatgggaggggggcctgggggtatttatttaggagggagtgtggtttccttagaaggtatagtctctagccctctaaggctggggctggtgatcagccccaacagagaaaatgaggagtttagagttgcagctggggaaggggtttgaaggaagttggaagtggggaggggtgggggcatctggtctcagaaatggaccagctggatgcagggcaggggactgagggtgcttgagtaggatgtgagacttcatgggcctgggttctgttgagttttttcagtatcaatttcttaaaccaaattttaaaaaaaacaaggtgggggggtgctcatctcgtgacctctgccacccacatccttcacaaactccatgtttcagtgtttgagtccatgtttattctgcaaataaatggtaatgtattggacccca

SEQ ID NO: 729617 - DNA, 1439 bp, Homo sapiens
ggcctggtccagctatcgtgctcggtattcagttttccggagcagcgctctttctctggcccgcggagcggtcccgcggccgagtaccggattcccgagtttgggaggctctgctttcctccttaggacccactttgccgtcctggggtggctgcagttatgtccgcgctgcgacctctcctgcttctgctgctgcctctgtgtcccggtcctggtcccggacccgggagcgaggcaaaggtcacccggagttgtgcagagacccggcaggtgctgggggcccggggatatagcttaaacctaatccctcccgccctgatctcaggtgagcacctccgggtctgtccccaggagtacacctgctgttccagtgagacagagcagaggctgatcagggagactgaggccaccttccgaggcctggtggaggacagcggctcctttctggttcacacactggctgccaggcacagaaaatttgatgagttttttctggagatgctctcagtagcccagcactctctgacccagctcttctcccactcctacggccgcctgtatgcccagcacgccctcatattcaatggcctgttctctcggctgcgagacttctatggggaatctggtgaggggttggatgacaccctggcggatttctgggcacagctcctggagagagtgttcccgctgctgcacccacagtacagcttcccccctgactacctgctctgcctctcacgcttggcctcatctaccgatggctctctgcagccctttggggactcaccccgccgcctccgcctgcagataacccggaccctggtggctgcccgagcctttgtgcagggcctggagactggaagaaatgtggtcagcgaagcgcttaaggtgccggtgtctgaaggctgcagccaggctctgatgcgtctcatcggctgtcccctgtgccggggggtcccctcacttatgccctgccagggcttctgcctcaacgtggttcgtggctgtctcagcagcaggggactggagcctgactggggcaactatctgggtgaggggattcaagaaagcctggagccaggcatggtggctcacacctgtaatcacagcactttgagaggctgaggcaggaggatcacttgaggccaggagttggagcccagctggggcaacatagctagacgtcatctcaagaaagaaagagagagagagaaagaaagagagagagagagacagagaaagaaagaaggaaagaaggaaggaaagaaagaaaaagaaagaaagaaagaaagaaaagaaagaaatcagccaggcatggtagcgcccgcgcctgtagtcccagttactcctgaggctgaggcaggaggatcacttgaggccaggagttggaggccagcctgggcaacgtagctagaccgcatctctaccaaaaaaaaaaa

SEQ ID NO: 729618 - DNA, 448 bp, Homo sapiens; identical to SEQ ID NO: 410858

SEQ ID NO: 729619 - DNA, 423 bp, Homo sapiens
gatatctcagtctctagtccagcgtggtttatggtgccaaataagtgccaggtgaactcactacatctgacaaaatctcaaggaaccaagtttaccagataatatttatgattatgtgaaaaagactgaggaaatcactcaagtgatccatcatacagcacctccagttccaaagaatactgacttacttcagctgtactggtctggagctgcacattcttttcagacaactcttgttccagtgactcttctcctgtaacagagcctccttcttagaaactatggcctcccgtttctttaagtctgcttccagctcctctaattcttggcgttggttcagaactttctctacttcttcatctaaccatttcttttgctcatccaatttctacattaaaattaaaaaaaaagttacttgttttt

SEQ ID NO: 729620 - DNA, 437 bp, Homo sapiens
ccatccctaggagtgagattactgggtcacatagtatccgtaagtttagccttttgaggaactacaaaatggttatccaaagcaattgcaccattttccaatttcaccagcagtgtatgaaggtcccaatttctccacctcctcccacacatttcttattatgtttttctgattatagccatcctagtggggagtagggagtggtttacaaccagaatcaagtagtgtattaaacagaatacctgactagatctcaatttcttattttccaggtgactcttctcctgtaacagagcctccttcttagaaactatggcctcccgtttctttaagtctgcttccagctcctctaattcttggcgttggttcagaactttctctacttcttcatctaaccatttcttttgctcatccaatttctacattaaaattaaaaa

SEQ ID NO: 729621 - DNA, 829 bp, Homo sapiens
agagaaagacaaaaagggcacagagaagcagagagaactgtatatatacacatacattctggacttcaggaggaagagatgtactgcctaactgttctctccctgacacattctctaaggcatccaggtatacacacagctgcatcgtgtcactgcaagcggctcccagagttgttcctgttcatccaggaagaaagaaaatcccgccaaagattgagagagatcaataaatgtatttccaaagaacctgaacagaagatgtttccatttggctgtcttaccctctatccaagctcagagggaaatgcattcaagaacgttaacggccagcacaaattccattccaagccatggagcgggaagggcacatgataccaagtgtcccaccagacggccatcttgctaactaatacacctcgggattacatttgcatttacacaaaatgtgagctttgggagccagacgtattattttggttaatagtttggcacgttctcagcttggaagcctgagcatatgtgatgggtcagtaacacaataaaagtaacggggaagcatttctttccccagtggtgaatttctaccctattcaggaaacagacttcccaactcagccattacagctgtctggatcgttcataccatttgctgttaaatatacccaagtaggaaaaacagtgtctctgtatttgctgtcacactgtactcagagacaatctttacgggtcatccggatcattactatcagcataatactgctttagagaacaatatcatcctatgtgtggcatgcatttgccgggaagccatgcgcaactcgccagagcc

SEQ ID NO: 729622 - DNA, 477 bp, Homo sapiens
  misc_feature (44)..(44): n is a, c, g, or t
  misc_feature (131)..(131): n is a, c, g, or t
  misc_feature (393)..(393): n is a, c, g, or t
  misc_feature (402)..(402): n is a, c, g, or t
  misc_feature (404)..(404): n is a, c, g, or t
ttttttgtttttccagggggcaaggagggacaaaaaagtaaccncttcttaagtggaatattctaataagctaccttttgtaagtgccatgtttattatctaatcattccaagttttgcattgatgtctgnctgccactcctttctttcaaggacagtgtgtttttgtacgtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggttttaaaagactagccagttaagtaaaagggggntggaacatntntttttttccaaaactggaaaaatgaacctggttttaaaagaatgtcccccaaaataaaacatgtgaagcagta

SEQ ID NO: 729623 - DNA, 399 bp, Homo sapiens
  misc_feature (44)..(44): n is a, c, g, or t
  misc_feature (131)..(131): n is a, c, g, or t
ttttttgtttttccagggggcaaggagggacaaaaaagtaaccncttcttaagtggaatattctaataagctaccttttgtaagtgccatgtttattatctaatcattccaagttttgcattgatgtctgnctgccactcctttctttcaaggacagtgtgtttttgtacgtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagccacctgttacttaactgtctagtcttttaagaccgatcagtatgttccctggaaa

SEQ ID NO: 729624 - DNA, 640 bp, Homo sapiens; identical to SEQ ID NO: 242809

SEQ ID NO: 729625 - DNA, 460 bp, Homo sapiens
caggtgatccgattgtttttctaaagagcaagggctaggacgtcctacgtgttcatatgcacaattttttgaactccatcaagaacacgaaccccatgcccacatcttcactgctcaattcacattgtctgatatgcaccttccagggagaaggaggttttcatggagaaagaggcaacgttgactatacgtgtttactcaaggcttttttataccggactatatgccatccaggtttaagagaagtccaggcaggctctagcattatgtttttcacagaaaaagccggtgcagtagcccggatgcccagatccactcatttcccaaaccggttcccacacccgctgcccaccacctggcgaggaaggagcgggcgaggttcgctcgaatcgtcgtcacgggtttccgtgggtacagttattactcgttacataatattaaacaattaagattaaaaatg

SEQ ID NO: 729626 - DNA, 1986 bp, Homo sapiens
catggcaacatgagcagtgctgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggagccaagatgatgagatggaaaaaggcagaccagtggctactccagaaatgcattggcggggtcagagggatgtggcgcttctattcctacctcacaggcagtgcaggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcaagtccctcctgaacctctccatctggcatcccaaccaatcaaccactaggagggagatcctgagccacatgcagaaagtggctctgttcaaactccagagctattggcttcccaacttttacacccacaccaagatgaccatggccaaggaggaagcatgccatggtctgatgcaagagtacgagactcgcttatacagcgtttgctacacccacataggagggctccctctgaacatgagcatcaagaagtgccaccactttcagaaacggtactcaagcaggaaagccaagaggaagatgtggcaattggtagatcctgactcttggtctctggaaatggatctcaagccagatgctattggtatgcccctacaggagacatgtcctcaagagaaggtggttatacaaatgccttccctgaaaatggcttcttcaaaggaaacaagaatcagttccctggaaaaggatatgcattatgcaaaaatatccagcatggagaataaagccaagagccacctccacatggaagccccctttgagacaaaggtctctacccacctgaggactgtcatccccattgtcaatcactcctccaagatgacaattcagaaggccatcaagcaaagcttctccttaggatacatccacttggccttgtgtgctgatgcctgtgcagggaaccctttccgggaccacctgaagaagctgaatttgaaagtggagatccaacttcttgacctctggcaggacttgcagcatttcctcagtgtccttctgaataacaaaaagaatgggaatgcaatctttcgtcacttgctgggtgacagaatctgcgagctctacctgaatgagcagattggtccgtgcttaccactcaaatcccaaaccattcagggcctgaaggaactattgccctctggggatgtgatcccctggattcccaaagcccagaaggagatttgcaagatgctcagtccctggtatgatgagtttctagatgaagaggactactggtttctcctttttacggtaggaaggactttgggttaggaaggaatcatgaggatgagggaagaagaaagagtaattactgttttaaaagggttatgtgttaaagtaaatgaaattgttatttttcctagagtcaaccaaagatcagcatggtccctgttgttctaaagctaaacctctcaaggaaaaggactcagtgcataagatgactttggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcacgccagcctgggcgacagagcgagactccgtctc

SEQ ID NO: 729627 - DNA, 498 bp, Homo sapiens
agataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggaggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcagtaagaattataaagcatctttttggggggatgcaacaaaaaagtaaa

SEQ ID NO: 729628 - DNA, 409 bp, Homo sapiens; identical to SEQ ID NO: 246205

SEQ ID NO: 729629 - DNA, 352 bp, Homo sapiens
ttgagaggagatttcaggacgtttacccagccctttagtggggatctgtccgggactgtgcagtctgaacctgcaactgtaaaagattgcctctggatggatacctatggtctggcactatcaagatggtatcagtctgtggctccaggtggaccataactcaagatacacatgggagtaagacacagactccctgaatctgcacacctcctgcatgcctcccatgttatgcattatgcttccctttctttaaaaacctgccctcagtccaaccttgtgaactggtttatacaggtgtcatccagccatttccctactgctggatttgaaaaataaagtcactttcctttca

SEQ ID NO: 729630 - DNA, 1563 bp, Homo sapiens; identical to SEQ ID NO: 247640

SEQ ID NO: 729631 - DNA, 279 bp, Homo sapiens
atgccatagtctcttttgggcacacattatattcctatccatgacaagcagccagggcagaagagctctctacatatgtgccaccttgtctccaaaacctgctgtcccctttggacagactggcccatccctgaccactgttctcccctgtcttcaattcctgatggcaacaagagagattctctgactgtttccaaggatgtcattctcagcctcacctccaagtttgattttatagaacaaccaataaatgtggtttcaccttccttgagttcacaa

SEQ ID NO: 729632 - DNA, 1024 bp, Homo sapiens
cttcccttccctcggcttcccgctcttgcctcactctcagcggctgccttcgcccctgtctgcagacagcgccgctggatgctcccagctggacttcaaccccactcctctcagtccctctccccactgccttccagacgcgcctcttccccgccccgcgcccctctctcctctcccacccctgcccctctccgcggcgctcaccctcctcagtcccagtttctgaaaggactcagctgagaaaggacaactgggttccgctttccttaaccctacaccctttagctggatgctgtcagaggcgatggagaaacgcaaaggctactagacgcaacaatagaattaccatattgtttttcctggtttgaaaggaccagatggaaagaaactgggcaagccaatgaaagtctctggggatcatgggaattgagtgtctatgaaaaccatattccagacaagaatatagtctaaggacacagcaagaggcaacattttggaagcagagggcaactctcactggaaaccaaatctcctggcaccttgatcttggattttacagcctccagaactgatagctgggaggcattacatagtcatgtgcgaggtcaaaactgagtcaccaccacaaccaagttccagctggcaagaagaggaaaaataacacagaggagttatgaccagtgttgtaaggatctggcctagaaatggcatgcatctcttccactaatatcctattggtaaaaatgtagtcacatgggcacaccacctatctgcatggaaggctgggaaatgttgatcggtagggcagccatatgtgtaggaaggagaaaacagaatttggtggatacctagtagtctctgccatacccttgaccagaaatttttcttctaaagaatttaattctaaaagttatagacattcccaaagatatacctgcaagcatcacagctttgtgtataattgcaaaagttgaaatcaacatgaatgcccaaaatagtgaattatttaaacagattattaccc

SEQ ID NO: 729633 - DNA, 896 bp, Homo sapiens
cttcccttccctcggcttcccgctcttgcctcactctcagcggctgccttcgcccctgtctgcagacagcgccgctggatgctcccagctggacttcaaccccactcctctcagtccgctcaccctcctcagtcccagtttctgaaaggactcagctgagaaaggacaactgggttccgctttccttaaccctacaccctttagctggatgctgtcagaggcgatggagaaacgcaaaggctactagacgcaacaatagaattaccatattgtttttcctggtttgaaaggaccagatggaaagaaactgggcaagccaatgaaagtctctggggatcatgggaattgagtgtctatgaaaaccatattccagacaagaatatagtctaaggtttatgggactccccagtactctccatgtagagtctaatgtagaatccaggagtgcacagaaaagtcactggatgacacagcaagaggcaacattttggaagcagagggcaactctcactggaaaccaaatctcctggcaccttgatcttggattttacagcctccagaactttctcacacttccttttgaaagctattaaaaatctatggcagaaaaatggtcaaggaataggaactacaacttcataaatgaggaaccagaaaaggtaaaaaaaaaaaaaaaaactgaacagataatcaaatttcacagtaattcgttttcaaataaaaaatatacagattaaaatatgatttccccattgttgactagaatgcataaaaatggggccaagcatggtggctcatgcctgcaatcccagcacgttgggggtccaaggtgggagaatcacttgagcccaggagttcaagaccagcctgggcaatatgagcaagaaacataaatt

SEQ ID NO: 729634 - DNA, 779 bp, Homo sapiens
gctactagacgcaacaatagaattaccatattgtttttcctggtttgaaaggaccagatggaaagaaactgggcaagccaatgaaagtctctggggatcatgggaattgagtgtctatgaaaaccatattccagacaagaatatagtctaaggtttatgggactccccagtactctccatgtagagtctaatgtagaatccaggagtgcacagaaaagtcactggatgacacagcaagaggcaacattttggaagcagagggcaactctcactggaaaccaaatctcctggcaccttgatcttggattttacagcctccagaactgatagctgggaggcattacatagtcatgtgcgaggtcaaaactgagtcaccaccacaaccaagttccagctggcaagaagaggaaaaataacacagaggagttatgaccagtgttgtaaggatctggcctagaaatggcatgcatctcttccactaatatcctattggtaaaaatgtagtcacatgggcacaccacctatctgcatggaaggctgggaaatgttgatcggtagggcagccatatgtgtaggaaggagaaaacagaatttggtggatacctagtagtctctgccatacccttgaccagaaatttttcttctaaagaatttaattctaaaagttatagacattcccaaagatatacctgcaagcatcacagctttgtgtataattgcaaaagttgaaatcaacatgaatgcccaaaatagtgaattatttaaacagattattaccc

SEQ ID NO: 729635 - DNA, 498 bp, Homo sapiens
  misc_feature (487)..(487): n is a, c, g, or t
  misc_feature (495)..(495): n is a, c, g, or t
gcccatgtagcatccctggagggcctcatccctgaagataaggttgtgcttctggcaggttctcccttacagaatgaagccaccctgggtcagtgtggggtggaagccctgacaaccctggaagtggttggccgcaggctaggaggtgagtggggctacaggggccccaaactggtgtccaggggcaattcacgacacttagacttacttggtttgccctgcacggtgtgttacttttttttttcttttttctttagttcacaatgtctaaaagtcagctgattttgtgttaaaattcagtgtctggctttgcttcaaaaattgggaagatcggccggacgcggtggctcacgcctgtaatctcagcactttgggaggccgaggtgggtggatcacgaggtcaggagatcgagaccatcctggctaacatggtgaaaccctgtctctactaaaaatacaaaaaaaaaaaaaaaaaaaaaaatttacncgggcgtnggg

SEQ ID NO: 729636 - DNA, 461 bp, Homo sapiens
  misc_feature (450)..(450): n is a, c, g, or t
  misc_feature (458)..(458): n is a, c, g, or t
caagtcgcctacgtgcgcgcccgggagctgcacactcttgaagtgaccggcctggagacggttgcccagagcaaggcccatgtagcatccctggagggcctcatccctgaagataaggttgtgcttctggcaggttctcccttacagaatgaagccaccctgggtcagtgtggggtggaagccctgacaaccctggaagtggttggccgcaggctaggagttcacaatgtctaaaagtcagctgattttgtgttaaaattcagtgtctggctttgcttcaaaaattgggaagatcggccggacgcggtggctcacgcctgtaatctcagcactttgggaggccgaggtgggtggatcacgaggtcaggagatcgagaccatcctggctaacatggtgaaaccctgtctctactaaaaatacaaaaaaaaaaaaaaaaaaaaaaatttacncgggcgtnggg

SEQ ID NO: 729637 - DNA, 225 bp, Homo sapiens
gcctggagacggttgcccagagcaaggtaaagataatgatgtatccctgatcatccttaccccagccactacttgcctttcctcctgtggcttccccagacaacactcttgactctccctttcctttgaaggcccatgtagcatccctggagggcctcatccctgaagataaggttgtgcttctggcaggttctcccttacagaatgaagccaccctgggtcagt

SEQ ID NO: 729638 - DNA, 952 bp, Homo sapiens
ataggtttattgcccaagagaagtgaatgcacatactgtctctgtacgtaaatgttcacagaaaaaaaagagttactagcaaagaactggggtccagagctgaggggttccagcctggcagcaggagtgtggcatctcagcaggcaggtactatatatactgccatggggtccctggctctatttctgatagcccccaaaccacaaacaatctctatgtctgtcttttgcataaacaaattgtggtagtttgttaaaatagtacagtccaaagcaatactaacagctgatgtgtgcaaacaaatgaagaaactgtgagatatacagtaaggaatggtctgtgcccttctaacataggaacaaagacctgtactcacctatttagaattcaaatcaggttcgtgattgcgctcttaaaaaaaaagaaaaaaagagagaatacaaccaatatgctaatataatatcacttgagcctaggagtttgacgctgcagtgaaccacaatcaccccactgcaccccagcctgtgtaacagagcaagacctggtctcgaaaaataaataataaagtatgtgctaatattatgtaataattacatataacattagcaaaatttgttgagtatctctgtgacaggcctataaagctaggactacagtgccagttagagtttaggccaggctcactgatgtatgcctgtaatcccaacactttggtagtttgaggcaggaggatggcttgagcccaggagttcaagaccagcctgggcaaaatagcaagaccccatctctataaaaattttaaaaaattagctgagcatggtgatgtgcacctgtggtcccagctactcaggaggctgaggtgggaagattgagcctgggtgatcaaggctacagtgagccataatcatgccactgcattccagcctggacagtagagctagaccctgactca

SEQ ID NO: 729639 - DNA, 496 bp, Homo sapiens
cagaggagcacccccataatactgaaaccagcctgcattcattctaatttggagaacaatctgtgggatagtacgcacatcagggagcccagagagtgaactccagggctgtgggtaatctttcccagtgaaaatcagccatctcttctacaccatgtaccctgcctgctgcattctttactcttttattaaaattgaagtatgatattcctacagaaatacacacatatataactctacaactcaatgagatttcacaaactgaagacacctaggcaaccaatgcctagatcaagaggcaaaacattaccagcaccctagctgccctccttggactcccttttcatcacttccctgacaaaggtaactctcttccaacagcacaggttcctttttcctggttttgaactttacctaaacagaattatccagcatgtactttactgtgcctggtttccttcactcaacattacatttgtgaaattgtgaaaaaaca

SEQ ID NO: 729640 - DNA, 661 bp, Homo sapiens
gtcccctgatggaacctggtgcctctgttttctctcaggtcgctcccaggaaataaagtttccgtggatctctttaggcagctgttttggagggagaaagtgaaaggaaaggggactctctctctctctttttttcaaagaggagaagacgaggcaggtgctgtccaccgctgccgtgtaggtcatctcagggtggaaaaacctcacgagtgcagttttcgtgcgtcaggcatcttcacccttctttaaaaacaaaaacaaaaacgaaacaccaccacagtatgaacgagatctcatgatcgccccctttttctcttccggttttgtttgttatatatgtatacaaaacagtctgggtgtttattatgctttttattttttggcccctccttccttggactgcaaaaatgcctccttggtcagtttctcccgcgttttctcctccaagggcgggcatgcctgtctctgggtggaggggagggcggcggatgggcctgggctggagcccggagcggcccaggtgcagggtcggcgcggcggcggcagcggcggcggcggcggcggcggcggcggcaggggcggcggcggtgctgacggcggctgcggaggcgggcgacacttgcacgtgtaagtgtgctcacgatctgtgcgtgcacagctg

SEQ ID NO: 729641 - DNA, 1010 bp, Homo sapiens
aggcagagagcccgaaaggaccagacgcccaggtcgcccgcatcccgctgccgcagagagagagacagcgcgccccggccctgctccccaggcttcgcccgggcgccctcaactctgtccccagagactgagcacctgtcctccgcctcggcctctgctgagagccctctcctctggagcacacaccacccctgcagcccaagaagagtcccagccccacgccggctaccaccatggcggagaccaacaacgaatgtagcatcaaggtgctctgccgattccggcccctgaaccaggctgagattctgcggggagacaagttcatccccattttccaaggggacgacagcgtcgttattggggggaagccatatgtttttgaccgtgtattccccccaaacacgactcaagagcaagtttatcatgcatgtgccatgcagattgtcaaagatgtccttgctggctacaatggcaccatttttgcttatggacagacatcctcagggaaaacacataccatggagggaaagctgcacgaccctcagctgatgggaatcattcctcgaattgcccgagacatcttcaaccacatctactccatggatgagaaccttgagttccacatcaaggtttcttactttgaaatttacctggacaaaattcgtgaccttctggatgtgaccaagacaaatctgtccgtgcacgaggacaagaaccgggtgccatttgtcaagggttgtactgaacgctttgtgtccagcccggaggagattctggatgtgattgatgaagggaaatcaaatcgtcatgtggctgtcaccaacatgaatgaacacagctctcggagccacagcatcttcctcatcaacatcaagcaggagaacatggaaacggagcagaagctcagtgggaagctgtatctggtggacctggcagggagtgagaaggtcagcaagactggagcagagggagccgtgctggacgaggcaaagaatatcaacaagtcactt

SEQ ID NO: 729642 - DNA, 1873 bp, Homo sapiens
tccccaggctatctccagccgtggccgatggccgtgccgggggcagagcccgctcccctccgcgcgttgctacgtgcggggatgacatggatccagacgccgtcaactacgggaaggaggaggcgagagttggagcgcgtgggagcgcagaggccggaggagggagggggggacaccgagcgcggagagcgcggagagcgcggagggaggcgcgcgcgggagcgaacaccctcccggatccagagcccggcggcggcgaagcagcagctgcggccgcgcccttgccagagccggtgcgtccgcctagccccgctccgcctgaggccgtcagggctcccgaggatggaagattcccaggagacatcgccgtcctccaacaactcctcggaggagctcagctctgctctgcacctgtccaagggcatgtcgatcttcctcgacatactgaggagagcagacaaaaatgatgatggaaaattatcctttgaagaattcaaagcatattttgcagatggtgttctcagtggagaagaattacacgagcttttccataccattgatacacataatactaataatcttgacacagaagagctatgtgaatatttttctcagcacttgggcgagtatgagaatgtactagcagcacttgaagacctgaatctttccatcctgaaggcaatgggcaaaacaaagaaagactaccaagaagcctccaatttggaacaattcgtaactagatttttattgaaggaaaccctgaatcagctgcagtctctccagaattccctggaatgtgccatggaaactactgaggagcaaacccgtcaagaaaggcaagggccagccaagccagaagtcctgtcgattcaatggcctggaaaacgatcaagccgccgagtccagagacacaacagcttctccccaaacagccctcagtttaatgtcagcggtccaggcttattagaagaagacaaccagtggatgacccagataaatagactccagaaattaattgatagactggaaaagaaggatctcaaactcgaaccaccagaagaagaaattattgaagggaatactaaatctcacatcatgcttgtgcagcggcagatgtctgtgatagaagaggacctggaagaattccagctcgctctgaaacactacgtggagagtgcttcctcccaaagtggatgcttgcgtatttctatacagaagctttcaaatgaatctcgctacatgatctatgagttctgggagaatagtagtgtatggaatagccaccttcagacaaattatagcaagacattccaaagaagtaatgtggatttcttggaaactccagaactcacatctacaatgctagttcctgcttcgtggtggatcctgaacaactagatgttcctagacattttctttatggttccaagtgcaaaacaggtgttcttatctaaaacgtcaattagaaaattatctgcggttgttaatctactgtatatttttgtttggtatatttactaagtgcactctttcaaaacttattctataactttatcaattcatgtgaattttagctcaattttcaaagttcactaatattctcaatatttaatgctaaatgctttgctacattgtaactcacctaaaaccttttagtgacaaaatcctaatatgtggaaaaaagcatatgcataaaggaataatattgtgaaaatgaatctgttatgataaagaaaaaataaagtggaaacttttagagtattacttcatagggcagattttgtaaactgtcgtatactgtaaagggttaaatcagcgttttgtgatttttaagtaactgtgagtgaagtttattcttcaacaatctcgtgcc

SEQ ID NO: 729643 - DNA, 1828 bp, Homo sapiens; identical to SEQ ID NO: 256697

SEQ ID NO: 729644 - DNA, 1543 bp, Homo sapiens
actgctctcctgcctagagataccactgagtccagaagcaagacctgtgagagtgcacagtgccacttcgccccatggctgaagatggtttgcccaaaatttattctcatcctccaacagaaagcagtaaaacaccaactgcagcaaccattttctttggggctgacaatgctattcccaaatcagaaacaactattacttcagaaggagaccacgtcacttcagtaaatgaatatatgctagaaagcgatttttcaacaactacagacaacaaactgacagctaaaaaggaaaaactcaaatcagaagatgatatggggaccgactttattaagtcaacaactcacctacagaaagaaattacctctctgactggcactacaaactccataacaagagactctattaccgaacatttcatgccagtgaaaattgggaatatttcatcaccagttactactgtttctttaatagatttttccactgacatagcaaaagaagatatcctcttagctaccattgacacaggagatgcagagatctcaataacctctgaagtctctggcacactaaaggacagcagtgctggtgttgctgacgctcctgcctttccacgtaaaaaggatgaagctgatatgagcaattataattcctccatcaaatccaatgtccctgctgatgaggctgtccaggtcactgattccactattcctgaggctgaaatccctcctgctcctgaagaaagcttcactactattccagacataactgcccttgaagaagagaaaataaccgaaattgacctaagtgttttagaagatgacaccagtgctgtggctacattaactgactctgatgagaagtttatcactgtgtttgaactcactacctctgctgaaaaagacaaagataaacgggaagatactctgctaactgatgaagaaactaccgagggagccagtatttggatggagagagatactgcaaatgaagcagagacccattctgttttgcttactgctgttgaatccagatatgacttcgttgtccctgcatcaatagctacaaacctagtggaagaatcatctacagaagaagatttgtctgaaactgataatacagagactgtacctaagatcactgagccattttctggaactacctctgtattagataccccagactataaggaagacacctccacaactgaaacggatatctttgaactactgaaagaagaacccgatgagttcatgatttaaaagcaacaaaagggataccatgtagaattgtgcaatagtctagccagctagccttaacatctaagaaatttttccaacaagcaaaaacctttagaaatgaaagaatgtgggcatttaaggtcttaaacactgaatatcacactcttcttatgactcttgttagcgattcaaggacataaatcttcattcttttctggcacagactacttaaatgggtctgttttcactttgctcatttttcttcaataaatctttttggcaagcaactgaaaaaaagtgtg

SEQ ID NO: 729645 - DNA, 472 bp, Homo sapiens
tgctcagatagagcagctgaggaggaaccacaaccaggccatccagtacttgcagcaggctcattctgtctgtgtttctttgttcactgaagtcagccccaaaactgcagaaatgagtgcgttactggccaaagcttatgccatgtctggagaggcccagcacagggatgctgttgagatatatttcataagaagtatcaatgcatatcgagcaacattgggctcagaggattttgaaacactgagcaccactgaagaattttgcaaatggcttgtccaaaatggagaaaaacaggacaagtagcagttcatccagatggagaagagaagccattcctggaagaaggaactctacatacaaaggcacagaagcatgacagagggcagtgtatggaggaatggtcttctgttatcaaattgaaaacctctatacaggatagccaacaataaagacaaccttgttgatgataaa

SEQ ID NO: 729646 - DNA, 157 bp, Homo sapiens; identical to SEQ ID NO: 464577

SEQ ID NO: 729647 - DNA, 883 bp, Homo sapiens; identical to SEQ ID NO: 257286

SEQ ID NO: 729648 - DNA, 686 bp, Homo sapiens
atatccccacccctctcaaaaaggaacagcaagaattttcagtgctgccacaagaaaatgcattgccaaactggaaggtcatgaaggtgaaatttcaaagatttctttcaaccctcaagggaaccatcttctaactggcagctctgacaaaacggctagaatctgggatgctcagactggccagtgcctccaggttcttgaggggcacactgatgaaatcttttcatgtgctttcaactataaaggcaacatagtcattacaggcagcaaggataatacctgtaggatatggcgttgactgaaggaagctggtcagtgagcaaccttgctagcaatggtaatcaagaactggaacttcacagacagcagctctcttaatatttcttatactttctctttttctgcaagtcaactatttctacaactgtccttcatttcacagatatgaccattaaacatgacaaagttatgccactccaatattattatttgatggcgatggcaggacacagcataatgtttggctaatgccaccagttatttcagttgtgtttgttttttaaaagcattatgatactgaaaaaggagaccagaacaacttaacaacgtgtctcctggattttactttgaagcctattgttataatttctgttgaataaagtgtttggaggaaattccttgtacat

SEQ ID NO: 729649 - DNA, 524 bp, Homo sapiens; identical to SEQ ID NO: 673042

SEQ ID NO: 729650 - DNA, 618 bp, Homo sapiens
cacatttattttcatagtttatgacattgacatacctgtgcataactctgtctcagcattttaaggccctggtggtgcacaggaagccgtgactaaaatgataggtacactgttcctaatacgggatataaaagactcaacaccacacctgacaaaagaagctgttgtcttaaagatgcatcttcctttaaagtaaatgaataacaaaggtaggccataaggagcttcttatctactttaagctcttggctggcttttccaggaagtttgaggagataaatcatgactcattttctgcagggtcagtggggaaactggagaggtggctgtccctgttcctgccggtgcctgaagctttcagtgttgttccatcacactctggctccatacctttcctcctgtcctccctccctgttggctggagtctaatgtgacacttcttccaaaacacagaaccgcctacattgtgtaaactgattcatgagccattgcgcccagccctccatctcatatttttagcctatttataggttctgcttacttatggcttcatcttcctcataagttttgcttgcttatgaccctcttgacctcacctctgcgttgtgtaaactgatt

SEQ ID NO: 729651 - DNA, 413 bp, Homo sapiens
  misc_feature (109)..(112): n is a, c, g, or t
  misc_feature (114)..(114): n is a, c, g, or t
  misc_feature (116)..(116): n is a, c, g, or t
  misc_feature (119)..(119): n is a, c, g, or t
  misc_feature (122)..(122): n is a, c, g, or t
  misc_feature (124)..(125): n is a, c, g, or t
gaatatgatactgtttaagagaaaatgaaaaggattacaagttttttatagtatttgactttgtgatgctctattatagcaatatttaatttagaaatctgatgaaaannnntntnganatncnncatctcttcacatttcgatgtatcatggcatgttagattttaatgttggcgagtgaggcttcttgaatcaaaaattacactggataaagtcaaacagacaaggaagactgtattcaaggccgctgcaataggggaaggaggccagaactaagtgtgaactcaactcctctgaaacaaaaggcagaagggtttttaagggccaggatgagctagtggaaaaatactgaaagatattatgtggggcagttaatcgggtgtgttgggcacacattatggaggggtaccgag

SEQ ID NO: 729652 - DNA, 278 bp, Homo sapiens
  misc_feature (109)..(112): n is a, c, g, or t
  misc_feature (114)..(114): n is a, c, g, or t
  misc_feature (116)..(116): n is a, c, g, or t
  misc_feature (119)..(119): n is a, c, g, or t
  misc_feature (122)..(122): n is a, c, g, or t
  misc_feature (124)..(125): n is a, c, g, or t
gaatatgatactgtttaagagaaaatgaaaaggattacaagttttttatagtatttgactttgtgatgctctattatagcaatatttaatttagaaatctgatgaaaannnntntnganatncnncatctcttcacatttcgatgtatcatggcatgttagattttaatgttggcgagtgaggcaggagaatggcgtgaacccgggagcggagcctgcagtgagccgagatcgcgccactgcactccagcctgggcgacagagcgagactccggctca

SEQ ID NO: 729653 - DNA, 837 bp, Homo sapiens; identical to SEQ ID NO: 265677

SEQ ID NO: 729654 - DNA, 538 bp, Homo sapiens; identical to SEQ ID NO: 728392

SEQ ID NO: 729655 - DNA, 566 bp, Homo sapiens
agaggctggatcttgctgactcatctggggtaccaaggacagacaaaggacatggagtccaggcccaggaggcgacaccaggccagcagtttcactgatgctcctgtcatgacgatgactgcctccctcctccccttggtccctgactcagtgtctgcagtgaccaggcaccaggcagggagcaaggaaccaagcctttcacctgctcccaccaactcctatggtgctccctttccaaggctaggtctcctctccacccagttccttatcacgtaccatgagaagctgtcaccttggcaactgtcaccttctggtgagatttacaattgcactgctacaactgcttgtggcatggtaaagttgcaccaggacctctgctgtccatgagatcaaagttccaggccaaggtgagcacccgcctccatcctagagaggattctgtgagaatcattgagagggagctactctctccaggcaatcacgggggtgagaaagaaaaaaaaaaagagagggagttactcatgtactgacttattcaatgaatgcttatgttgtaatacctacta

SEQ ID NO: 729656 - DNA, 593 bp, Homo sapiens
agaggctggatcttgctgactcatctggggtaccaaggacagacaaaggacatggagtccaggcccaggaggcgacaccaggccagcagtttcactgatgctcctgtcatgacgatgactgcctccctcctccccttggtccctgactcagtgtctgcagtgaccaggcaccaggcagggagcaaggaaccaagcctttcacctgctcccaccaactcctatggtgctccctttccaaggctaggtctcctctccacccagttccttatcacgtaccatgagaagctgtcaccttggcaactgtcaccttctggtgagatttacaattgcactgctacaactgcttgtggcatggtaaagttgcaccaggacctctgctgtccatgagatcaaagttccaggccaaggcaccaggggcacgaacagtgttgcccgcatggaactcacacttaatgggagcggcagccaacaggatgatacccggcaaattcttcaaagcagtgttctccaacttgaatgtttgtgatgtgggcgattctgactgagggggtctgtagaccacatcttgataaacaatgctttttaaaaaattc

SEQ ID NO: 729657 - DNA, 514 bp, Homo sapiens
tgttttgttttttaagcttctcacttcagtatctaccagacaggcttgtgcaaggagtgaactagtattgtatctgttaatttctttgcaggcaaaaatcaagttaccaggaaaatattttttaaaaaccacgaacagtctaagagcactgaacattttgaatcatttgccttttctcaacactggattttaagcaaggaacaagactattccagttctaaatgctttaatgaacaaggggtattgggttttagcatcaacatgatctatcctcactctgaagctttaacttgagtagctgctgtgctttgtaaagcttcaatccaattcatttgataactacaattaccaaatctgggcattgctgactacacagttcaaaaaaacagcatggagggaagacctgctgagaaccttagaatctatcgataagctcttgaaatggtttaaagtaataaaccacttcaattgaaagggcaataaaatgtttttcgtgtatatatgtaaaaaaaat

SEQ ID NO: 729658 - DNA, 1658 bp, Homo sapiens; identical to SEQ ID NO: 277528

SEQ ID NO: 729659 - DNA, 482 bp, Homo sapiens
gagagagaaactgatagtcccaatttagttcaggtgtgtgtacctgatctaaacatttttggtgaaaggatcagattatagggcagaaacatggatatggggaggggctccaggggttggggtatgcaattcttgtagaagagcggggctaaataatccaagagtggtgttcccttgagagccttgggttcttcatcatattatgagaataattctacttacctttcaggatgttattagagtcaaagtagataaggaaagtgaaaacattttttaaaatgtcaaaacatgcaaatgaagagtgttgtatacattcaagttccaccagccagacagtccctgatccaagcagtcagattccccttctaactcttcttccatgtcatatgggctgaaaattcagaaagtcctgggaacaaaaagattcaaggtctcttacagtggtgttctggttaacaagctctacaagatttaaaaaaaaa

SEQ ID NO: 729660 - DNA, 1093 bp, Homo sapiens
gggcaggaagtaccatcctctcatggcctccaaatgatgagagctagaagtacttcacaaacattgttagtggcctgatagagtcttagaagccttcacaaagcagacgatctttgagctgtgtctggaagtaagactgtgtctttcaggctgacaagagggggaaagccgagggagaaagtgtttatctgcaccactcagggctcattcgcttgagtcttacacggcttttgtggtcggagatgttcttgcagattgaaatgaaaactgcttcataagcacaaataatgttttcaatgatgtcagctgttcttcatgctttgggggtgattgagagaggcaagtaggtttgaacgagaagctaggggtgcagatatgcaggaaaatatatcagagaaatataaacataagcgttaagggcatctgtttagactgtttctcaagtttcttagtcctggaacagccaattccatggagcatgccaccaggagttgcaacttatagcctaggtggctcttgggaggtgaacgtctttgtggctatgtgagcagcatggaattgtctacgccttttgattggaatgcactcccccttggtgaaagggaatctatgtcttttttctacatgcagttatataacacttagaatcaccattctttcccataaggcttgtacataagccctaccttttgtccctaaggaaggagttggtgaaagtcggcctgtgagtaacattggaattaggcagtagaatttgaagaaatggtagcaacagacagccctctgctcccttaagtctttctttgcctgattattgaatttgtagtagatcaagggggatgccatgcagagaaagaccatcaatcctgggttttaggttcagggtcagttaccagcctcaggatcccggtcagttccgtgctctgtaaaaccgatacctgctttacctaccttccaaggttattttgaaaaggaagtaagattatgcatgtaataaatatcttatgaaagtaccttgaagcgttcaattatttcacaaatgcatggtggtggtgttattagtatttattaaactgatattgtgaaaaattgt

SEQ ID NO: 729661 - DNA, 411 bp, Homo sapiens; identical to SEQ ID NO: 461101

SEQ ID NO: 729662 - DNA, 1636 bp, Homo sapiens
actatgtcatgtgaaaagtagcttgatttggggtcactgctattcagtggaaaatttaaccttgggatggataatgcagcccaaatttgaactctgaaagactattcactggattggaagaccaatagataccaataaattaaaagtaattgctgtttatccttcatcaaaattaccattattctacaaggtggccctccagagttagtgaactgtgacctccacatgggatttggacatgcgtgccctacatctggaatgcagaaacactcttcacagaactctgatagcccaggaatatttatgtaaatctctgtcctggtaaggcacatgttgatgtacttgggcttaagctcataaaccaagaggaacagtttcctacatcccccttctaatgactaaagccaacgggctgagccaaatgggacaatttagacaaagagagactggcgaaaagcaaatgaatagtccttcccatgctactttcctactatctctgtgtttcctagaaccaaggtacacccctccccatggcctctcccactgccatcacattctaagcatatgtccagccctagggagctataagaccttgagtgtattggtgaaactctccaagtctcattttcctcatctggtgtcagaatacaatgcatttggtgacaagctgactggactcaaagagaagttgctgtgggatttctgcaagaccagagtcttagaggagacggtgcccaagtctaacttgttcactcttggaatgccaggcaccaaacatggtgcctggtccattgctggcaataaaagcagctttgagatcagcatggaggaagaaggaataggaagaagctgctctgaactccctccagaaacacctacatttacatccaaggcaccagctgttgagtttccctgacttgagaaatggcatcgctcttggccaacatctcccaaggagactaaatagaatattaatgtattagtagaatattaatattaatatattagtagaatattactaacagattagaatattaatattaatatattagtagaatattactaagtaatagattagtagaatattaatatatattagtagaaataatatattagtagcatattcatatattagtagaattaagcaaattgactggttttaaattctaatatatttgttaaagtttaatcatttaattgatagttatatctgataataagaaactcatctcttcattttatttaataacagaataaacagatcattaagcatatgaatttagaatagaggtgaatctaactgaaatattattggcatatgagtatttatggagtcttcatgttcttcactacctacctgcaaagttaaagtgtttatttgaggatgtagacatggagatccacacaaatacgtgaagagctatatattgaagacaacagccttcaatctttaaaccaagtacaaagctcttatatatttatagtataatatagctcctactatttcaatgtttatgtcgtatctcttccgtaagcgattggtgggtctgaaatccactttcactgagatacttggttgacgtcaatacaaatgagaacagtgcggaccgttctgcccttcccctgaaaacacaaa

SEQ ID NO: 729663 - DNA, 1143 bp, Homo sapiens
ataaaagcagctttgagatcagcatggaggaagaaggaataggaagaagctgctctgaactccctccagaaacacctacatttacatccaaggcaccagctgttgagtttccctgacttgagaaatggcatcgctcttggccaacatctcccaaggagactaaatagaatattaatgtattagtagaatattaatattaatatattagtagaatattactaacagattagaatattaatattaatatattagtagaatattactaagtaatagattagtagaatattaatatatattagtagaaataatatattagtagcatattcatatattagtagaattaagcaaattgactggttttaaattctaatatatttgttaaagtttaatcatttaattgatagttatatctgataataagaaactcatctcttcattttatttaataacagaataaacagatcattaagcatatgaatttagaatagaggtgaatctaactgaaatattattggcatatgagtatttatggagtcttcatgttcttcactacctacctgcaaagttaaagtgtttatttgaggatgtagacatggagatccacacaaatacgtgaagagctatatattgaagacaacagccttcaatctttaaaccaagtacaaagctcttatatatttatagtataatatagctcctactatttcaatgtttatgtcgtatctcttccgtaagcgattggtgggtctgaaatccactttcactgagatacttggttgacgtcaatacaaatgagaacagtgcggaccgttctgcccttcccctgaaaacacaaagtggagctttaaaacaggctctcacactggattttaggtggatttggattttaactccagttgtctatgagcaattaaaaaaaaacccacagcaggacgatttccaaggatattagaggatttaatgaacaaggatcgcatttaagggaagaggggtaacgaggagtaaaacgaaattttcctgctttttcctgtgagaagtatcattgtaattacccatgtatctaaattaaaattgcatattcatgttttgcattttcaattggccttgtataattaaaactgcatcacatttgatgaatttaaa

SEQ ID NO: 729664 - DNA, 661 bp, Homo sapiens
ggggcacttgtgaatttcaaagaataatgacaataaccaaaagaagctacatttgtggcattggctaaatgttttataaattttatctcttaaaattcaaaccaaaaaaccccctgtattcacacctgtaatcccagcactttgggaggtcaaggcgggaggattgcttgagcccaggagttagtgaccagcctgggcaacatagtgagaaccccatctctacaaaaaaatttaaaaattagtcgggtgcggtggtgcatgcctgtagtcccagctgcctgggaggctgagtgggaggatcgcttaggcctgggagtttgaggctacagtgagctgtgattgcgccactgcactctagtgtgggtgacagagaaagaccctatcttaagaaaaaaaaaagaaaagaaaaagaaaaaacaaacaaaaaaaacacccaaccctatataggtattattattacttctataggacacatagaggtttggaaagattaaatcacttgaccaaggtcacaaaataagttctgaggctgggatctgggattcagtcttattatatgcccttcctctaccactccctaaaacttctcattccctcaatccccatatatcatcttaaaatctgcaataaatagccccatacattcgttggcacttaggaa

SEQ ID NO: 729665 - DNA, 3796 bp, Homo sapiens; identical to SEQ ID NO: 248621
  misc_feature (18)..(18): n is a, c, g, or t

SEQ ID NO: 729666 - DNA, 829 bp, Homo sapiens; identical to SEQ ID NO: 248622
  misc_feature (18)..(18): n is a, c, g, or t

SEQ ID NO: 729667 - DNA, 529 bp, Homo sapiens
aaagtgttaatggacatgaaataaatgagaggaaagagaaaacaaaaccagttccaggatacaataatgatacagggaaaatttcaagcaaggtggagttggaaaagaactcaggcatgagaaccaaatatcgaacaaagaagggccacgtgacacgtaaacttacgtgtttgtgcattgcctactcttctaccattggtggactgacaacaatcactggtacctccaccaacttgatctttgcagagtatttcaatacattccatccacacagaagaggagatcgtacaaggcatgtacaccaggaggcagaaatttgaggcatatcttggaactctgtctaccacatcctgaacatcacacagtttccactcttgttgccttcaatcctgagaatgcatccaggagccattctgttttatgtcaattactaattagatcatgtcacgttactaacttactacgttccaattagtccttattgcatttgtaataaaatccgcatactttcggactggctacaaggtta

SEQ ID NO: 729668 - DNA, 679 bp, Homo sapiens
gctgacgctggggttcatgagcagcactgcctttttgtctatgtggctcagcaacacctcgacggctgccatggtgatgcccattgcggaggctgtagtgcagcagatcatcaatgcagaagcagaggtcgaggccactcagatgacttacttcaacggatcaaccaaccacggactagaaattgatgaaagtgttaatggacatgaaataaatgagaggaaagagaaaacaaaaccagttccaggatacaataatgatacagggaaaatttcaagcaaggtggagttggaaaagcactggaaacttgcagttcaagatggctccccatctccctctgtccattctgtatcgcagctagctgctcaaggaaaggagaaagtggaaggcatatgtacttagaaattattctattactttcctggatttaagagtattcagattttctatttcaacatcaaacaattgcatttttaaaaagaaatttatgtgttccatgtcaaatttagtagtgtgtggttgtttataatattttcttatatctacttaatttctatagtatttatagttatatgtctttatttctaacatttttcttgtgcttttaaagattatttaaagattatttttaaataatctttatttcatttaaataaaatattttatttaagtcttttttaa

SEQ ID NO: 729669 - DNA, 463 bp, Homo sapiens; identical to SEQ ID NO: 248625

SEQ ID NO: 729670 - DNA, 461 bp, Homo sapiens
ctcaaatgccctccccccaaactcctatcacctggaagcctctactaggcctgtgccccattccagggaaccctctgctcccatccagggccctcatttcaccccttccctgaagcctgtctgcggctgtccccacctccctccagccaggggagggtgctccctgaccagatggctccacctgtcactccctgtcactatggtggtccttcctcctctgaactctgggaccttgcagaggctgctcaacacctctgagctcgaatctctgctccaggggatgcaggttatgaagatgagagcgtgagacagcgagctgtaagggaagcaggttacccagggatggacagaggatgggccctggccctcatgttatgaagcttctccacgtggtgccttcctctgtcaaatgggcagaagaatatccttttgatagaattaaaatatacgaaaaccaaata

SEQ ID NO: 729671 - DNA, 374 bp, Homo sapiens; identical to SEQ ID NO: 401187

SEQ ID NO: 729672 - DNA, 623 bp, Homo sapiens
tgggcagggcccaggcatgagatcagagtcacaacatgtaggtgctgggccaagtgatatgtcacaatgcccactgtagacaggttccaggaagaaaaggagcatcacatcatctaggtgataaaccctgagatatctcacaatgacccctttgtgcagagatcacaaagaagaatcatataacctgtgtgctggatccagtggtatgaaagtcaacacctgtattttgggtctaagtacatgagacacaatggtggacaatctatactgagagcctcaattcttcctgtagacagtgtctcctcagtggagtaaaagcctcacggtgtgttgaatcttggtctgagagtcgccaacccactggtggaccggatccacttacaagagtcaatgttcaaactttcaactgtctccagctgtgagattcagaacctcaacagggatgcaggttatgaagatgagagcgtgagacagcgagctgtaagggaagcaggttacccagggatggacagaggatgggccctggccctcatgttatgaagcttctccacgtggtgccttcctctgtcaaatgggcagaagaatatccttttgatagaattaaaatatacgaaaaccaaata

SEQ ID NO: 729673 - DNA, 608 bp, Homo sapiens; identical to SEQ ID NO: 401189

SEQ ID NO: 729674 - DNA, 503 bp, Homo sapiens
catgtgcaacaaacggagatttcacagactgtatcaactgggagtcaatcatcttgagttgcagcgtacccgataccttaccaaatggacctgtcttgtggttcaagggaacagggccaaaccggaaattaatctacaatttcaaacaagagcagaatccaagacctcccaagaacagacctgcaggcagagcaggctccagggcccaccatgatgcccatacctgcctctcggccctgcctgagagaaacagcacaaactatttcgtccaaccctgctgctgcctccggctgctgggactcacaggcttgctgtcaaaataatccaaacagggaaggaacgtacaagtaaataacaaaagcccccatactcttctgactccctggagacagctactttttaggagtttcatttgccttcttcaagagagctttcttccactgacataaaatgccagcttgatcgtacaataaatctgtctatttacctgggtccaaaaaaaa

SEQ ID NO: 729675 - DNA, 521 bp, Homo sapiens
catgtgcaacaaacggagatttcacagactgtatcaactgggagtcaatcatcttgagttgcagcgtacccgataccttaccaaatggacctgtcttgtggttcaagggaacagggccaaaccggaaattaatctacaatttcaaacaaggtaactttcccagagtaaaagagattggagacaccaccaagcctggcaacacagacttttccacccgcatccgtgaaatctctcttgctgatgctggcacctattactgcgtgaagttcataaaaggaagagctatcaaggagtaccaatcaggtcggggcactcaggtgtttgttactgtctcttacagttctagaagccagaagtctgaaatctgcatctctggactgaaatcaaggcatcagcagaactgctccttctggaggttctaggagagagcatattccctttctcttttggcttctggtttgctgccagcatccctggcctgtcagcagcatagaataaatcttcaaggccagtgtcaaatc

SEQ ID NO: 729676 - DNA, 355 bp, Homo sapiens
aggcaagaactgtcttctctgctcggagcactgagtcgagggcatctccaggacaggcattcaggcagagcaagctccaggtttcaccacaatgcccatccctgcctccccactccacccacctctgccttccttactgctgtatctgctgcttgaactggcagtctcttacagttctagaagccagaagtctgaaatctgcatctctggactgaaatcaaggcatcagcagaactgctccttctggaggttctaggagagagcatattccctttctcttttggcttctggtttgctgccagcatccctggcctgtcagcagcatagaataaatcttcaaggccagtgtcaaatc

SEQ ID NO: 729677 - DNA, 533 bp, Homo sapiens
gtaactttcccagagtaaaagagattggagacaccaccaagcctggcaacacagacttttccacccgcatccgtgaaatctctcttgctgatgctggcacctattactgcgtgaagttcataaaaggaagagctatcaaggagtaccaatcaggtcggggcactcaggtgtttgttactgagcagaatccaagacctcccaagaacagacctgcaggcagagcaggctccagggcccaccatgatgcccatacctgcctctcggccctgcctgagagaaacagcacaaactatttcgtccaaccctgctgctgcctccggctgctgggactcacaggcttgctgtcaaaataatccaaacagggaaggaacgtacaagtaaataacaaaagcccccatactcttctgactccctggagacagctactttttaggagtttcatttgccttcttcaagagagctttcttccactgacataaaatgccagcttgatcgtacaataaatctgtctatttacctgggtccaaaaaaaa

SEQ ID NO: 729678 - DNA, 1955 bp, Homo sapiens
agctttggcactgcctgacaaggttctgctggaggacgccatgaagctcttcgactgcctgccaggcgcctctgagcctgagggtaccctgtgcgaggtccctgggccggccctgcctgacagcagtggtgggaactcagccgatgacatccgctcgctgtgcctgcccgaggagctgctgtcctttgactacagcgtgcctgagatcctggacaccgtgtccaacgttgactacttcttcaacttcaaggcgctcgacgaggagcagccgccccacccggggccccctgccaccaacaccccggcccccattctgtctggcaagagaaaggcctcgacggccaagaagggaaagccgggaaggaaggccaggcagccggcaggcccagccagcgccactcccccggggcccagggaggacctgggagccaccccgcattaaagcacatttgacctttcaaaaaaaaaaaaaaaaaaaaaaaaaaaaaaaaaaaacaaaaaaaccccgcagaggcctcataatgtgcggcgggggcgggaaacaagcggagaaaaggaaagcgggccaagtgggcaccaacagcggcggtccacgcggcccacacacattatcgtggtgcacaccaaggggggaaaacattcggcgcgggatccccccaatatagaggaagagagcgcgaatatataaaactcgcgagagaaaacgccgaggggtaacccgcggggatatcagaggaaccgcccggaaaaaaaaagacaagaccgacacacgaccacacacacgacgaccgacaaagacaaaaacccaaaaagaagacaagagacaaagaggacacaaaacaacacaaacctcaagaggacaaacaaaacaacagacggagagaaaaagagaaaacaaaacgaacaacaatacacacgaacaagcaacaagacacaccagcgacaccgcacaaagacacacccacagccacagaaaacaaaacagaaacacaaagaagggacccccgcaccacaaaacgaacacaacaccaccacagacaagcaccgaggaagaggagcgggagaggagagagagagggggaggcggcgggagacgcggaggcaaggagaagggacggaggcacagaagcagagagacaacgaagcgaacggcagagcacgacgcgcgagcggaggaggcgcaggaggcgcgcagggaggagagggacagacggcgggcggagggagcagagacggcagagagcacgcaagcaagaaggcgagagggaagagaggagagagagggaggaggaggcagagagacgcgaggagcgagagagggcggacgggcgccgggcgcagggggccggcagagcgcgacggcggagggcgagaggggaggcgcgggcaggcaggcggagcgacagcacaagagcacaaggcagcgcgagcggaagcagagaggcgacgccggacaggaagggagagaaggcgggggacaaaaccagccgggggagaacaggggggaggcaggaaagagcgcacaaggcaggcgcaagggcgagggagagaggcgcagggggggaagcaagggagagggagcgaaggagagaaaggaaggccgcccagcggcaaagaggacggcagacgaagcaacggagcgaaccaacaggcagacacgagcaggacgacgccaagcacgagaggaacagcaggcaggaagagcagcacaaacaacaagaacgaaagagaaggaggagcaaagggaggaggaagcggcaggggaacgcaaccaaagaaccgagaggagcgagacacgggacagaggaagcgaacgcagagcgagaagcgacccagacacaagagcgagccaacagaacaacgacgagcaaagcagacaacggacagacaaccaaagacagcaaggaaggcgagacacaggcaagcagcagagcgaaaagacacacaggacgacg

SEQ ID NO: 729679 - DNA, 4984 bp, Homo sapiens
  misc_feature (1091)..(1092): n is a, c, g, or t
  misc_feature (1095)..(1096): n is a, c, g, or t
  misc_feature (1104)..(1104): n is a, c, g, or t
  misc_feature (1109)..(1109): n is a, c, g, or t
  misc_feature (3874)..(3874): n is a, c, g, or t
  misc_feature (4509)..(4509): n is a, c, g, or t
gggcccggaggactctggagctacctctagctgcagcactgcctctggatggggacttccccatgctgtgggctgtggctccatagcgggcactggaagttcctctctctctgcacgtgcggcaagagctgaaaaaggagaaagggtcactgagcaggttttctgtgtctgagccccagagttcaatctctgctgaccagacccccactgaccagacccctgagcggtggtgttcagagtcccctaccaatggcccttctcagtccacagacctctccctcccctcatcagcacccacaggtgactgagagtcttctcgggactggaccccaactccaggacacagggaggggcagtttgtcccaggctccgggtgctgagcttcacgcttgtgccacaaggtcctctgggccatctcaaagggggcagtgatgtggcctcgcacatctggatgcactgtctgggcctattcctgagccacatagccagaggaacaggaagctgtttgtcaacccaggcaccccactctgctgggtctcccagggtccttcccatggaggccagatccagagacacagcacagaggcagcagggtgaccggcccagaacccttgagactaggctggggacgacaggaggactgtccccagacaaccagaagaccctttgctagtttcttgatacttcatttctcacctgctacccttactccaccagaaatccccttcatgcagagtcaatgaggagaggaagacggacacagaatctgtggaaagaaagaaaacaaaagatgggtggggagaagagttgggagtgtaacgttgtaagcgtcctacactatgcgtattatttgagggttgattaattaaaggtgtgccttgtagacaaccattacacacactataaataaattttatatatatatacatatatatatatacatatatatatatgtatatatatatatatggagagagagagagagagacagggtcttgctccgtcacccaggctgaagtgcagtggcccaaacacagctcactacagccttgacttcccaggctcaagcaatcctcccacctcagcctccnnaanngctgggantacangtgtgagccaccgcgacttgccagctctgtctagttgagaggtgcagtgcctctcctgtgggccggtgtgctgtgggacctcccgccctgccgccctgccgccctgccgctgcccgagggctcacccggctgtagtcctccacgtgctggagctgggtctcctggcagatgcacaggttcaggaagttctgccactccatcttcagggcctcctggtgggcctgggtaccgcagcacggagccctcggaccacgccccgcccccgcacccacgtccaccccccccttccccgcccaccacgtcccttctcactctcgccctgcccccagcgcacctggatgggccccaccgcggggtgccgcagctccaccatgcgcttgccgtcctcctccagctggtttacgctctgctcctggctcagcagctcgtgctgcttgaagtgctgggggcgagtcgggtggggagcggcggtgaggaccaggatggccctggtcgcccccgcctggccccaacctctgccagccgacctcgtattcccgccgcacgcccgcagggtcggccatgaggtcgctccagtcctgctgcaggatgcggcgctgctgctccgccagggcgctcagctgccacgtgcagccctgcagtgcgtgtacaggctgcccaggctctgcccgcgccacgacgccgccctctgtgctcaggacccgccgccagcagcagggtggggagagagaaagtggggggcaaaaggcgccattgggcggcgctcaggaacactggccccgggcagggtccgggcggccacccaggcccacctgcagccaccctgcccgaccctccctcctgctcaccagtaggtctcggtattggctccggatggtggcggcatcctgccttgaccaaggggagaaacaagcccgtgagaggtggggcacagggagacggccccctaagatctgggcaagccataccccacccacccctatccccagggcccagccgatctagctccggctctgactggaaaaacaggggctggggctggccccggatgtaacatcttcccggctcacccaccggccccaccaggctccgcagctgctctccttggtcgttgatctccttctgcacgatgttgagctccgcgatctgttcctccagctccgccatgcccggcccatactggcctgcgcagaccagcttctgcaggagagccggcggctcagtcaccacaggaccagggtggagagccagagaaccccacacgtctcccacccggagaagtggacttggtcatttgggcagagcgtggacgagcctgagagcagcccgggtgcacgccctgcagctcacccagggtgagccattctgctctgcagggtggccactgcagaggccattctgcagtggcccctgagtcccactggttcccagacgctgggctcagcctcagaagtctccagctccatcctgccttgtctgtgacccagcctcagtgcttcctgcctggacacctccagccaagctctagggccctcagaacgccctgctgcacccgggcccttccccactgttcctctattgtcatgatgacaccccttctgtgtggcatcaaagcacaactcctcaaccagggatcagaatgccccatgtcctggctctgcccacctggccagaaatccccacttcccatcgaatcctaggcttcctcctggcaggtgcctttgctccttctttctggaattgtcctctcctcactacttcaccctgacccaaccgagccctctcacccctctgaggtctcttcatgtgcctcctcctacaggaagtcttccctgactgcactgtctcctctgctgtctccctgcccagacccctgagacaccactatacactgactgttcaagcctacagtcaggccctgggttaaatgcagttccgtatcaccctctgatcacactggggtgtgactttgagctcctgacctgtttctgctccagcacgtgtgcccagtcgaccttggatcccacgtcggggcggcagcaccatcttctcgtacagggcacagtactccgcacactcctgggtcacccgctcgtgcagctgctcgatgctgtcaagaaggtggccagcaggtcagggctgggcctgggtcttccccagggacccccagccctgccgcagccccactcactccttctcagtctcctcagcctgcgggtgcttgagccgccgggccttgtccacgtccaggaagaggtccttgagcagcacctcggcctccttcaggctgctgcccgtctcctgctggtgctgcagggcctggctctgctcactgttcagccggtcctgtgggcaggggatgggcagacttgccagggtccagagcccccacacccctgctgcccatcattgtgggcctgagccccacctttgggaccccagctatgctggccaacctcgaggcccacgccaggcacagggtcaggcccagggcgtccatgaggcaggtgacaaagacacaggggagcccagcaaagaaggaagttgagccctctctcccaccgtgtgttaggggacaggcggtgcaggacaaatgtcatctgtcccatcttcaccatcaccagggggcactcagggagtgccaggcctgatgatgggcctcccatgccacccagcctgcccacaccctgccaactgctgccgggttctcacctgctgcagcctcttctgcgtctccaggatgtcccgctccacctggtcggcgntggcttgcatgtgggagatgagcagggtcagctcctgggtggcattcttggtgggtggaggggacagtgggcagctcggtggaagaggcccctctgtgccccatccaggtggcgtcccctgccctctctccaccccatcccgcccccacagcctagcacactgccctgactttggggtctctctctgcaggaggctctgtgagctagacctggttgggggtgttagcactgccccgccacatgaggggtcaaaaggtgagggtctcaggtctgtgtggtgctgggtgtcaggcggcctcggtgtcccagcctcagccagctgtgctggcagtgagttcccgaccccacccagctgcctgccacttcccccctgtgagccggtagtacctgagccagcctggctgggccctgggaggggcagttgggctggctggggcagggaggcagcagcatgccccccacccccacctcctcccactccagccctgtgttcccctatacctcctccaccccagggagctttgccagagtgctggcttcagcagccgtctagaggagcctcacactgtcagagtcggggagcgggggcaggcgcaagagactgctgggcaccctaacattctccagagttgagngttcaaagcccagattgtgccctaacttgctctgagttacgtggtcagggacggaggggaaaccttgcttccaccccagggctttttctgtgcattcgccctgcagcctccatagagcacctgctgtgtgcatgcagtcactctgtggaggtcacaaggccaagcagacctaaaagagggcagattggtccaagccttatgagcacagtgccttatgggggatcattatcctggggcaggggaagccttgaactgggtcaaaggatgggcccccccaggcaacgggacagtgctggtgaaggcacagcagtctggaagaactctgtggccaagacagcctggtttcatctttctccatcattaatgctgtgtgaccttgggcaagttactcaacctctctgtgcctgaggttcctcactcgtaaagcaggattttaataaaaatatctatgccttagggctattgtgagcattaa

SEQ ID NO: 729680 - DNA, 441 bp, Homo sapiens; identical to SEQ ID NO: 728394

SEQ ID NO: 729681 - DNA, 941 bp, Homo sapiens; identical to SEQ ID NO: 252598

SEQ ID NO: 729682 - DNA, 690 bp, Homo sapiens; identical to SEQ ID NO: 250865

SEQ ID NO: 729683 - DNA, 568 bp, Homo sapiens
tggtggctcaattttaaccccagcagccaatggaaaaatcacgacttctgagactttgggagtttccacagaggtgagagtcgggtgggaaggaaacaaaacaaaacaaaaacatcaaaccaatgaaataaaataaatcatgtctcctgctagaatagtattggatacctgactaaattacacaaaatagaccataataggatagcgctgtgaatacatccttcccgatcactgagtcacagtgacccttggctgctgctgttctcttctgcaaggttgaagcttgacgtgtgatgaacatgggtgggctcttggtccaccccaggctggggcctgcgccaagcatgaactagctgggaccagtggctgacagaacacaggacttccctaagtacccgtaggtctgtggagcaagacagagcagagttgccatgtcaacacatggggaatgatatgatagaaacaatctttatgactaaaagaaactcatcttcttcattaaaaaaactttggtgtccttaatctctctgaatttggctgtgtaataaacaactggaactgactcaca

SEQ ID NO: 729684 - DNA, 703 bp, Homo sapiens
tggtggctcaattttaaccccagcagccaatggaaaaatcacgacttctgagactttgggagtttccacagaggtgagagtcgggtgggaaggaagcagggaagagaaagcaggcccagctggagatttcctggtggctgtccttggccccaaagcagactcactaatcccaaacaactcagctgccatctggcctctctgaggactctgggtaccttaaagactataaaacaaaacaaaacaaaaacatcaaaccaatgaaataaaataaatcatgtctcctgctagaatagtattggatacctgactaaattacacaaaatagaccataataggatagcgctgtgaatacatccttcccgatcactgagtcacagtgacccttggctgctgctgttctcttctgcaaggttgaagcttgacgtgtgatgaacatgggtgggctcttggtccaccccaggctggggcctgcgccaagcatgaactagctgggaccagtggctgacagaacacaggacttccctaagtacccgtaggtctgtggagcaagacagagcagagttgccatgtcaacacatggggaatgatatgatagaaacaatctttatgactaaaagaaactcatcttcttcattaaaaaaactttggtgtccttaatctctctgaatttggctgtgtaataaacaactggaactgactcaca

SEQ ID NO: 729685 - DNA, 1166 bp, Homo sapiens; identical to SEQ ID NO: 250868

SEQ ID NO: 729686 - DNA, 508 bp, Homo sapiens
ccaaagcagactcactaatcccaaacaactcagctgccatctggcctctctgaggactctgggtaccttaaagactataaaacaaaacaaaacaaaaacatcaaaccaatgaaataaaataaatcatgtctcctgctagaatagtattggatacctgactaaattacacaaaatagaccataataggatagcgctgtgaatacatccttcccgatcactgagtcacagtgacccttggctgctgctgttctcttctgcaaggttgaagcttgacgtgtgatgaacatgggtgggctcttggtccaccccaggctggggcctgcgccaagcatgaactagctgggaccagtggctgacagaacacaggacttccctaagtacccgtaggtctgtggagcaagacagagcagagttgccatgtcaacacatggggaatgatatgatagaaacaatctttatgactaaaagaaactcatcttcttcattaaaaaaactttggtgtccttaa

SEQ ID NO: 729687 - DNA, 533 bp, Homo sapiens
gaagttacagcagcgcccaggcagcctgacagagatcattcaaggggggaaaggggaagtgggaggtgcaatttctcagattggtaaaaattaggctgggctggggaaattctcctccggaacagtttcaaattccctcgggtaagaaatctcctgtataaggttcaggagcaggaatttcactttttcatccaccaccctcccccttctctgtaggaaggcattggtggctcaattttaaccccagcagccaatggaaaaatcacgacttctgagactttgggagtttccacagaggtgagagtcgggtgggaaggaagcagggaagagaaagcaggcccagctggagatttcctggtggctgtccttggccccaaagcagactcactaatcccaaacaactcagctgccatctggcctctctgaggactctgggtaccttaaagactataaaacaaaacaaaacaaaaacatcaaaccaatgaaataaaataaatcatgtctcctgctagaatagtattggatacctgact

SEQ ID NO: 729688 - DNA, 837 bp, Homo sapiens
gcgccacaacttcactgccattttgtgaggtgccgccgtctctcctccagcaaggtcaggacttcaggactgaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaactggccttccagaggctaagaaatttctgttagtaaaagatgttctttttc

SEQ ID NO: 729689 - DNA, 783 bp, Homo sapiens
gcgccacaacttcactgccattttgtgaggtgccgccgtctctcctccagcaaggtcaggacttcaggactgaaacaatgaccgataaaacagagaaggtggctgtagatcctgaaactgtgtttaaacgtcccagggaatgtgacagtccttcgtatcagattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaactggccttccagaggctaagaaatttctgttagtaaaagatgttctttttc

SEQ ID NO: 729690 - DNA, 525 bp, Homo sapiens; identical to SEQ ID NO: 251791

SEQ ID NO: 729691 - DNA, 356 bp, Homo sapiens
ccgtctccctcttctaccgcaatgactccgcccacctgcccctgcctctcagcctccccgggtgcccggccccctgtccactaggccgcttctaccagctgactgccccggcccggcctcccgcccatggggtctcctgccatggcccctatgaggctgccatccccccagctccagtggtgcccctgctggccggagctgtagctgtgctggtggcactcagcttggggctggcctgctggcctggagaccagggtgcctgcggccttggggggccccgtgtgagccagaaaccagggcttccctacccccagctgacactggaccccaacatgtatgctcagtagctgctctgg

SEQ ID NO: 729692 - DNA, 2353 bp, Homo sapiens; identical to SEQ ID NO: 252569

SEQ ID NO: 729693 - DNA, 1358 bp, Homo sapiens; identical to SEQ ID NO: 253728
  misc_feature (4)..(4): n is a, c, g, or t
  misc_feature (6)..(8): n is a, c, g, or t

SEQ ID NO: 729694 - DNA, 516 bp, Homo sapiens; identical to SEQ ID NO: 253729
  misc_feature (4)..(4): n is a, c, g, or t
  misc_feature (6)..(8): n is a, c, g, or t

SEQ ID NO: 729695 - DNA, 748 bp, Homo sapiens
ggataaggagtggatgcctgtcacaaagctgggccgctttgtcaaggacatgaagatcaagtccctggaggagatctatgtcttctccctgcccattaaggaatcagagatcattgattcttcctgggggcctctctcaaggatgaggttttgaagattatgccagtgcagaagcagacccgtgtcggccagcgcaccaggttcaaggcatttgttgctatcggggactacaatggccacgtcggtctgggtgttaagtgctccaaggaggtggccaccgccaaccgtggggccatcatcctggccaagctctccatcgtccccgtgcgcagaggctactgggggaacaagatcagcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagc

SEQ ID NO: 729696 - DNA, 562 bp, Homo sapiens; identical to SEQ ID NO: 728395

SEQ ID NO: 729697 - DNA, 388 bp, Homo sapiens; identical to SEQ ID NO: 256671

SEQ ID NO: 729698 - DNA, 200 bp, Homo sapiens
ttccagccttggtgctgcccacagggtggattatgacatactgctaagccctgcactcaggttggattgtgacatacactttagcacagctcatggttgtgatgatgacacttacgccacaaaacagccaataggagagatactgccacttgtagctagacttacagaaatgaataaactcctgagtcttctgtagtaaa

SEQ ID NO: 729699 - DNA, 427 bp, Homo sapiens; identical to SEQ ID NO: 256673

SEQ ID NO: 729700 - DNA, 559 bp, Homo sapiens
cagcctggaagtccataggactgtgatgaagatgactgcttgcattttctgaatcactttgtcgatgagacatgcatcctattagatctaacaaagcttcacagaaaggttgttttgaagttgacactgaggaagatataagtgctctaggatcagtatgtgaggctgccacaaacatgctatagtctgcacattcttgcagagaggttgcagagtctgcttgggagagaagcctcaaaaacatggctggtgtcttggcagagtttgctctggcccccaggagggtgtacaaacagccttcatgagaaggtgacttgctggccactcttaaccactagaagaaactgatgccatggaactttgaaaaatcagaaagcaattccacaaaagaagaacctctgaagatagtagagcccaatgaagataaatgacatcgcccataggagggaacagtggtatcaacctaaaggggctcactgccctatgtgctggaggccaatactatgacaatgggtttttgagaaaataaaagctttgcattgagattcaacccctaaaa

SEQ ID NO: 729701 - DNA, 519 bp, Homo sapiens; identical to SEQ ID NO: 295139

SEQ ID NO: 729702 - DNA, 521 bp, Homo sapiens; identical to SEQ ID NO: 286531

SEQ ID NO: 729703 - DNA, 472 bp, Homo sapiens
cttattaactgtgtgttttcctcttcgagaacttgtatcgtcaataacgtcatcgtgaaccagactagcagtgtggatcatttctgcaattaaggctatggcgcggtggctggcttgcacatgtcaaattaacagacagcaatgctttttaacagacgccgcctagaaccttctcagcaatcagcttgtgaaaattggacatcggatcgggagttgttatgatggatattacatgctcgggccattagcaccccaataattggtcgaaaggcttttccttttccatcaaagtagtactcagacatttcctgaagttctgttgttgatatgagcagttcctttctaatgtcctcatacagacctttcaagtctctgcaaccgaatttgaaaggatcggtgatctgtatatttctcaccactgtgtgttttactgtccggggttgtgtgataaaaccgtgatatactgtataca

SEQ ID NO: 729704 - DNA, 502 bp, Homo sapiens
  misc_feature (42)..(43): n is a, c, g, or t
atcaaattagacgatgctgccatgttaattctccaaacgagnnacaaaagtgtatagagaacttgtatcgtcaataacgtcatcgtgaaccagactagcagtgtggatcatttctgcaattaaggctatggcgcggtggctggcttgcacatgtcaaattaacagacagcaatgctttttaacagacgccgcctagaaccttctcagcaatcagcttgtgaaaattggacatcggatcgggagttgttatgatggatattacatgctcgggccattagcaccccaataattggtcgaaaggcttttccttttccatcaaagtagtactcagacatttcctgaagttctgttgttgatatgagcagttcctttctaatgtcctcatacagacctttcaagtctctgcaaccgaatttgaaaggatcggtgatctgtatatttctcaccactgtgtgttttactgtccggggttgtgtgataaaaccgtgatatactgtataca

SEQ ID NO: 729705 - DNA, 388 bp, Homo sapiens
cttattaactgtgtgttttcctcttcgagaacttgtatcgtcaataacgtcatcgtgaaccagactagcagtgtggatcatttctgcaattaaggctatggcgcggtggctggcttgcacatgtcaaatttgttatgatggatattacatgctcgggccattagcaccccaataattggtcgaaaggcttttccttttccatcaaagtagtactcagacatttcctgaagttctgttgttgatatgagcagttcctttctaatgtcctcatacagacctttcaagtctctgcaaccgaatttgaaaggatcggtgatctgtatatttctcaccactgtgtgttttactgtccggggttgtgtgataaaaccgtgatatactgtataca

SEQ ID NO: 729706 - DNA, 480 bp, Homo sapiens; identical to SEQ ID NO: 263067

SEQ ID NO: 729707 - DNA, 444 bp, Homo sapiens
aggttaagcatgaatcgaggaaaggaaacagaaatcctcttcctagtcctctttcctctgttttctcctctgggtaccagaattgcgacagagtgggacagctcaggcagctgcaggtcttggccagtgctcttcctcacccaggccatgcagcatcaacacagtcaccgtagaactcctcttaagacaagcaaaggaactttccaacccagtactcagggagttttgagattttccaagatgccatcgaggaactgaaaagtgctgcccagctgcagtgagggctttttaaaggcagtttcatgtctacaccccactgagttcagactgtccaatgaagcactgacattgttacacatgcgtgttgtggacaacttgagaaaacacttgtctgcaggaagatgaaattaaaatcaagtgtgatcctaccaccgaaagataagt

SEQ ID NO: 729708 - DNA, 259 bp, Homo sapiens
aggttaagcatgaatcgaggaaaggaaacagaaatcctcttcctagtcctctttcctctgttttctcctctgggtaccagaattgcgacagagtgggacagctcaggcagctgcaggtcttggccagtgctcttcctcacccaggccatgcagcatcaacacagtcaccgtagaactcctcttaagacaagcaaaggaactttccaacccagttgagtgcacttttcccaagtgtgtggtaaaaagttaaatgacactt

SEQ ID NO: 729709 - DNA, 582 bp, Homo sapiens; identical to SEQ ID NO: 265123

SEQ ID NO: 729710 - DNA, 987 bp, Homo sapiens
attgtcaaaatatgtaactggaggattacagtatgcttacctctgattttatttctacagtgctgctataagtaacaatgagtaaatctactaaattatgtggtaagacttcttgtccaagaagcaatatattctgcaatctccttgacaaaattgttaaaagaccctccctacagtttttgggtcagtggggatatcactgttacgaaccaaggatttacagatcactggcaaaaattctgaggtatgtggacttggatggttttgacgcactactcacagattacattgcatttgtggaaaaatcaggataccgttttgaagtaagttttaacctcgacttcactgaaatatgtgtgaatacaattctgtactgggtttttgccagaaaaggtaatcctgactttgtggaattgcttctcaagaagacaaaagactatgttcaagacagaagttgtaacctggcactgatatggagctcagacaagacagtctaatatcttcaaaatactactgcaatatggaatcttagaaagagaaaaaaaccctatcaacattgtcttaacaatagtactctacccttcgagagtaagagtaatggttgatcgtgaattggctgacatccatgaagatgccaaaacatgtttggtactatgttccagagtgctttctgtcatttcagtcaaggaaataaagacacagctgagtttaggaagacatccaattatttcaaattggtttgattacattccttcaacaagatacaaagatccatgtgaactattacatctttgcagactaaccatcaggaatcaactattaaccaacaatatgctcccagatggaatattttcacttctaattcctgctcgtctacaaaactatctgaatttagaaatctaacatacgtcagtgtcctaagttccttaacaatgcttaccaatgtatggcttagaagttaataaaaattcacttcatgtaagtttt

SEQ ID NO: 729711 - DNA, 521 bp, Homo sapiens; identical to SEQ ID NO: 263755

SEQ ID NO: 729712 - DNA, 5803 bp, Homo sapiens
  misc_feature (4176)..(4176): n is a, c, g, or t
  misc_feature (4249)..(4249): n is a, c, g, or t
  misc_feature (4320)..(4320): n is a, c, g, or t
agcccagacactggggctccagtgtttgtcaccagggggcgccggaaggggcgcgccgggcggtcggcggcggccgttggcgagctgaggcctgccaggcgaagtctggagaccagccgggccgcggccgcaatggccaaggactcgcccagccccttgggcgcgtcgcccaagaagccgggctgctccagcccggcggcggcagtgctggagaaccagaggcgggagctggagaagctacgggcggagctggaggcggagcgggcaggctggcgggcggaacggcggcgcttcgctgcccgggagcgccagctgcgtgaggaggccgagcgggagcggcggcagctggctgaccgtctgcgctccaagtgggaggcacagcgcagccgggagttgcggcagctgcaagaggagatgcagcgggaacgcgaggccgagatccggcagctgctgcgctggaaggaggccgagcagcggcagctgcagcagctgctgcaccgggagcgcgatggcgtggtgcgccaagcccgggagctgcagcgccagctggccgaggagctggtgaaccgcggccactgtagccgcccgggggcgtccgaggtttccgcggcgcagtgccgctgtcgcctgcaggaagtgttggcgcagcttcgctggcagactgacggcgagcaggcggcgcgcatccgctatctgcaggcggcgctggaggtggagcgccagctcttcctcaagtacatcctggcgcacttccgcgggcacccggctttgtcgggatcaccggacccccaagctgtgcattccttggaagaaccgctgccccagacctccagcggctcttgccacgcccccaaacccgcctgccaactcggatctctagacagcctgagtgctgaagtcgacggcctgctctccacgcacgccagctcccttgattgcttcgcacctgcgtgttcccgctcgcttgacagcacccggagcctccccaaggcctccaaatccgaggagcggccctcctcaccagacacctccacccctggctcccggaggctctcgccgccaccatcgccactcccgccgccaccaccaccgtcagcccacaggaaactcagcaacccgcggggaggagaaggctctgagagccagccctgcgaagtcctgactccctcacccccgggcctgggccaccacgagctgataaagctgaactggctgctggccaaggcgttgtgggtgctggcgcgccgctgttataccctgcaagaggagaacaagcagctgcggcgtgcaggctgcccctaccaggcagacgagaaggtgaagcggctcaaggtaaagcgcgcggagctgaccgggctcgcgcggcgcctagctgaccgcgcccgcgagctgcaggagaccaacctccgggccgtgagcgcgcctatacccggcgagagttgcgccggcctggagctgtgccaagtctttgcccgccagcgcgctcgggacctgtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcacgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatggggggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgacgatggccggcgggggctggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggaatggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggtgcgggtggaggtgcggctgccatgggacttgctgcaggtgtattggggaactatgtcctccaccgtcaccttcgacacactcttggcaggacctccctacccaccgctggatgtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccgtattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctaccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggngccagccaacagtatgcatctgacttccataacgttttgaaggaggagcaggaggcactgtgcttggatctgnggggcacagagaggcgagaggagaggagggagcctgagccccacagcaggcaaggacaagctctgggggtnaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggcacctgccttctgtggcccacctcgaggactttcaggggctcaccatcccccagggttcctccctggtgctccaggggaactccaagagactcccactgtggactccaaagatcatgatagcagctctggactatgatcctggggatgggcaaatggggggccaggggaagggcaggctggcgctgagggcaggagacgtggtcatggtttacgggcccatggatgaccaaggattctattatggagagttgggcggccacaggggcctggttcctgcccacctgctggatcacatgtccctccatggacactgagcaagcatccttgcccaggtagtggcctctggctgctcacaccctgccagaggagaagcaagcgttcagaccctcacaccagcacccctcctcaccaccataagtagcatgtgctccaagtgccactgtgttaaactgatggtagtccttaagtgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatcttaaaaaagaaaaagcaatctgagtgttatttttgggatgtgagggtgatctggctgcgacatgtgtcaccccattgatcatcagggttgattcggctgatctggctgactaggcgggtatccccttcctcccgcaccactccatgtgcgtccctccagaagctgtgcgctcaatggaagaggatgaccatccccgatagaggacgatcggtcttcagtcaagagtataagagtagctgcgctcccctgctagaacctccaaacgagctctcagaatgttatttttctgtcttatgtccaacccctcattaaaatgttcatagaaaaaacatattttagaagttgaagcacaaccaaggaaacatgagcctggctttcctccctctcacttctgcgcactgggtccgcaagggctacagaaatgtttt

SEQ ID NO: 729713 - DNA, 4655 bp, Homo sapiens
  misc_feature (3275)..(3275): n is a, c, g, or t
  misc_feature (3348)..(3348): n is a, c, g, or t
  misc_feature (3419)..(3419): n is a, c, g, or t
acggcctgctctccacgcacgccagctcccttgattgcttcgcacctgcgtgttcccgctcgcttgacagcacccggagcctccccaaggcctccaaatccgaggagcggccctcctcaccagacacctccacccctggctcccggaggctctcgccgccaccatcgccactcccgccgccaccaccaccgtcagcccacaggaaactcagcaacccgcggggaggagaaggctctgagagccagccctgcgaagtcctgactccctcacccccgggcctgggccaccacgagctgataaagctgaactggctgctggccaaggcgttgtgggtgctggcgcgccgctgttataccctgcaagaggagaacaagcagctgcggcgtgcaggctgcccctaccaggcagacgagaaggtgaagcggctcaaggtaaagcgcgcggagctgaccgggctcgcgcggcgcctagctgaccgcgcccgcgagctgcaggagaccaacctccgggccgtgagcgcgcctatacccggcgagagttgcgccggcctggagctgtgccaagtctttgcccgccagcgcgctcgggacctgtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcacgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatggggggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgacgatggccggcgggggctggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggaatggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggtgcgggtggaggtgcggctgccatgggacttgctgcaggtgtattggggaactatgtcctccaccgtcaccttcgacacactcttggcaggacctccctacccaccgctggatgtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccgtattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctaccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggngccagccaacagtatgcatctgacttccataacgttttgaaggaggagcaggaggcactgtgcttggatctgnggggcacagagaggcgagaggagaggagggagcctgagccccacagcaggcaaggacaagctctgggggtnaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggcacctgccttctgtggcccacctcgaggactttcaggggctcaccatcccccagggttcctccctggtgctccaggggaactccaagagactcccactgtggactccaaagatcatgatagcagctctggactatgatcctggggatgggcaaatggggggccaggggaaggtagcatgtgctccaagtgccactgtgttaaactgatggtagtccttaagtgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatcttaaaaaagaaaaagcaatctgagtgttatttttgggatgtgagggtgatctggctgcgacatgtgtcaccccattgatcatcagggttgattcggctgatctggctgactaggcgggtatccccttcctcccgcaccactccatgtgcgtccctccagaagctgtgcgctcaatggaagaggatgaccatccccgatagaggacgatcggtcttcagtcaagagtataagagtagctgcgctcccctgctagaacctccaaacgagctctcagaatgttatttttctgtcttatgtccaacccctcattaaaatgttcatagaaaaaacatattttagaagttgaagcacaaccaaggaaacatgagcctggctttcctccctctcacttctgcgcactgggtccgcaagggctacagaaatgtttt

SEQ ID NO: 729714 - DNA, 1288 bp, Homo sapiens
ctccaggcggcccaggtctccgagcactcgggcctgcgcctgggtgctggcagccttgccgctcgctgtgccagtgcctggtgggccgttctggccatccagcatggtggactactacgaggtgctggacgtgccccggcaggcctcatccgaggccatcaagaaggcgtaccgcaagctggcgctcaagtggcaccccgacaaaaaccctgagaacaaggaggaagcggagaggagattcaagcaggtggccgaggcctacgaggtgttgtcggacgccaagaaacgcgatatctatgaccgctatggcgaggcgggggcggagggcggctgcacaggcggcaggcccttcgaggaccccttcgagtacgtcttcagcttccgcgacccagccgacgtcttcagggagttcttcggcggccaggacccattctcctttgacctcttgggaaacccgctggagaatattttgggggggtcagaggaactgctggggaagcagaagcagagcgtctgcaccccttttctctgccttcagtgaatttccagcttttgggggtgttttttcttcttttgatacaggatttcgttcctttggctccctgggaagtgggggcctttcttccttctgcatgtcctacggtagtgatgggacaggcagcttcaagtccatgtcgacttccactgaaatagttgatggtaaaaaaatcaccaccaagagaatcattgagaatggccaagaaagggtggaagtggaggaagatggagagttgagttaaagtccttcataataaacggcatagagcagttgctccccattgacaccaagtaattccagtccacatttgcctttaagcacatctggaggaatagcggactttttttaggattgaaagtgaactttactttcagaacagctgtacccaagaatttataaacactttatgccaacacctgttcttatcgttgggactacacggataggacctctgtttgtctttcaatcgttgtaaaatatctgtatgcaatttgctatttattaaacttaagcctgaggcagacaatgattatttgctagtggtaggacagaatgttcagttcagcactttgagcattacctttttccgttgggaaagtgtgagccaggtggtttgctctaaatcatttgactttattgtttagtgtgtagtggtgaaatctacaaataatatcaatacttctggcttaatttaatgatggttcaaaacaacatgcatttattatcttaatattttggaggtcagacatt

SEQ ID NO: 729715 - DNA, 1072 bp, Homo sapiens
ctccaggcggcccaggtctccgagcactcgggcctgcgcctgggtgctggcagccttgccgctcgctgtgccagtgcctggtgggccgttctggccatccagcatggtggactactacgaggtgctggacgtgccccggcaggcctcatccgaggccatcaagaaggcgtaccgcaagctggcgctcaagtggcaccccgacaaaaaccctgagaacaaggaggaagcggagaggagattcaagcaggtggccgaggcctacgaggtgttgtcggacgccaagaaacgcgatatctatgaccgctatggcgaggcgggggcggagggcggctgcacaggcggcaggcccttcgaggaccccttcgagatttcgttcctttggctccctgggaagtgggggcctttcttccttctgcatgtcctacggtagtgatgggacaggcagcttcaagtccatgtcgacttccactgaaatagttgatggtaaaaaaatcaccaccaagagaatcattgagaatggccaagaaagggtggaagtggaggaagatggagagttgagttaaagtccttcataataaacggcatagagcagttgctccccattgacaccaagtaattccagtccacatttgcctttaagcacatctggaggaatagcggactttttttaggattgaaagtgaactttactttcagaacagctgtacccaagaatttataaacactttatgccaacacctgttcttatcgttgggactacacggataggacctctgtttgtctttcaatcgttgtaaaatatctgtatgcaatttgctatttattaaacttaagcctgaggcagacaatgattatttgctagtggtaggacagaatgttcagttcagcactttgagcattacctttttccgttgggaaagtgtgagccaggtggtttgctctaaatcatttgactttattgtttagtgtgtagtggtgaaatctacaaataatatcaatacttctggcttaatttaatgatggttcaaaacaacatgcatttattatcttaatattttggaggtcagacatt

SEQ ID NO: 729716 - DNA, 485 bp, Homo sapiens
acacacacttcactccctggcttgccttgtatgggggtgagtatggaaccccgcagggactctgggctctccccacagagtcccatctagacctaaatgcagtcccaggtcccacaccccaacccccctccccccaccactgccacttccaaacccgccccgcagtctactgtgggaaggaggtggggtaggagggttctgagtgcctcccacacccagggcatgagctcagcagcctcagggttctggtgcttcctaggcctgactttacaatctctgcaggatctctcagtgagcatagctaccccaagcccctgagaatcgtgaatcccagagacagatgcctggagctgcttccagccctggggcaggcctcaaggggctacccactaggacccgtggccctccagggatgggaatgattgttttaatcacttttattttctaaatattaaagacattcttccttagtgaaggatatttgg

SEQ ID NO: 729717 - DNA, 609 bp, Homo sapiens
ttacttgtatagtccaagaagatatgcccactaaccctgctatcctagcagtgctggattcctctggcagaagttcctgctatcatcccaatggaaatgtctgggtatacatcaatatcttgggaggtcaatattcagatcaagccggcaacagaataagggcttggaattggtcaaattccatcacttcctcaccctttgtttcatttaaacctgtctttctggctttgaaccgttatattggagtccgcatcttagaacaagacaagatttctataacttttctagcaatgggccaacaggcaagaatcagtgttggaaccaaagtgaagctaccaaaccctgaggagattccaatcctccgatacgtaagtggagatgaccttcttctgctggccagtttaataaagatccgtcgcctgtttcataaacttgaaggatgtgtgaattttccctcaagccaggtttgggaaaaattaaagcaaccttcctacctttcttcactttctctaaaactaattgccctttgtcacagttctggtataaagcaagatataatgaagacaataagaaatataataaatgaagaaatttaactaagaaaaaaag

SEQ ID NO: 729718 - DNA, 1810 bp, Homo sapiens; identical to SEQ ID NO: 462386

SEQ ID NO: 729719 - DNA, 501 bp, Homo sapiens; identical to SEQ ID NO: 269278

SEQ ID NO: 729720 - DNA, 471 bp, Homo sapiens
ccagaaatggctttgctgccgaatgcattatcttgccattttcgtgtcccaatactgaacaaacgatcgcctgatcgatcggctgttgtccagctctaatgatgtcctagagcagaagtgtttcttctgatgtctcattttaacaagaggatgatgtctgtgtatgtctctgtgttttagagaggctggcaaatgctgctaagaggatctgaggttcacataaagaggatgaaaattctgaattactttcattgcaaataaaccttaacaattgtgagagttagagagcatacttttcacataagactttggtatgctgcctaaagctacttacataatttgctattcagagaaatgcatttgtttattgaggacccacccggacttaaattggaaaaatgtaacattcagatttttattttatatgtgaaataaatgtgtgattgctgttcttaaaaatttgaaaaaaaa

SEQ ID NO: 729721 - DNA, 460 bp, Homo sapiens
gtgagaaattctacactgaataagactggttgggactcaaagaagctacaaggatgcacttttccagcacaaacatgttctaggttggatgatcaaatgcatatgcctagcaattgaaatctccaactaggaacaaaaaactaatcacaaaaagcaaaggattcactttggtgttcacagtaggagcaacagcagcatcttgtttgcagttctggtagcagcagcagctgcaatggcttcagccatatcaaatatcctgtggcacagagggcttcgaggttaagagatacaaatttgcttaccgcatgaactttgcagtttgatttttactttgatttggtcaccttgctttctttgctcttgattgttttctagccctacttctgtgactacattaaataattctttagctaataataatccttccaataaattcactcttctgcttgaatgattcaca

SEQ ID NO: 729722 - DNA, 1003 bp, Homo sapiens
ccccaggacttctgctggaaccgctgggagttggaagctttcttcccactgaggggcaaaccttctaggtatctgaagatgttgaagaccatttcctggaacagcagaggtaaatgcccagaggatgagaacacatagccattaggagagcctgaaagttcagtgtgactgaaagatgaagttcaagagaagggacaaactgcaaaacacaagctggagagttttagagagactgtggaatggaatgactctccagagctgcagattgaaggcatattttcatctgactttggtgattatgtttccaatctctctgggaataagatctcaatggcgggaacaccttcatggcccctttatagctggtatgttttcttcttatggacaatgagaaacatgtaataaactgtgtttccttctcgctaggaaaccctgagttaaagctttacttccctctcaggaaccatcaaagagccataatctgtacaccctggtgcaacatttcccctggatttgatcccctttcaattgttttagccttattttacatttcttaaatctatttctctatgttgccatgtgtattatcaaatgctatttcagatgccaaccatgagctaaagcatatgttggaattattaagagaaacagagggatatacttatgtaaaataacacatataaatgcaatgctgattttttttccttaagaagtctttaacaattgcttcggaggaatctgcttttcactgaagcttcaatattttcagatcctttaataccaggtgtcaaacttattcactgggatgaattatagaaagttgcaccactttcttctgcctcatttattctcattgtaaatatgagaattttaaaaagtcttcctaattcttgctttatgatggattctatacaaacaattgaggtgctgttcactaaactactggaaacatggggaagtgagctaaggagataggaactatgaaatgacctgttttaagaaa

SEQ ID NO: 729723 - DNA, 971 bp, Homo sapiens
ccccaggacttctgctggaaccgctgggagttggaagctttcttcccactgaggggcaaaccttctaggtatctgaagatgttgaagaccatttcctggaacagcagaggtaaatgcccagaggatgagaacacatagccattaggagagcctgaaagttcagtgtgactgaaagatgaagttcaagagaagggacaaactgcaaaacacaagctggagagttttagagagactgtggaatggaatgactctccagagctgcagattgaaggcatattttcatctgactttgatctcaatggcgggaacaccttcatggcccctttatagctggtatgttttcttcttatggacaatgagaaacatgtaataaactgtgtttccttctcgctaggaaaccctgagttaaagctttacttccctctcaggaaccatcaaagagccataatctgtacaccctggtgcaacatttcccctggatttgatcccctttcaattgttttagccttattttacatttcttaaatctatttctctatgttgccatgtgtattatcaaatgctatttcagatgccaaccatgagctaaagcatatgttggaattattaagagaaacagagggatatacttatgtaaaataacacatataaatgcaatgctgattttttttccttaagaagtctttaacaattgcttcggaggaatctgcttttcactgaagcttcaatattttcagatcctttaataccaggtgtcaaacttattcactgggatgaattatagaaagttgcaccactttcttctgcctcatttattctcattgtaaatatgagaattttaaaaagtcttcctaattcttgctttatgatggattctatacaaacaattgaggtgctgttcactaaactactggaaacatggggaagtgagctaaggagataggaactatgaaatgacctgttttaagaaa

SEQ ID NO: 729724 - DNA, 906 bp, Homo sapiens
ccccaggacttctgctggaaccgctgggagttggaagctttcttcccactgaggggcaaaccttctaggtatctgaagatgttgaagaccatttcctggaacagcagaggtaaatgcccagaggatgagaacacatagccattaggagagcctgaaagttcagtgtgactgaaagatgaagttcaagagaagggacaaactgcaaaacacaagctggagagttttagatctcaatggcgggaacaccttcatggcccctttatagctggtatgttttcttcttatggacaatgagaaacatgtaataaactgtgtttccttctcgctaggaaaccctgagttaaagctttacttccctctcaggaaccatcaaagagccataatctgtacaccctggtgcaacatttcccctggatttgatcccctttcaattgttttagccttattttacatttcttaaatctatttctctatgttgccatgtgtattatcaaatgctatttcagatgccaaccatgagctaaagcatatgttggaattattaagagaaacagagggatatacttatgtaaaataacacatataaatgcaatgctgattttttttccttaagaagtctttaacaattgcttcggaggaatctgcttttcactgaagcttcaatattttcagatcctttaataccaggtgtcaaacttattcactgggatgaattatagaaagttgcaccactttcttctgcctcatttattctcattgtaaatatgagaattttaaaaagtcttcctaattcttgctttatgatggattctatacaaacaattgaggtgctgttcactaaactactggaaacatggggaagtgagctaaggagataggaactatgaaatgacctgttttaagaaa

SEQ ID NO: 729725 - DNA, 919 bp, Homo sapiens; identical to SEQ ID NO: 265686

SEQ ID NO: 729726 - DNA, 953 bp, Homo sapiens; identical to SEQ ID NO: 265685

SEQ ID NO: 729727 - DNA, 306 bp, Homo sapiens
agagactgtggaatggaatgactctccagagctgcagattgaaggcatattttcatctgactttggtgattatgtttccaatctctctgggaataagatctcaatggcgggaacaccttcatggcccctttatagctggatgatcatttcctgttctctccaccatggccacctggtccaagccaccatcttcatgcacctggatacctgccataacctcagctgacctttcctgtgtccattcttgttcctttgggcccagtctcctcgctcatagcagcagaatgagtctattaaaaagtgaaa

SEQ ID NO: 729728 - DNA, 952 bp, Homo sapiens
tttcttctccaattgttggggtaactggagtgaggagcctgaggggacccaaagatgttctcctggtaggattccctctcatggtcttctgcatttgtagacattttgattggttccatttctaagggccaattatctgtgctttaacctgaaataaggaacctgccttctgatcttcaaggatatgtacatggacacacatctttcagattcaactcttgagatttttggttttaaacaaacaattgtgttcatcacaaatgaagattccctcaagcagcagccgcctggaatcaactgctgagtccaaatcttgtagcccttaaaaatatttagtatttttactaagtaataagtatttagggtgttatgaaaaatgcaatttgaaaaagtacattggtttttaagaacaagaggaactatttagaaattatacaatatattaacaaaagtaaatatttaatatatctcaaacacaaaaatgcaaaaactggttaccaagcatcaagaaaaacttaaaacttgtaaaatacaaaggttaaatgtattttatcttcattctattattagcagataaccttaataaaaatgagctgttatttacagcaaaatatcatgtaattttagatttatcactttttatttctatggaaaagcaacaccagcatgtattgttgctgaaggtgaagcaactttttgattctgttctgttccactctgtgttctaagatgtgtgtcagataccggccacacaccctacatgtgctcggggcacagcctggccccacacagcactttagtctgcaggtgggcatctaaggccctgccattcccacttcttattgtcatatttacttagttctcagcacctctgcccatctttaaatgacttaagtgagagtatgttaaagtagcttacatgttcctaagcttcctcacagcacatcccatc

SEQ ID NO: 729729 - DNA, 472 bp, Homo sapiens
gccaagtcctggacagtctttaggccatgttggaactacatttggaaaggtggttgttaaacatttcccagcacacacctggatctgcatctgctgtgtcaattgaaccactcactggttctgtgacctcagttcttcgtagactctggaatggagctggaagctgtcatcctcagcacactaacgcaggaacagaaaaccaagcactgcatgttcccacttataagtgagagctgaacgagcagaacacatggacatatgaaggggaacaacacactctggggcctgtgaggtgcagggagagcatcaagaagaacagctaatgggtgctgggcttaatacctgggtgatgggttgatctgtgcggcaaaccaccatggcacacatttacctatgtaacaaaccttgacatcctgcacatgtaccccggaacttaaaaataaaagttgacaaaaagaaaacataacttact

SEQ ID NO: 729730 - DNA, 313 bp, Homo sapiens
ccatgttggaactacatttggaaaggtggttgttaaacatttcccagcacacacctggatctgcatctgctgtgtcaattgaaccactcactggttctgtgacctcagttcttcgtagactctggaatggagctggaagctgtcatcctcagcacactaacgcaggaacagaaaaccaagcactgcatgttcccacttataagtgagagctgaacgagcagaacacatttacctatgtaacaaaccttgacatcctgcacatgtaccccggaacttaaaaataaaagttgacaaaaagaaaacataacttact

SEQ ID NO: 729731 - DNA, 337 bp, Homo sapiens
aaacaaacattgacatcggccagattccactctcatatgacaatcaatgacagactttttcaatctgccaaaaactggactggaattgcaaacattcatttggccaccttggaggagaaactgaacaaatagcagcaaccccctcttccagaatgtgagagctccctccacctaagagctaaaagaagcaaatccttactagtaattaactattgcttctacaatgtattatgattcatcaaagcttttaatcatttatattttgcttacactattaataaaactacaatatgccctgagaacatagtaaattctagagaaatgcctatttaagatt

SEQ ID NO: 729732 - DNA, 966 bp, Homo sapiens
aaacaaacattgacatcggccagattccactctcatatgacaatcaatgacagactttttcaatctgccaaaaactggactggaattgcaaacattcatttggccaccttggaggagaaactgaacaaatagcagcaaccccctcttccagaatgtgagagctccctccacctaagagctaaaagaagcaaatgcaaagtttttcactggttttagagaaataatgctttagatataagcaagcatcacctatataattaggtgagccctgtgcccatgaatctagtcctttctacctctgatcacttgttcagtacagtcttatctgctaacttccctaaagtaatttatttaccaattacaatggaaaaacccaagacaatattctcagaagacttcagaacccaagttctcctcctttacacgctcagctactaagaaggctttcgtttccattaatccagtatttaactgaacaaatttttaagcccttatcaccaacataaaggtgcagtagaaagaaaatgagtataacacagttcccattaccatcaagcttatggttatgaagtgtgtatgggagagatgggagaaccatatcatatggtacactatgataagagtcacaggaccgcctgttcaggctcttcatctaaggagaaacatacgtgcagacagagcgacctacagtctgtgctacaacgacatcttccacgcatcctgagctcggtgttacttaccctacagtggaaatccaaatagtccaaatatcaaccagctgtttcagtgggtatgaaaaatgggacagataatccaaagcagccttactagtaattaactattgcttctacaatgtattatgattcatcaaagcttttaatcatttatattttgcttacactattaataaaactacaatatgccctgagaacatagtaaattctagagaaatgcctatttaagatt

SEQ ID NO: 729733 - DNA, 1158 bp, Homo sapiens; identical to SEQ ID NO: 264495

SEQ ID NO: 729734 - DNA, 392 bp, Homo sapiens
aagaatgctcctggggaagccccataggaaaacatcatggtgctgatgattccagattcagtattttagctctatcattcacaagtttggataaaattaatctagagaaagaattagaaaatgaaaatcataactaccatataggatttgaaagtagcattcctccaacaaattcatccttctcaagtgacttcatgccgaaagaagagaataaaaggagtggacatgtgaacattgtggaaccatctttgatgcttttgaaaggctctcttcaacccggaatgtgggaaagtacatggcagaagaatatagagtcaataggttgttccattcagctagtggaagtacctcaaagcagcaatacgagtctggcctctttttgcaacaaagta

SEQ ID NO: 729735 - DNA, 584 bp, Homo sapiens
agagatagctgcattctcatgtttattgaagtcctgttgaaatagccaaaatatggaatcaacctaagtgcccatcagtggatgaatggttaaagaaaatgtgattgatatgcaatggaatattattcagccataaaaaagaatgaaatcctggcggggcacagtggctcatgcaagtaatcccagcactgacctcatgaagacagagagtagattggtggttaccagaggttgagaaggggagaggagaggagggatgaagagaggttgattgatggatagaaatatacagtttgataatgataaatcagtagggtgactatagtttataataacctattgtatggttcaaaatagctaaaagagaataattgaaataacgtaagacaaaaatttaagatgatagatatcccaattacactgatttgatctttacaaattatatgaatgtattaaattattacatgtatccccaaaatatgtacaagtattttgtatcaataaaaaataaaatttaagataaagtaaatgtaatgattagcttatatttcctagatcggaaataaatatttacttaagtatgt

SEQ ID NO: 729736 - DNA, 635 bp, Homo sapiens
  misc_feature (93)..(93): n is a, c, g, or t
aacgggaccctgtggattagacatataccaagctcccacatggtcgactatcagccctacaggaagcacaaatactccagagtcacgccgcangagcaggcaaagctcgatgctcaactccgggacaaagagttttacaggcccatccctaaccccaaccccaagctaacagatgggtaccctgctttcaaaagaccccacatgactgccaaagacctgggactccccggcttcttcccatcacaggaacatgaggccacgagggaggacgagcgcaagttcaccagcacctgccatttcacatatccagcttcccacgatctgcacctggcccagggtgaccccaaccaggtcctccagagtgctgactttccgtgcctcgtggatcccaaacaccagcctgctgcagagatggccaaaggctacctgctactgccagggtgtccctgtcttcattgccatatagtcaaggtccccatcttgaaccggtggggacccttgatgccattttaccagtaggaaggatgaaaataccttccaaaggctcttccaagggcatgtggaaatcctatgaccttggagtgcagagaggagaactgaaaataaaactggaaagatgttccaactgcaaaaaa

SEQ ID NO: 729737 - DNA, 1080 bp, Homo sapiens
tcagttgctccacagctttgccactgtccctcagaccccacacatgccgcacttcctttcgttcctagccgaagaagcccccttgtcatttgctttatgtagtggatcccattgttttaatttggaattccccagtggtatatgtgctgagcatgttttcataggttttgttgccattggcatcatactttcttttggaaagatgccatattttctttggatgctctggtattcagttggtgacactggattctctccatcatggagggggtgggcctttgcttgggaaaacacaggctttctgcatgtgggttttcctctctatgatcgtgcttttgccggcactattatcccaacattgcctctgattaatgtgcttattgcacagaggacatgcgttgaaggactcaggcccagaggactcaccatactacacctagcttccctctcacccagaagcagctaacctgatgaaacaaatgccctggccttgggaagacttagctatatcctaattggagccaacacccagaaaaaaagaagcactgtcctaaagatagtagatgatttgaatcagcgtgtgatatggggtgctgatttttccaaagcttgaatatatgggtccaggaatcaaggaccaagtgggagtgttttctccactattacacaagatttctcacttacagaatttttatattcttcctctatcaagctctactacctttggttccaacggaaacatgcctgtaccagggccagcaccctcgaacagtgactgacaggagctggtatttatatattccagattcttctttggctggagacaaccctgaggtgtgtgtttcatgctatctgaaacccccgtgggattaaactcctgttgcatgtagtggtaacgagtttgataacacattctgcctacatttttttaatcttatttcctcctcctctactggtggttcctgaaactcttaaataaattgattagactcaaattcttgtcttgtgtctgcttctgggggaaatccagtctaagactgttgagcattttattgtgggtttttccaactttgcattccc

SEQ ID NO: 729738 - DNA, 2017 bp, Homo sapiens
ccccttatttttgggaattggccggatacaatttccaccggaaccgtttgaccggttccgattttacccgacccctatagaaatttgcccctgggccaaaaatttcgcacgaggggtttaaagggattttgggagaaccctgtcccatgataaggggaagttgaagtgtcctttggagtttcatgtgtgggccctttgggcatgtttaattgtctgaactcttcccgtgaattgccttcaaatttggtgtttatgcaaaaataatttagaagaccataaaaatccctgaagaaagtctgagaaagaggtgcaaggagagagggagaatttccagcttcatcaaaactgtgtgcagatggagcctctgcaggccacagctctttcctcagcagacatcatcctgcctgttacagaggaagtgggcactgccgggcagagccccagctcttctgcaccacgttcaagaaggcaggcaccacacaggcaacctcacgcctccttcggaagcagatggaggttttttttttttttttgcacaaggttactctaacctgtttgtcttcttggggtaacttgttcattcatatatgaattgtcacccattctatcaaacaaataaaatcaccatgacaattgctatttttaggcacattttaaagctataaatgagatcatgttagttaataaaaattatctcctcagttaaatgggtattaattacaatttccaaaattacagcaaactctgaaccctccttttagactggctggtaccatctgttctagctaggtattatactttacttagccattcccctgctgttggacatttaggacgtttctaatttgaaatttaacattgggtggttttccaagtatttatgtatatatgtattggtgctgattatgacgacgtcaaatttctctccgtctctgcctgccggcttcagctgcggcccctcctctcggaaggttcctcaggggttctcctgtccagttagaggttttggggtttcctccttacgctggtctcagcgacttcctgcggctcagaagcagcacaggctggacccaacccctgcctcggaaaaccactgtgctgatgcgccagcagagggccgagaggacagccgcgtcggaacccaggggcgacagttccctggggccaaggggagccatgtggagcccggcccaggcttggcgcccaggctcggccgggctgctgtgcgcgcggggagtccgggtgtccactggcccgagccagggtcccgctggcgggaggacgccccgcgagtggggtgggccgcgagcgggaggaacacgcacgtcccggggcggccggaggggccccgcttgcgcagggggttgtcagaagactcgcacgcggcaggaggcctggccgtgggtgcagagttcccaccttgcagcttcaggactgctgatcctgattatgctgtgcaaagggtgttcgttccacggtcacactgtctctatgaggcagcaacgtctaggagtgttatccccattgagggggcagataaaccaaggaaggaggagggcaggtgctggcccaagtcacacacagatgaaggcacacatggttctatcagtgcaaagagggcccactaagacccactctgcagggctgttgaggaaagccccatctgacaggcacccgacaaagctcctcacactccgtaaatgccacccatcatgaatgtggctatgattaaattgtgatgaggactgtgacccacaagactggaaaaccagtttggcaccttgatgcagatgttttcaaggactgggttagagaatacataccatcattctacttttagctgttttgtttcattaaaacctttttggttttaatgaaacaaaccataacatgtatgacaaccataacatgtatgacaacatagcatgacaaccataacaagtacaatattttggccaatttcatttaatttggcacatagaatggaagaaatattaagatattattttctacatga

SEQ ID NO: 729739 - DNA, 544 bp, Homo sapiens
cgcacagcccagacaaaaacaggacacagcagtgtgtgaatgagccgggctttctccttccctccacgtaatagaaggtgcctgaggttgttgaaacacagtccatttctcctgggaatgacaagaatttgagggatgctgactttcaaggaatactgcatgacaggcatcaagataaacctgatgaagaaaacataggccagaatctgggaatcgggagcaaagtaatacagcttcggggacaggcacgtaatgaggtcatgatgtaggagactccctgcaggactggcggcccctgttccctgggttgttctggctctttcagaacctgaccctggaacaggactgagcaggtgcctgtgtgcacagaagaccttgtgtgagtcctttggtaccacgtttgctgcacgaatgtctgagacacctcacagtcgcttggttcagcctctccctcctctctccgctggggaacatcatccctcatcactggaagaaattacaaggattgtgtaaacaattacaagtattctacaaacagtgagca

SEQ ID NO: 729740 - DNA, 1301 bp, Homo sapiens
agcggagaggcgcagagagagctgggagctaaggggtggcggcgaccggaagcgcagtgcacacccccatggcccgggctttggtccagctctgggccatatgcatgctgcgagtggcgctggctaccgtctatttccaagaggaatttctagacggagagcattggagaaaccgatggttgcagtccaccaatgactcccgatttgggcattttagactttcgtcgggcaagttttatggtcataaagagaaagataaaggtctgcaaaccactcagaatggccgattctatgccatctctgcacgcttcaaaccgttcagcaataaagggaaaactctggttattcagtacacagtaaaacatgagcagaagatggactgtggagggggctacattaaggtctttcctgcagacattgaccagaagaacctgaatggaaaatcgcaatactatattatgtttggacccgatatttgtggatttgatatcaagaaagttcatgttattttacatttcaagaataagtatcacgaaaacaagaaactgatcaggtgtaaggttgatggcttcacacacctgtacactctaattttaagaccagatctttcttatgatgtgaaaattgatggtcagtcaattgaatccggcagcatagagtacgactggaacttaacatcactcaagaaggaaacgtccccggcagaatcgaaggattgggaacagactaaagacaacaaagcccaggactgggagaagcattttctggacgccagcaccagcaagcagagcgactggaacggtgacctggatggggactggccagcgccgatgctccagaagcccccgtaccaggatggcctgaaaccagaaggtattcataaagacgtctggctccaccgtaagatgaagaataccgactatttgacgcagtatgacctctcagaatttgagaacattggtgccattggcctggagctttggcaggtgagatctggaaccatttttgataactttctgatcacagatgatgaagagtacgcagataattttggcaaggccacctggggcgaaaccaagggtccagaaagggagatggatgccatacaggccaaggaggaaatgaagaaggcccgcgaggaagaggaggaagagctgctgtcgggaaaaattaacaggcacgaacattacttcaatcaatttcacagaaggaatgaactttagtgatccccattggatataaggatgactggtaaaatctcattgctactttaatctatgtttcaaactcaaatgtctaca

SEQ ID NO: 729741 - DNA, 542 bp, Homo sapiens
agcggagaggcgcagagagagctgggagctaaggggtggcggcgaccggaagcgcagtgcacacccccatggcccgggctttggtccagctctgggccatatgcatgctgcgagtggcgctggctaccgtctatttccaagaggaatttctagacggagagcattggagaaaccgatggttgcagtccaccaatgactcccgatttgggcattttagactttcgtcgggcaagttttatggtcataaagagaaagataaaggacccgatatttgtggatttgatatcaagaaagttcatgttattttacatttcaagaataagtatcacgaaaacaagaaactgatcaggtgtaaggttgatggcttcacacacctgtacactctaattttaagaccagatctttcttatgatgtgaaaattgatggtcagtcaattgaatccggcagcatagagtacgactggaacttaacatcactcaagaaggaaacgtccccggcagaatcgaaggattgggaacagactaaagacaacaaagcccag

SEQ ID NO: 729742 - DNA, 490 bp, Homo sapiens; identical to SEQ ID NO: 728397

SEQ ID NO: 729743 - DNA, 438 bp, Homo sapiens
gctagcacactcctccccttcaccatgcgatgcccttcactaccttgcgactctacagcgagtcaccaccagcaatgagacgctcatcagatatggatcctcaaccttgaaatgctcatctccatactgctttgaaataatcattaaaactatacatttaacaagatcggagtcatatggtgcgcatctgccagcacagattgccacctttggacagatgaaaatactgaggcagagaaaagttaagtaagttccccaaagagaaatacacagctaagaagtgttagtttaacctgaccatgtggcagaaagccagatatgcaaagaaaaacatgggggaatggatcaagaatggtaaattgacatattattataaaagaatttaaatgaaaatttaagatgttttgtgtcaaataaatgaatgagagtcatcgtagg

SEQ ID NO: 729744 - DNA, 325 bp, Homo sapiens
attgccacctttggacagatgaaaatactgaggcagagaaaagttaagtaagttccccaaagagaaatacacagctaagaagtgttagtttaacctgaccatgtggcagaaagccagatatgcaaagaaaaacatgggggaatggatcaagaatgcaataatacaagaggacatcaccaagggaatgagcctagaccaagaaaggtactacaaactgggtctgaagcactgtgaacagggtggaagaagagcaaaacataaaacctgtttcagagaatgagtgacaagttttgttgggtcaaatacagcgactgctcatgtataa

SEQ ID NO: 729745 - DNA, 605 bp, Homo sapiens
aggtgtgctagggaataaatgaaatgcctgggacatcatcgttaagtggcatctgatgcataagcagtgccctaggaatggggttgcctgccttggtctctaaaggatgggttcaaaaggcaagagcagcacacaagaagatagcttcaagcaggagaaaaagcttggcccagggcccaaaggggatacgacccttcagcaaactgacatgctgaaagctgccctatggagaggctcatgtggcaaggaacagagggtggcttctggccaacacccagtgaggaactcaggccctcagtcaaacagcctgcaaggaactgaaccctgccaataaccctgggttgaaagcttccctttggagaagaactgagggctgtctctggtcaatagcactgaggaactgaatccagcaaacaattatgtgaagaaacttggaagcttgtcctcccctctagttgagctttgagatgactgccgccctagtggacaccttgattgaagccttatgagaaaccctaagccagagaacccaattaagctacgcttacattcctaacacagagaaaatatgagctaataaatgttgtttcaaaccactaaaaatt

SEQ ID NO: 729746 - DNA, 551 bp, Homo sapiens
aggtgtgctagggaataaatgaaatgcctgggacatcatcgttaagtggcatctgatgcataagcagtgccctaggaatggggttgcctgccttggtctctaaaggatgggttcaaaaggcaagagcagcacacaagaagatagcttcaagcaggagaaaaagcttggcccagggcccaaaggggatacgacccttcagcaaactgacatgctgaaagctgccctatggagaggctcatgtggcaaggaacagagggtggcttctggccaacacccagtgaggaactcaggccctcagtcaaacagcctgcaaggaactgaaccctgccaataacccactgaggaactgaatccagcaaacaattatgtgaagaaacttggaagcttgtcctcccctctagttgagctttgagatgactgccgccctagtggacaccttgattgaagccttatgagaaaccctaagccagagaacccaattaagctacgcttacattcctaacacagagaaaatatgagctaataaatgttgtttcaaaccactaaaaatt

SEQ ID NO: 729747 - DNA, 581 bp, Homo sapiens
aggtgtgctagggaataaatgaaatgcctgggacatcatcgttaagtggcatctgatgcataagcagtgccctaggaatggggttgcctgccttggtctctaaaggatgggttcaaaaggcaagagcagcacacaagaagatagcttcaagcaggagaaaaagcttggcccagggcccaaaggggatacgacccttcagcaaactgacatgctgaaagctgccctatggagaggctcatgtggcaaggaacagagggtggcttctggccaacacccagtgaggaactcaggccctcagtcaaacagcctgcaaggaactgaaccctgccaataaccgctgagctctgaaacttctcctggcagttcaagagagcgatggagggaatgctggggcacatctaaataaagcctccaagtgggagttcctgctcagctatgcatgagctctttgtgacttcatctcccagcctacaacttgtgaaataagcacgacttcactcagagcacagccagaaacatacaaactttccaaaaatatttgaatgttgacagcaaaatgtcttgcattccagtgaataatt

SEQ ID NO: 729748 - DNA, 472 bp, Homo sapiens; identical to SEQ ID NO: 348797

SEQ ID NO: 729749 - DNA, 569 bp, Homo sapiens; identical to SEQ ID NO: 348798

SEQ ID NO: 729750 - DNA, 728 bp, Homo sapiens; identical to SEQ ID NO: 348794

SEQ ID NO: 729751 - DNA, 650 bp, Homo sapiens
gcagtgtcagcccccggccaatgaccaccatggacctccctgtagttgaacaaagttgggtttgctgactggtggcagtgagggagaatgcacaccacagggagctgtgcagtgtctcagtaagaagccaggagccatcccgtgaggccgttactgcaaacaagctgaaaatcctgctttgtttcttttggacacaacatgctttccttcagcttcagtagacgatgaggccagcaccacatgggctagatgtacatgagatgtgagcaaccacacttcccctctgacggggacagacagcatcacagtatcctgttgggacagacagatgaagaaccagagaccagagagtttaagtagcttgccaaaggtcacacagcagtgtaagcagtacgggtgattcttaagcccacattgtttgacttccgagacatatcagaaaactacgtcaaagaacacgcacaactcagacctatttccagtggcctatgcagaagagctaccctgcttgaatggaaaccccttaagatacactattctcaaaaacctaagtgcttagcctggcttatggaggaggcaatgcaatctaccacaagatgattaagacaacaatgaacttaagtcccagccactgctggagaatatcaaaa

SEQ ID NO: 729752 - DNA, 426 bp, Homo sapiens
ccaggagccatcccgtgaggccgttactgcaaacaagctgaaaatcctgctttgtttcttttggacacaacatgctttccttcagcttcagtagacgatgaggccagcaccacatgggctagatgtacatgagatgtgagcaaccacacttcccctctgacggggacagacagcatcacaggctgagctctgaaacttctcctggcagttcaagagagcgatggagggaatgctggggcacatctaaataaagcctccaagtgggagttcctgctcagctatgcatgagctctttgtgacttcatctcccagcctacaacttgtgaaataagcacgacttcactcagagcacagccagaaacatacaaactttccaaaaatatttgaatgttgacagcaaaatgtcttgcattccagtgaataatt

SEQ ID NO: 729753 - DNA, 998 bp, Homo sapiens; identical to SEQ ID NO: 348802

SEQ ID NO: 729754 - DNA, 469 bp, Homo sapiens; identical to SEQ ID NO: 348801

SEQ ID NO: 729755 - DNA, 1455 bp, Homo sapiens
tggtgactcctggtctccatgtcatctgccagaaaggccacctgcgccagcacctcctgagaccggccttcaaagacacgacgcatgccgctctgccgtccggagcacttaatgcctagagccagcagggtcccagtggccgcgtcactgcctctgagccacgcggtcattccaactcaactgccctcgcgttctggccacaggccccctgggagaccccggagatgcccaaaggcctcatgcctgccgcctccagtgggacctagcagcacacagacagcgaagcgggtgaccatggggtggccacggccgggccaagccctcgtggcagtcaaagccttgctggtcttgtcgctgctccaggtgcccgcgcaggcggtggtacgggccgtgctggaagacaactcgagctcggtggactttgcggatctgccggcgctgttcggcgtccccctggcccccgagggcatacggggctacctgatggaggtcaagccagccaacgcgtgccatcccatcgaggccccgcgactgggcaaccgctctctgggctccatcgcgctgatccgccactacgactgcaccttcgacctcaaggtgctgaacgcccagcgcgccggcttcgaggcggccatcgtgcacaacgtccactccgacgacctcgtgagcatgacccacgtctacgaggacttgagggggccagatcgccatcccctcagtgttcgtgagcgaggccgctcgcaggacctgcgggtcatcctgggctgcaacaagtcggcccacgcgctgctcctgcccgacgacccaccgtgccacgacctgggctgtcaccccgtgctgaccgtgtcctgggtgctgggctgtaccctggccctggtcgtatcagccttctttgtcctgaaccacctgtggctctgggcccaggcctgctgcagccacagacggccggtgaagacgtctacctgccagaaggcccaggtccgcaccttcacgtggcacaacgacctgtgtgccatctgcctggatgagtatgaggagggcgaccaactcaagatcctgccctgctcccacacctaccactgcaaatgcattgacccctggttctcccaagccccccggcgctcctgccccgtgtgcaaacagtcggtggccgccacagaagacagctttgactccaccacctacagcttcagggacgaggacccctccctaccgggccaccggccccccatttgggccattcaagtccagctacgctcccggaggctggagctgctgggccgcgccagtccccactgccactgcagcaccacgtccctggaggcagagtataccactgtctcctcagcccctcctgaggcccctggtcagtaaagatctagggcagggaggggggtgcaatgaggaatgtttctggtctgaaaagaataaagtgggtttgaaagcggaaactca

SEQ ID NO: 729756 - DNA, 353 bp, Homo sapiens
cctctcagcattctccttgggaggtcacaggcgccggtctcatcaggtgagaaggacaaaagcagccctggccgccgtcagctgagagctggcccgtgctactcagccagggcgttgaacacgccaggggatgccacaatcagatgcgcgtgctcagtgacccaaggagctgaggccaaagggagatcttccgcagtcaaagctgagtgcatatcagaacactgcacacagcacagaaatgaccagctttccccctcccagctaacagggcttgtctgctccaaatttagccctgctccactcttgctacctactagataaaaattattaaaatatccaactattaaactacc

SEQ ID NO: 729757 - DNA, 512 bp, Homo sapiens
tccaggaagagcgaccaggccttgagaggacatggccttaggaccagatccagggaagacacagtcactaacccctggctcatctggcaggtgtgggaagcagccaggcccgtggcttcaccagctccccccgatctctgccttcagctgtcctgcagcctgggtcaggcacctaggcagctttatggcaggcggagatgcaccacccacatcctctttccaggcagggcttgctgccctggctgtagcgagtgcggcagcaggtggcctccagctatcagcaacttcagagagctgccttgcctgaggtcccgtcccttctggggaagctcccatctgccagggggctacaaaagcacagtggacaccatgatgggcaattctggctgatgggagcaccacctggtggctgaggcattcttgggccacatagcagttgactgccctctccaccatcttttcacaagtgttaatcccaataaacacccatcctcttccatcccaaaaagtct

SEQ ID NO: 729758 - DNA, 598 bp, Homo sapiens
tactgatattgcagaaagaagatagttatacaagggtggcactgaacacacaagaaacaaatgattcacggtagcattagaggcaccagcaaaggacacacttttagagaaaggaatctgctcccctgtggctctccaaatcacactccttaggcaccacatctacagggaagacccaggtagagactgtgaggatctcaatggcctggtgggccacaagatcacttctgcttccggctggaatgctccttctccacagagtccggaaactgacatatgcagccacccacccagaaggacatgtccaagaaggaatggaaagaaaaatgatggcccagatgttctgtagcttgcagtgactgccaattcaccacagaccccagtacctgggagggcaaggcagcatcaggctcttgcttcctggtttcaggcagccagggccctgatggtgggtggcaactctgacagaatgcagactggccaggggagaaacctttagaagggcactggctgacgggacttgggggttgaacacacagcgctgatttatcacttccttactcataaaaatgtgattcgaactgctaaaaaaaatgaa

SEQ ID NO: 729759 - DNA, 1757 bp, Homo sapiens
gttgcgacggacgggtaggggaggcgaccccggcgttctgctccgcactgtggaggaggtggggaggtgttgggccagggctgaggtaggagggagtctgtccctcgacgcctcctgcgacgccagcccctgagcgatgatgcgaacgtgcgtcctactctccgcggtgctctggtgcctcacaggagacaaaatatatgtagagttacatcaaaatagtccagtccttatctgtatggattttaagctttctaaaaaagaaatagtggaccccacctacttatggattgggcctaatgaaaagacgttaacaggaaataatagaataaatataactgaaactggacagctgatggtgaaagattttttggagcctttgtctggactttacacatgtactctttcttataagactgttaaagcagaaactcaagaagaaaaaacagtcaaaaagagatatgactttatggtctttgcctatcgggaacctgattattcatatcagatggctgtacgttttaccacaaggtcttgtatagggagatacaatgatgtattctttagagtgctgaagaaaatcttggatagtctaatttctgatttgtcatgccatgtcatagagccatcatataaatgccattctgttgaaattccagaacatggcctcatacatgagctatttatagcatttcaagttaatccttttgcgccggggtggaaaggtgcttgcaatggatctgttgactgtgaagataccactaatcataatatcctccaggtgagaatttcatgccaagcatatattttctaccataactttaataaaactctaccagcaatgcattttgtggaccacagtttgcaagtagtacgtctggatagctgtcgaccaggctttggaaaaaatgaacgtctacacagtaattgcgctagctgttgtgtggtttgtagtcctgcgacttttagtcctgatgttaatgtaacttgtcagacctgcgtttccgtccttacctatggagctaaatcttgcccacaaacttcaaacaaaaatcagcaatatgaagattagaggtgaaagcattgttacttacttgtggaagtcggggacataagatgattttcacatcccagagcatcatagatagttccattaagtaaaatcagtaagaccaaaccactggaaaacatgcattttggaaactttaaaataaatggttaacatggcatttctaagaaggcatttaatccagtatctctagtgtacaaaggaaacttgaagttttaatggattatttttaatgaaatgttttattgtttacaaacggtatgttgctgtgtacctaagagtatagtaaggtcaagaagagtatcaaagtataataaaataaaaattgtatactctccatatatttatttgtttggaatcactctttgtgtgatataaaggcgtgtatattatctttgtattagaaccaaaaaagttatttattttggtccctatgattttattttttaagataaattaatatactgtattttttaaagtataggtttaggtttacagaataatagagcagataatatatagagttccatacacccactgcaccccataccctcattcctccttacacaatttctcctattattaagatggtgcattagtgtggcacatttgttacaaatgatgaaccaatattaatttattattaattatagcccatagttcacattaagattcattgtgttgtaaggtt

SEQ ID NO: 729760 - DNA, 615 bp, Homo sapiens
ccaagcatatattttctaccataactttaataaaactctaccagcaatgcattttgtggaccacagtttgcaagtagtacgtctggatagctgtcgaccaggctttggaaaaaatgaacgtctacacagtaattgcgctagctgttgtgtggtttgtagtcctgcgacttttagtcctgatgttaatgtaacttgtcagacctgcgtttccgtccttacctatggagctaaatcttgcccacaaacttcaaacaaaaatcagcaatatgaagattagaggtgaaagcattgttacttacttgtggaagtcggggacataagatgattttcacatcccagagcatcatagatagttccattaagtaaaatcagtaagaccaaaccactggaaaacatgcattttggaaactttaaaataaatggttaacatggcatttctaagaaggcatttaatccagtatctctagtgtacaaaggaaacttgaagttttaatggattatttttaatgaaatgttttattgtttacaaacggtatgttgctgtgtacctaagagtatagtaaggtcaagaagagtatcaaagtataataaaataaaaattgtatactctccata

SEQ ID NO: 729761 - DNA, 3263 bp, Homo sapiens
ctggttctgagattctgtgcaagcctcatggaaatgaagctgccaggccaggaagggtttgaagcctccagtgctcctagaaatattccttcaggggagctggacagcaaccctgaccctggcaccggccccagccctgatggcccctcagacacagagagcaaggaactgggagtacccaaagaccctctgctcttcattcagctgaatgagctgctgggctggccccaggcgctggagtggagagagacaggcagctcctctgcatctctgctcctggacatgggagaaatgccctcaataacactgtctacccaccttcatcacaggtgggtactgtttgaggagaagttggaggtggctgcaggccggtggagtgccccccacgtgcccaccctggcactgcccagcctccagaagctccgcagcctgctggccgagggccttgtactgctggactgcccagctcagagcctcctggagctcgtggagcaggtgaccagggtggagtcgctgagcccagagctgagagggcagttgcaggccttgctgctgcagagaccccagcattacaaccagaccacaggcaccaggccctgctggggctctactcatccaagaaaggcttctgacaatgaggaagcccccctgagggaacagtgtcagaaccccctgagacagaagctacctccaggagctgaggcagggactgtgctggcaggggagctgggcttcctggcacagccactgggagcctttgttcgactgcggaaccctgtggtactggggtcccttactgaggtgtccctcccaagcaggtttttctgccttctcctgggcccctgtatgctgggaaagggctaccatgagatgggacgggcagcagctgtcctcctcagtgacccgcaattccagtggtcagttcgtcgggccagcaaccttcatgaccttctggcagccctggatgcattcctagaggaggtgacagtgcttcccccaggtcggtgggacccaacagcccggattcccccgcccaaatgtctgccatctcagcacaaaaggcttccctcgcaacagcgggagatcagaggtcccgccgtcccgcgcctgacctcggctgaggacaggcaccgccatgggccacacgcacacagcccggagttgcagcggaccggcaggctgtttgggggccttatccaggacgtgcgcaggaaggtcccgtggtaccccagcgatttcttggacgccctgcatctccagtgcttctcggccgtactctacatttacctggccactgtcactaatgccatcacttttgggggtctgctgggagatgccactgatggtgcccagggagtgctggaaagtttcctgggcacagcagtggctggagctgccttctgcctgatggcaggccagcccctcaccattctgagcagcacggggccagtgctggtctttgagcgcctgctcttctctttcagcagagattacagcctggactacctgcccttccgcctatgggtgggcatctgggtggctaccttttgcctggtgctggtggccacagaggccagtgtgctggtgcgctacttcacccgcttcactgaggaaggtttctgtgccctcatcagcctcatcttcatctacgatgctgtgggcaaaatgctgaacttgacccatacctatcctatccagaagcctgggtcctctgcctacgggtgcctctgccaatacccaggcccaggaggaaatgagtctcaatggataaggacaaggccaaaagacagagacgacattgtaagcatggacttaggcctgatcaatgcatccttgctgccgccacctgagtgcacccggcagggaggccaccctcgtggccctggctgtcatacagtcccagacattgccttcttctcccttctcctcttccttacttctttcttctttgctatggccctcaagtgtgtaaagaccagccgcttcttcccctctgtggtgcgcaaagggctcagcgacttctcctcagtcctggccatcctgctcggctgtggccttgatgctttcctgggcctagccacaccaaagctcatggtacccagagagttcaagcccacactccctgggcgtggctggctggtgtcaccttttggagccaacccctggtggtggagtgtggcagctgccctgcctgccctgctgctgtctatcctcatcttcatggaccaacagatcacagcagtcatcctcaaccgcatggaatacagactgcagaagggagctggcttccacctggacctcttctgtgtggctgtgctgatgctactcacatcagcgcttggactgccttggtatgtctcagccactgtcatctccctggctcacatggacagtcttcggagagagagcagagcctgtgcccccggggagcgccccaacttcctgggtatcagggaacagaggctgacaggcctggtggtgttcatccttacaggagcctccatcttcctggcacctgtgctcaagttcattccaatgcctgtgctctatggcatcttcctgtatatgggggtggcagcgctcagcagcattcagttcactaatagggtgaagctgttgttgatgccagcaaaacaccagccagacctgctactcttgcggcatgtgcctctgaccagggtccacctcttcacagccatccagcttgcctgtctggggctgctttggataatcaagtctacccctgcagccatcatcttccccctcatgttgctgggccttgtgggggtccgaaaggccctggagagggtcttctcaccacaggaactcctctggctggatgagctgatgccagaggaggagagaagcatccctgagaaggggctggagccagaacactcattcagtggaagtgacagtgaagattcagagctgatgtatcagccaaaggctccagaaatcaacatttctgtgaattagctggagtaggagtctgggagtggagaccccaggaaacagcatgagttcacaggtgcttactcaggaagtcaggacatttttggcctttggcttaacttccagatgctcagtcggcttggggaaggactgaagggcagctgccaagacctcagttacctcctgacctgagggtggagagtggcaggaagcaagcatgtttgctgtgcacttaggaaaggctggtgagccagagggactgatcaggccccattcactctctactcattaaaaggtcctgagccacg

SEQ ID NO: 729762 - DNA, 3101 bp, Homo sapiens
ctggttctgagattctgtgcaagcctcatggaaatgaagctgccaggccaggaagggtttgaagcctccagtgctcctagaaatattccttcaggggagctggacagcaaccctgaccctggcaccggccccagccctgatggcccctcagacacagagagcaaggaactgggagtacccaaagaccctctgctcttcattcagctgaatgagctgctgggctggccccaggcgctggagtggagagagacaggcaggtgggtactgtttgaggagaagttggaggtggctgcaggccggtggagtgccccccacgtgcccaccctggcactgcccagcctccagaagctccgcagcctgctggccgagggccttgtactgctggactgcccagctcagagcctcctggagctcgtggagcaggtgaccagggtggagtcgctgagcccagagctgagagggcagttgcaggccttgctgctgcagagaccccagcattacaaccagaccacaggcaccaggccctgctggggctctactcatccaagaaaggcttctgacaatgaggaagcccccctgagggaacagtgtcagaaccccctgagacagaagctacctccaggagctgaggcagggactgtgctggcaggggagctgggcttcctggcacagccactgggagcctttgttcgactgcggaaccctgtggtactggggtcccttactgaggtgtccctcccaagcaggtttttctgccttctcctgggcccctgtatgctgggaaagggctaccatgagatgggacgggcagcagctgtcctcctcagtgacccgcaattccagtggtcagttcgtcgggccagcaaccttcatgaccttctggcagccctggatgcattcctagaggaggtgacagtgcttcccccaggtcggtgggacccaacagcccggattcccccgcccaaatgtctgccatctcagcacaaaaggcttccctcgcaacagcgggagatcagaggtcccgccgtcccgcgcctgacctcggctgaggacaggcaccgccatgggccacacgcacacagcccggagttgcagcggaccggcaggaaggtcccgtggtaccccagcgatttcttggacgccctgcatctccagtgcttctcggccgtactctacatttacctggccactgtcactaatgccatcacttttgggggtctgctgggagatgccactgatggtgcccagggagtgctggaaagtttcctgggcacagcagtggctggagctgccttctgcctgatggcaggccagcccctcaccattctgagcagcacggggccagtgctggtctttgagcgcctgctcttctctttcagcagagattacagcctggactacctgcccttccgcctatgggtgggcatctgggtggctaccttttgcctggtgctggtggccacagaggccagtgtgctggtgcgctacttcacccgcttcactgaggaaggtttctgtgccctcatcagcctcatcttcatctacgatgctgtgggcaaaatgctgaacttgacccatacctatcctatccagaagcctgggtcctctgcctacgggtgcctctgccaatacccaggcccaggaggaaatgagtctcaatggataaggacaaggccaaaagacagagacgacattgtaagcatggacttaggcctgatcaatgcatccttgctgccgccacctgagtgcacccggcagggaggccaccctcgtggccctggctgtcatacagtcccagacattgccttcttctcccttctcctcttccttacttctttcttctttgctatggccctcaagtgtgtaaagaccagccgcttcttcccctctgtggtgcgcaaagggctcagcgacttctcctcagtcctggccatcctgctcggctgtggccttgatgctttcctgggcctagccacaccaaagctcatggtacccagagagttcaagcccacactccctgggcgtggctggctggtgtcaccttttggagccaacccctggtggtggagtgtggcagctgccctgcctgccctgctgctgtctatcctcatcttcatggaccaacagatcacagcagtcatcctcaaccgcatggaatacagactgcagaagggagctggcttccacctggacctcttctgtgtggctgtgctgatgctactcacatcagcgcttggactgccttggtatgtctcagccactgtcatctccctggctcacatggacagtcttcggagagagagcagagcctgtgcccccggggagcgccccaacttcctgggtatcagggaacagaggctgacaggcctggtggtgttcatccttacaggagcctccatcttcctggcacctgtgctcaagttcattccaatgcctgtgctctatggcatcttcctgtatatgggggtggcagcgctcagcagcattcagttcactaatagggtgaagctgttgttgatgccagcaaaacaccagccagacctgctactcttgcggcatgtgcctctgaccagggtccacctcttcacagccatccagcttgcctgtctggggctgctttggataatcaagtctacccctgcagccatcatcttccccctcatgttgctgggccttgtgggggtccgaaaggccctggagagggtcttctcaccacaggaactcctctggctggatgagctgatgccagaggaggagagaagcatccctgagaaggggctggagccagaacactcattcagtggaagtgacagtgaagattcagagctgatgtatcagccaaaggctccagaaatcaacatttctgtgaattagctggagtaggagtctgggagtggagaccccaggaaacagcatgagatgctcagtcggcttggggaaggactgaagggcagctgccaagacctcagttacctcctgacctgagggtggagagtggcaggaagcaagcatgtttgctgtgcacttaggaaaggctggtgagccagagggactgatcaggccccattcactctctactcattaaaaggtcctgagccacg

SEQ ID NO: 729763 - DNA, 880 bp, Homo sapiens
ttcattccaatgcctgtgctctatggcatcttcctgtatatgggggtggcagcgctcagcagcattcagttcactaatagggtgaagctgttgttgatgccagcaaaacaccagccagacctgctactcttgcggcatgtgcctctgaccagggtccacctcttcacagccatccagcttgcctgtctggggctgctttggataatcaagtctacccctgcagccatcatcttccccctcatgttgctgggccttgtgggggtccgaaaggccctggagagggtcttctcaccacaggaactcctctggctggatgagctgatgccagaggaggagagaagcatccctgagaaggggctggagccagaacactcattcagtggaagtgacagtgaagattcagagctgatgtatcagccaaaggctccagaaatcaacatttctgtgaattagctggagtaggagtctgggagtggagaccccaggaaacagcatgagttcacaggtgcttactcaggaagtcaggacatttttggcctttggcttaacttccagatgctcagtcggcttggggaaggactgaagggcagctgccaagacctcagttacctcctgacctgagggtggagagtggcaggaagcaagcatgtttgctgtgcacttaggaaaggctggtgagccagagggactgatcaggccccattcactctctactcattaaaaggtcctgagccacgaagcgcttcccattttgaactttctgtcctcacagattctgtttgacagaatctaagggccatcagggaactcttttcatcttgcaaagagaaaaagccagtctttccagaataaatattcatctgtttgaaataaattttta

SEQ ID NO: 729764 - DNA, 896 bp, Homo sapiens
ggaacagaggctgacaggcctggtggtgttcatccttacaggagcctccatcttcctggcacctgtgctcaagttcattccaatgcctgtgctctatggcatcttcctgtatatgggggtggcagcgctcagcagcattcagttcactaatagggtgaagctgttgttgatgccagcaaaacaccagccagacctgctactcttgcggcatgtgcctctgaccagggtccacctcttcacagccatccagcttgcctgtctggggctgctttggataatcaagtctacccctgcagccatcatcttccccctcatgttgctgggccttgtgggggtccgaaaggccctggagagggtcttctcaccacaggaactcctctggctggatgagctgatgccagaggaggagagaagcatccctgagaaggggctggagccagaacactcattcagtggaagtgacagtgaagattcagagctgatgtatcagccaaaggctccagaaatcaacatttctgtgaattagctggagtaggagtctgggagtggagaccccaggaaacagcatgagatgctcagtcggcttggggaaggactgaagggcagctgccaagacctcagttacctcctgacctgagggtggagagtggcaggaagcaagcatgtttgctgtgcacttaggaaaggctggtgagccagagggactgatcaggccccattcactctctactcattaaaaggtcctgagccacgaagcgcttcccattttgaactttctgtcctcacagattctgtttgacagaatctaagggccatcagggaactcttttcatcttgcaaagagaaaaagccagtctttccagaataaatattcatctgtttgaaataaattttta

SEQ ID NO: 729765 - DNA, 760 bp, Homo sapiens
ttgctgggccttgtgggggtccgaaaggccctggagagggtcttctcaccacaggaactcctctggctggatgagctgatgccagaggaggagagaagcatccctgagaaggggctggagccagaacactcattcagtggaagtgacagtgaagattcagagctgatgtatcagccaaaggctccagaaatcaacatttctgtgaattagctggagtaggagtctgggagtggagaccccaggaaacagcatgaggccatagaacaccctcatcttcatgcttctccaagctcaagagcctaagagccaggccaggcacggtggctcacgcctgtaatcccagcactttgggaggccgaggcgggtggattacttgagttcacaggtgcttactcaggaagtcaggacatttttggcctttggcttaacttccagatgctcagtcggcttggggaaggactgaagggcagctgccaagacctcagttacctcctgacctgagggtggagagtggcaggaagcaagcatgtttgctgtgcacttaggaaaggctggtgagccagagggactgatcaggccccattcactctctactcattaaaaggtcctgagccacgaagcgcttcccattttgaactttctgtcctcacagattctgtttgacagaatctaagggccatcagggaactcttttcatcttgcaaagagaaaaagccagtctttccagaataaatattcatctgtttgaaataaattttta

SEQ ID NO: 729766 - DNA, 702 bp, Homo sapiens
gacttaggcctgatcaatgcatccttgctgccgccacctgagtgcacccggcagggaggccaccctcgtggccctggctgtcatacagtcccagacattgccttcttctcccttctcctcttccttacttctttcttctttgctatggccctcaagtgtgtaaagaccagccgcttcttcccctctgtggtgcgcaaagggctcagcgacttctcctcagtcctggccatcctgctcggctgtggccttgatgctttcctgggcctagccacaccaaagctcatggtacccagagagttcaagcccacactccctgggcgtggctggctggtgtcaccttttggagccaacccctggtggccacagaggccagtgtgctggtgcgctacttcacccgcttcactgaggaaggtttctgtgccctcagttacctcctgacctgagggtggagagtggcaggaagcaagcatgtttgctgtgcacttaggaaaggctggtgagccagagggactgatcaggccccattcactctctactcattaaaaggtcctgagccacgaagcgcttcccattttgaactttctgtcctcacagattctgtttgacagaatctaagggccatcagggaactcttttcatcttgcaaagagaaaaagccagtctttccagaataaatattcatctgtttgaaataaattttta

SEQ ID NO: 729767 - DNA, 460 bp, Homo sapiens
tcttatcactctttttgctctgttctttgcagtagtatgtcccctgagcacttgctttggcctcaccatgtcttctattagttcttcacaggtgcttactcaggaagtcaggacatttttggcctttggcttaacttccagatgctcagtcggcttggggaaggactgaagggcagctgccaagacctcagttacctcctgacctgagggtggagagtggcaggaagcaagcatgtttgctgtgcacttaggaaaggctggtgagccagagggactgatcaggccccattcactctctactcattaaaaggtcctgagccacgaagcgcttcccattttgaactttctgtcctcacagattctgtttgacagaatctaagggccatcagggaactcttttcatcttgcaaagagaaaaagccagtctttccagaataaatattcatctgtttgaaataaa

SEQ ID NO: 729768 - DNA, 696 bp, Homo sapiens; identical to SEQ ID NO: 233614

SEQ ID NO: 729769 - DNA, 489 bp, Homo sapiens
gagaagcattgttttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcgagacattagccctttagttatgagcctgtgggaacttcaggggttcccagtggggagagcagtggcagtgggaggcatctgggggccaaaggtcagtggcagggggtacttcagtattatacaactgctgtgaccagacttgtatactggccgaatatcagtgctgtttgtaatttttcactttgagaaccaacattaattccatatgaatcaagtgttttgtaactgctattcatttattcagcaaatatttattgatcatctcttctccataagatagtgtgataaacacagtcatgaataaagttattttccacaaaaaa

SEQ ID NO: 729770 - DNA, 736 bp, Homo sapiens
  misc_feature (736)..(736): n is a, c, g, or t
acatcttcatggactacgtggtgctgtccaaccctgtggctggactggtcattggcgtgctggtcacagccctggtgcagagttccagcacgtctcctccatcgtggtcagcatggtggctgctaagctgctgactgtccgggtgtctgtgcccatcatcatgggtgtcaacgtaggcacatccatcaccagcaccctggtctcaatggcgcagtcaggggaccgggatgaatttcagagggctttcagcggctcggcggtgcacgggatcttcaactggctcacagtgctggtcctgctgccactggagagcgccacggccctgctggagaggctaagtgagctagccctgggtgccgccagcctgacacccagggcgcaggcgcccgacatcctcaaggtgctgacgaagccgctcacacacctcatcgtgcagttggactccgacatgatcatgagcagtgccacaggcaacgccactaacagcagtctcattaagcactggtgcggcaccacggggcagccgacccaggagaacagcagctgtggcgccttcggcccgtgcacagagaagaacagcacagccccggcggacaggctgccctgccgccacctgtttgcgggcacggagctcacggacctggccgtgggctgcatcctgctggccggctccctgctggtgctctgcggctgcctggtcctcatagtcaagctgctcaactctggcgcgcggccn

SEQ ID NO: 729771 - DNA, 270 bp, Homo sapiens; identical to SEQ ID NO: 681973
  misc_feature (30)..(30): n is a, c, g, or t
  misc_feature (270)..(270): n is a, c, g, or t

SEQ ID NO: 729772 - DNA, 2862 bp, Homo sapiens
tttttaagtgacattttcaaaagacaagatctaataagccccccaatggtaaccatttcctattcccaggcagctagtgagaaacgcaagctcccagaggtggtggttgtgttacgaaggctgaccctgccaatggccgacaaaatggtgcgcacccccaagtgctcgagatgcaggaaccatggcttcctggtgcccgtcaagggacacgcgggcaaatgccgctggaagcagtgcctctgcgagaagtgctacctgatctccgagcgccagaagatcatggccgcgcagaaggtgctcaagacgcaggccgccgaggaggagcaggaggcggccctgtgtgcgcaggggcccaagcaggcctccggggctgcggccgccgcccccgcccccgtccccgtcccggccgcgagcctccgcccgctgtccccggggactccctccggagacgccgacccgggacccgagggccgcgcggccgcttgcttcttcgagcagcccccgcggggccggaaccccggcccgagagccctccagccggttctgggcggccgcagccacgtggagccgagcgagcgagccgccgtggcgatgcccagccttgcgggacccccttttggggcggaggccgcaggcagtggctaccctggccccctagacctgcgcaggccgatgcggaccgtgcccggcccactgttcaccgactttgtgcgccctctgaacatcaacccggaccgtgcactgggccctgagtaccctggtggctccagcatgcacccctactgcccgttcccgctgggctacctggacgcccctcctggcgtccccctgcagcagggcttccggcatgtgtcccgcagccagtaccaaggcggaggcttggtgtcagaaccaggaggagacttccagccaagctactacctgccgccgccgccgccgccactgccgccccttccaccgcttccaccgcagccccagttcctcccgccaggctacctctctgcgctccacttcctccccccgccaccgccaccaccacctccatcatctttctcactgaccgtcctgtttgatactgacaaggagaacactgatgaccaggatgcagaggtactgtcgggtgagcccagccagccatcgtctcaggagcagtccgactaggccccaggcccgccctcctggccagcagagtggggcactggggggcaacagcaacagttttcttgtcttcattcagtgatatgtagggaggaaggaggttgatagcatagatggcaactgattcccagtttaagataggaggaaggagagcaatttctaagtttcaatcctgcgctgtacagttgaagaagagtgtggaggaagctattaccaggggagggccagggctctgaggagtgggcgctgggagaagctcccatttaggaatgaatttaactgtccttgggttacactaccatttattggaacaagccccagaggcagtatttgatttcctcaggccccactctaggacaggaggcaccatctatttcagccttctgctgcctttgcctggtcctccaggttgctgggggcaccacagacatcaagattccagttcatccaggtggctggagccagcagccaggaccagggtcgttgacagcaggttctgcagcatcctgccttgctgctctgtcccccacatcttcctggccacagccccttgcccctcctctaaggggttttactagcaagcatcctggctgctggggctacttcattccccctccataaagtttcagccattatgggcactggttttaaaaaatttattagtttgactatttgatgtttttatagtgattgccaactttaaaaagtaggctgttcataagcactgatgcagtccctagggaatagaatggtgcttctgatcacctgtgacatgaacagtttcttctgtgaggacagttggctattgaaataaaatgagcaatggaaatccttgtggaaggcttattctccctttgatcctggtggaaggcctgtgagctgatgaatctccagaaattggtcggcatctttcctggagccttggaggcacctgctggggtgaaaagaccaactgggggtcaggggcttgtcccagtgctgccccctggcttactggttttcaggaaggcctgccttcctacctttccccgctgtgtattgttgggctcatcatgtaatttttccaagccttactttgtcctctggtaacattggttcagtggtgctctgaggatgcaggagtgcttgtgtgaaacaccttctttgatggcacctgtgtcattggatgcttgaaggcagtgacctttttgagaccacgtcagaggctagaaatgaccaaggctctttacttcctggtgctccccacattccaggcactgtgctgaatgcttcctacgcattctgtctctgagtcctcagagtgacccctcaggcaggcaccaagtacctcatcttacagatggcaaaactgaggcctacagagattagattttccccctcagttgccctgtccataagtggcaaattcaagttccacctgagtgcagagctaagttcctagctgcactgtgctctcctgcttctctgagagggagtcttggggaagtggtccccccaggacttgctgcccagctggggttcagtgagtgtggaccagtcaaaagcaaagaacaactagcttaggtcctacacgaggaatgaaatcatttctcagaaatttccaaatcctttaatttcattttgaaaatgatgaacaaacaaacatgaagttgagtttttaaaaaaaacatgagtattaatagcatattaaaatttaagccttgt

SEQ ID NO: 729773 - DNA, 475 bp, Homo sapiens
tggtttgactttcatcaaaaattaaacgacagaccataccgacgctttgaaaacgtgactgagctggtgcacaaaacaatggtgcctagaattttgaattgtgcaatgttgtgcatggccgcggatatgtggggccttgtggttccaagagcctgtctcaggtgtaccggccctcatcactgggcttcagaggttcaatctgcaaggaggcatctcctgccaggaaattggaagcaaaggccactcggcccttctgttcctcagtcaagttattgtagacatgacgactggagtaagtgatcacctgtgggatagaccgaggcagagtcaagcagcgtaactctcagcctgcctttcctgatggtgtgaagaagaggaaagggagtactcccagtggcacaaagtagtcaagcctggggctgagagtccaagagacctctgttctaaataaaagttaaaaatacagtaaattgca

SEQ ID NO: 729774 - DNA, 3185 bp, Homo sapiens
  misc_feature (1)..(1): n is a, c, g, or t
  misc_feature (2439)..(2439): n is a, c, g, or t
natttgggaagaaaaagaaaatgttggatcatttacaaatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccctgtcccatctggggcccgagtgccaaccctttatttcatccacaccccaattccggcccacacctatggctcaggccgaggctcaggcccatcttcaatcttctttcccagtcctatctcctgcttttccatccctgattcagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcaggacgaatcaccagggacaagtcaggccaagggcaaacccagtccctggcagtcctccatgtccacaggtgaaagcagcaaggaggcacagaaggtgaagttccagctagagagggacccgtgcccacatctggggcaaattctgggtgagaccccacaaaatctatccagggatatgaaaagcttcccacggaaggttctgggggtgacttctgaggagttggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgcgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgaacccttgaagcctcctccagctggacaggagggcaggtggccatctaagcccctcacgtacagcctcacaggcagcacccagcagagcaggagcttaggagcccaatcttcaaaggctggagagacaagggaggcagtgccacaatgcagagtccccttggaaacctgtatgctggcaaacctccaagccacaagtgaggatgtgcatggtttcgaggctccagggaccagcaaaagctctctacaccctagagtgtctgtctcccaagatccaagaaagctgtgtcttatggaggaggttgttagtgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctactgggaacatgcgggcttcccaggagctacatgacctcatggcagccagaaggagcaaactggtgcacgaggagcccagaaaaccaaactgtcaaggctcatgcaagagccaaaggccaatgtttccccctattcacaagagtgagaagtttaggaagcccaacttagaaaaacatgaagaaaggcttgaaggattgaggactcctcaacttaccccagtcaggaaaacagaagacacccatcaggatgaaggcgtccagctactgcnatcaaagaaacagcctccttcagtaagcccctttggagaaaacatcaagcaaatttttcagtggattttttcaaagaaaaaaagcaagccagcaccagtcactgctgagagccaaaaaacagtaaaaaacagatcatgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacagacaaatcagaaatcaacagcccttgaaaagtgtgcggtgcaacaatgagcaatggggcctgcgacatccccaaatcttgcaccccaagaaagctgtatccccagtcagtccccttcagcactggccgaagacatccggtgcctctagccaccatcaccactgtccaaggcactgtcttctttgggaaggtatctgatttggtcagtcacaaattcttttttagccttccctggagaaaaacaagtccccaagaaaaaattcactctatgtagagaaaaaatattttctctcatgttagtacatgcagaacatttaatattccacaatatatatggttttttattcataaaaaa

SEQ ID NO: 729775 - DNA, 438 bp, Homo sapiens
tcaagaaagtcaggattctaaataccaacagcatcactctgtcaaaaccacccttgcaacctttctcagaaaaggaaatgtaatgacaagatgaaagttagccagaacggccacgtccagaaaagctctcagtagtacagccatctgtccgaaatactctaaccttcaaggtggccacggtctcttcagagggtcatggagctctgcaaagcttgtcttaaaactgattaaggttgttaaactgaaccatcttgactggccccagccaagtttcttacagtggaaatggcacattaactatgcagctgtcatgagagaagtcagtactcttagattctaacccaaaagaattcaaatatattggatttcctctcctgttcaattggaattcaaggacttaatccacttttaattacactgttcctgttgttgcatcaa

SEQ ID NO: 729776 - DNA, 706 bp, Homo sapiens
agcagtggctccgaaggcaccgtcttcttcaagaagtttatccggaagccaatgcacccattggacataaccgggaatcctacatggttccttttataccactgtacagaaacggtgatttctttatttcatccaaagatctgggctatgactatagctatctacaagattcagacccagactcttttcaagactacattaagtcctatttggaacaagcaagtcggatctggtcatggctccttggggcggccatggtaggggccgtcctcactgccctgctggcagggcttgtgagcttgctgtgtcgtcacaagagaaagcagcttcctgaagaaaagcagccactcctcatggagaaagaggattaccacagcttgtatcagagccatttataaaaggcttaggcaatagagtagggccaaaaagcctgacctcactctaactcaaagtaatgtccaggttcccagagaatatctgctgatatttttctgtaaagaccatttgcaaaattgtaacctaatacaaagtatagccttcttccaactcaggtagaacgcacctgtctttgtcttgctgttttcactcagcccttttaacattttcccctaagcccatatgtctaaggaaaggacgctatttggtaatgaggaactgttacttgtatgtgaattaaagtgctcttcttattttaaaaaattaaaaa

SEQ ID NO: 729777 - DNA, 459 bp, Homo sapiens
tgggaaatatgagtgagcatgtgagaacaagatcccaatcctcagaaagaggaaatgaccaagagtcttcccagccagttggatctgtgattgtccaggagcccactgaggaaaaacgtcaagaagaggaaccaccaactgataatcagggtattgcacctagtggggagatcgaaaatgaaggagcacctgccgttcaagggcctgacatggaagcttttcaacaggaactggctctgcttaagatagaggatgagcctggagatggtcctgatgtcagggaggggattatgcccacttttgatctcactaaagtgctggaagcaggtgatgcgcaaccataggtttcaagcaagacaaatgaagactgaaaccaagaacgttattcttaatctggaaatttgactgataatattctcttaataaagttttaagttttctgcaaagaaaacttacaca

SEQ ID NO: 729778 - DNA, 1338 bp, Homo sapiens; identical to SEQ ID NO: 270241

SEQ ID NO: 729779 - DNA, 220 bp, Homo sapiens
tgcagagacacagagaaaatgccatgtgaagatggatcagagacagaagtgatgcggctgcaagccaaggaatgtgaagaatggccagccaccaccggaagctaggggagacgccagcacagattctccctgagagtatccagaagaaaccaaccctccaacacctggatttcagacttctgaccttgagaagtgtgagccaataaaacaactgcagtgg

SEQ ID NO: 729780 - DNA, 445 bp, Homo sapiens
tgtccatcagacaaggatgagctaatcaaaagaaaacactgcctatgtgcacgactcagcagcctggacagctaataccaaggaacacgttttcactataaagattcagctttcaaaatccagttccctcttgtagagccacagggttaaaagggaccttagagatcatctacatacaggccaaaccctcaatgaatgccagtgttcgccttatgttcttcttgccggactcttttctggcctctgttctgtcaggatgtttcctgttttgcaaaacagctttaatccttgagtatatttaattgttagaaaacagttcctcaaatttgaccccaaatttaagtctaatttatgaagaaagttttgcctttggagacaggtttaattttacttccatgtggaaaaccttcaaataaaatgatgactattgtgtactcacgaaaaa

SEQ ID NO: 729781 - DNA, 860 bp, Homo sapiens
gaggcacctgaggaactaagagcccaggaagaaaggacagtaatgaaaaagccaacaaatgagaccaattctactctaaaagtcaccaggaaaaattcagctccactggtcctggctctaagtctactagcaaaatcttccagagaagtggaaaagccatcagccaatgtttggaaaccattttccattataaaagaaattcttccaaatcacacaaaacactctgacacttctccaattccccctatcatggggctggcagcagccgctttgcgtcctgaatgtcatgacagtgatggtaacagtaatgatgataacagcaatgatgaagtctcacatttaaaattttcaagtcactcatcacatcccaagtcactcccttcattaccttttatttatactggagtcatcctgtgtgcctcagtcagaccattttgtatgtacaatgaccatctgaggcactgcctataaagtggaagatataattataatactacagacgtcattccagctttccagttgcttatggtccagcagggaggatgcacatgggaaaaataataactaatgacaaatgtgatgagtcttaacaaagaagaagagcatattgcaagggaatgtaattcactccagggacaatgagatttaacatgcagtttgcagatcctcccttctctgggtcacctgaaaataagccacaaacaaaggaatgaaattgttgatgaaaagggaagaggcaagactccatatgaagaatacaactgactcacctgtctgtacatgcctctgtgtgtgtgttttatattggtgctggtgaagatagttctttatgctgatgcttaataaggtgaaatgtgtct

SEQ ID NO: 729782 - DNA, 507 bp, Homo sapiens
ttggaaaccattttccattataaaagaaattcttccaaatcacacaaaacactctgacacttctccaattccccctatcatggggctggcagcagccgctttgcgtcctgaatgtcatgacagtgatggtaacagtaatgatgataacagcaatgatgaagtctcacatttaaaattttcaagtcactcatcacatcccaagtcactcccttcattaccttttatttatactggagtcatcctgtgtgcctcagtcagaccattttgtatgtacaatgaccgacaatgagatttaacatgcagtttgcagatcctcccttctctgggtcacctgaaaataagccacaaacaaaggaatgaaattgttgatgaaaagggaagaggcaagactccatatgaagaatacaactgactcacctgtctgtacatgcctctgtgtgtgtgttttatattggtgctggtgaagatagttctttatgctgatgcttaataaggtgaaatgtgtct

SEQ ID NO: 729783 - DNA, 485 bp, Homo sapiens
ttttggtttgatgtaggattgcagtttgattccagctaaccttgtggaggcatttggtttattgattaactgcaacgagtcatctccctgccacccatttcttcctactgtgcaacacactttgaacaaagccattaatcctgaagggctgttttatgcggcttctagacagttcacaactgaagattttgaaaagctattggcttttgcaaagaatttgaatgtagaattcagcttggaagcagaaagaatgacccatggctattatctagcaagtcgcagaatcagaacaggctctgtatgtggatcaaagctgtcagcatctgcattaaaatatctcgttttcctatctgaagcccatgcacgactgaacttaaggaacaaagtgcttaaagaagatgtgctgattgcagccttactatttgaaacatccctcacattgaaatatggtaatgaattaaattattaatgatcactaaaaataa

SEQ ID NO: 729784 - DNA, 533 bp, Homo sapiens
ttcatcttcctattaacatttgccataataacccctcattgaccaccatcattcctccatccaccaccaactcagctccttctctaaagtgccctctaatgggcagtggctttggtctctgtttggcaaattatgtccagagggttaacattaatttctctttctcctattcctccctcatgctagattcagtccatcactcagcctcctgtcaggaaaaccatagcaaatcctactttctgctaaaatgaagttacaagacacttttccagagtagtcacactcaatgaagggacccagggtgtatctgagtgtgatgtaattgaaaccacatggaaagactagaaataccttgctcccagtcagatatagtgaaacagcttactcaagactggactaagatttagaatataggggggctagggaggagaaagagaaagatcctcagaagtggattgtccctgaatacaggatgaaatcatctagatttttttctccaattaaatttgcatttcattcaaccacaaaaaaat

SEQ ID NO: 729785 - DNA, 561 bp, Homo sapiens
acctggcaagggaacctccacagcccaagaatattaacatttatcaggtgccgggcatgggcctcatgtgttttatgtaattcaatcctcccaacaaaagtatgagagccagccctgcagcacagccttcaacatgagcaactcctgctctctgtagctccagccccagcctggacctatctttcagagccataatgctgagacagtccctgagtcttggatgaacacaggactcacagtgtctacaccggacagtttctgtttgcacgacgttgagtaaacttcacatccatcggggaagttaccctttgggattactgatgaaggtgaggagaagatgctgttctgagagctgctgataatacgtggatccaaacccacaggcttgagctgcttaattgaaattcacgtcaaaatgaaattctggtttagctcaacttgactactatggatgatgaaaataaatccctgggtcacacaaggatagtgattgagtagagcttgtttgctggcacaggaatgacatttcaactggaattaaattgtcgtcagttaacagaa

SEQ ID NO: 729786 - DNA, 463 bp, Homo sapiens
acctggcaagggaacctccacagcccaagaatattaacatttatcaggtgccgggcatgggcctcatgtgttttatgtaattcaatcctcccaacaaaagtatgagagccagccctgcagcacagccttcaacatgagcaactcctgctctctgtagctccagccccagcctggacctatctttcagagccataatgctgagacagtccctgagtcttggatgaacacgtgaggagaagatgctgttctgagagctgctgataatacgtggatccaaacccacaggcttgagctgcttaattgaaattcacgtcaaaatgaaattctggtttagctcaacttgactactatggatgatgaaaataaatccctgggtcacacaaggatagtgattgagtagagcttgtttgctggcacaggaatgacatttcaactggaattaaattgtcgtcagttaacagaa

SEQ ID NO: 729787 - DNA, 1357 bp, Homo sapiens
gtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatgattcccttggggctcagcatcggggtctgtgtccgagtggggatggctctgggggctgcggatactgtgcaggccaagcgctcggccgtctcgggcgtgctcagcatagttggcatttccctggtcctgggcaccctgataagcatcctgaaaaatcagctggggcatatttttaccaatgatgaagatgtcattgccctggtgagccaggtcttgccggtttatagtgtctttcacgtgtttgaggccatctgttgtgtctatggcggagttctgagaggaactgggaagcaggcctttggtgccgctgtgaatgccatcacatattacatcatcggcctaccactgggcatccttctgacctttgtggtcagaatgagaatcatgggcctctggctgggcatgctggcctgtgtcttcctggcaactgctgcctttgttgcttatactgcccggctggactggaagcttgctgcagaggaggctaagaaacattcaggccggcagcagcagcagagagcagagagcactgcaaccagacctgggcctgagaaagcagtcctatcttcagtggctacaggcagttcccctggcattaccttgacaacgtattcaaggtctgagtgccacgtggacttcttcaggactccagaggaggcccacgccctttcagctcctaccagcagactatcagtgaaacagctggtcatccgccgtggggctgctctgggggcggcgtcagccacactgatggtggggctcacggtcaggatcctagccaccaggcactagcaaagaagcttggaaatagaaagccaggagtggctgtccccagtatgcaaacacaccacggtctgccctgcaaaaacaccaatggggtctagtgcaggtggacactttgaaccactcctcaaaaaaagaactttggctgattccttgtggtgacactcagaggggtctgaacagacttgacaattctgttctggtcaagctggagttttcttctgtgacttggactgctctacagaagacatcagccaactgcacgagtcagagtccagggattgtcactattattaataatgtaaatggcttcaaatgggacactgcagataaaatcacaaaaaccactgttatattaaagattacacatttcctgggcacagcctgctgctcaagtctgtcata

SEQ ID NO: 729788 - DNA, 2054 bp, Homo sapiens; identical to SEQ ID NO: 272491

SEQ ID NO: 729789 - DNA, 635 bp, Homo sapiens; identical to SEQ ID NO: 728399

SEQ ID NO: 729790 - DNA, 840 bp, Homo sapiens; identical to SEQ ID NO: 272436

SEQ ID NO: 729791 - DNA, 925 bp, Homo sapiens; identical to SEQ ID NO: 284514

SEQ ID NO: 729792 - DNA, 325 bp, Homo sapiens
gaatggatgttttcttttaaaaatggtttattgaagtatcatgtacctatcttaagtgtacagcacgatgatgtgtatgcccatgtaaccatcacctagaaggatgagaaccacaagcatgagaacatgaggataaatacactttggggaaaaagaaaacagacagaggcagcagagaaggaagacgagaagaagagaaaaagagaagtaggaagaggatgaattcatttcgcttatctggcaaatgtgtaatctgagtaatagaggtgagtgtttctaagaggatgctgttcagagacaaatacactgtttaaaatccattaaa

SEQ ID NO: 729793 - DNA, 577 bp, Homo sapiens; identical to SEQ ID NO: 259235

SEQ ID NO: 729794 - DNA, 530 bp, Homo sapiens
gctggtctcgaattcctgacctcaggtgatccacctgcctcagcctcccaaaatgctgggattacaggtgcgagccaccatgctcagccctgaatccctgactttgttaatgacctgtccttaccaaccatgacctagagaagatttggctttttaagagttttggagaaagatggcataaaaatagattatttccttaaatcaattttttagcattacgctacctaagctcgtttggtctctcatagacaagaaaatacattatattgtaggttacattcttttaattttgaagagtcacaaaactcacattatttagagcaacaatatttgtatttggaaattaaaaattcatgatttcaagaaaatacataaaatttacatttttgagtagtttgaataagtttctatcttaattataatatttgtaggaaataacaaaacaaactcaaagcctttattatttccagtctctttgtaactgatgtggtatggtatcatcatgaaatctaaacagtggtacactgagt

SEQ ID NO: 729795 - DNA, 442 bp, Homo sapiens
  misc_feature (22)..(22): n is a, c, g, or t
  misc_feature (32)..(33): n is a, c, g, or t
ctgctgcctgagagggcttcancctacaacanncgtgcccaggcccggcgactccagggagacgtggcaggcgccctggaggatctggaacgcgcggtggagctgagcggcggccggggccgcgccgcccgccagagctttgtgcagcgcggactcctggcgcggctgcagggccgagacgacgacgcccgcagggacttcgagagggcggcacggctgggcagccccttcgcgcggcgccagctggtgctgctcaacccctacgccgcgctgtgcaaccgcatgctggccgacatgatggggcagctgcgccgcccccgtgacagccgctgagcgccgcggacccgggcgtccgcgggcgaggggacgggactgggccctgaaccaataaagccgtcgggcctcaccgactccgcctgctcctgcgtcctgcccgcgcccg

SEQ ID NO: 729796 - DNA, 1790 bp, Homo sapiens; identical to SEQ ID NO: 265178

SEQ ID NO: 729797 - DNA, 484 bp, Homo sapiens
cgctgggaactcctgagcgcccccgctcccagcctttgtgccctccatcatttcctggccccagaccccctaccgaccttctctcttggagcgcggagccctcttcgacgcattccgcaggaccgccccttctcagctgctgcccagagcgcccccatccgtcaagaaggcccactgttggtgcttggttcccatctgtcacctagcgcccccagtgcagagcccagcataacctagagcccgctgtcaacagcgcccaccgagggctccccgcccccacgcagcaccagcgccaccgcacacctgactctgtccgctcacacagcctcaccttcacctcttgggtatttcagatccgctctggcccagtgggcagaggcatcgcctagagaaaataacctcagggttccctcatccctctgacaaacctgcctctttccctgaaaccattcaataaaacctctgatcaaagtgtcaaaaattt

SEQ ID NO: 729798 - DNA, 460 bp, Homo sapiens
tggtccttgtgccaattatcactgccccactcatgccgcaggatataaagcagagtgacagggtcacaggactgccagaggaatacagcttctagaggctacccacattcctgggctaatggccccttcctacatcttcaaagccagcagtggtgggctgagtctttctcctggtatcatctcttcattctctatctccctctcccaattttaaggacctctgtgattatattgggcacctggatattgcaggatacgctctctattttaaggctatgctccgtaaagagagtgcctcctctagaatcacaagacctaagcatgaatcttcctttgaaggataaaatggaaggaaaaaaactggatgaggaaaagaagagtggggaatagaaagagagagagagagaaagatggataaatttttaaagttactataataaaaatcttctacaacgaaaaa

SEQ ID NO: 729799 - DNA, 517 bp, Homo sapiens
aactgctatttgtatattgcatgatattttatcaggaaaaaatataaaacagatctaatttcatgaaaatgctgttgccataatgctcaggagaacagggggaagagagagattcaagtcttcctaatgtctaccttatatgcaggtacattttacaagttctattgtattctgacttattaagcagtgcatatttctttcttttacattagctttcattgcagaagggtgtggggagatgagactgctggaaactgacgtgggattgatgtttatcagggctgtaggcttcagaaatatattaagcctcggaatgtcctaggtatgaaaaagataataaataacaggtcaatttattatattccctttatctctatattacctgagagagattgctatactgcagtgacactttcaagatgccccaatcctccaatctccatgcataacaatttgaaaaagggaaggttgactaaggctgggatgttcaggatcaatttctaatcagtttcaggtt

SEQ ID NO: 729800 - DNA, 300 bp, Homo sapiens
aactgctatttgtatattgcatgatattttatcaggaaaaaatataaaacagatctaatttcatgaaaatgctgttgccataatgctcaggagaacagggggaagagagagattcaagtcttcctaatgtctaccttatatgcagagccttggaaagatgggcaaatgctctgtgacaagccaccagggtagactggtactgaaaagaccctactacacacaggggctctgtccctggctggaaagttacaagtcagcctacctctctgtgatctggtttccacacctactactctttat

SEQ ID NO: 729801 - DNA, 452 bp, Homo sapiens
ttcaggatggagcagacacagccgcagcaaggcctctgtgcagcccccggcttaaaacacatcaacgcatccgtgggcacttttgtgagttaaagctcaacttacacatctgcctgtatccataggaaatgaatgaaaataaacaaacaaattccttgcattcaacgcagcgtaagaaaaatcacatcctgttccccagtagctgaggaaagccggctcacgagagtatacagggagaagaggccagcattgtgtggctgccagcaaagctcacttgtatgtcaaatgcagcgcttttcttagcccattatgtattttttttttcttgaacactcctgtgtctaccgggatctcctgtttttattgttttgggatgagattttaaaaacaccatttaatgtagcctgtgtgctcttgttcattaaaccaaaaagaaaccctggatcacggca

SEQ ID NO: 729802 - DNA, 430 bp, Homo sapiens
cctttcaggtggacatggactccatggaagcctgagctgccaggggcttccctggggcagcactgcttcgcgtaggctcacgagaaacttccagggttcctgggaaatgaatgaaaataaacaaacaaattccttgcattcaacgcagcgtaagaaaaatcacatcctgttccccagtagctgaggaaagccggctcacgagagtatacagggagaagaggccagcattgtgtggctgccagcaaagctcacttgtatgtcaaatgcagcgcttttcttagcccattatgtattttttttttcttgaacactcctgtgtctaccgggatctcctgtttttattgttttgggatgagattttaaaaacaccatttaatgtagcctgtgtgctcttgttcattaaaccaaaaagaaaccctggatcacggca

SEQ ID NO: 729803 - DNA, 406 bp, Homo sapiens
agaaatccagccatatcatcttggcctgttgtgtcctccacaacatctccctggagcatgggatggatgtttggtcctctccaatgacaggacccatggaacagcccccggaagaggagtatgagcacatggagtccctggacttagaggctgaccgtattcgtcaggagctaatgctcactcattttagctaatgtagaaggtggagaggagggatacttcccaggagttgtgacagactttcctcctcatcaccttttacacagttccatcatctagcatgactgagtatacagatacttgtcataaactgacatttaatatgtgtgttttggtaaggttggggctatgccagaatatcttgattcatttgcatatgcattaattaaactgaaaccaagaaaaa

SEQ ID NO: 729804 - DNA, 798 bp, Homo sapiens
aatgtggctggcaactgcgggggtagaagaactcaggcaaagtaggcacaggaatgggggagatgagagccaagggacaaacgccgagaaagcgttccgacaagcatgtgtgttcatacatgcatacccccaacaaagggcaatgcactgtgtaacagaactgaacacaatttaacaaagctgctcccagccttcctgtcacctctttggcagtagggcaggccatctcaacttcggacacacaaagacattctcttcaggaggaaggctgtcctgtgtggtggggacaaggcttcagttgcaagatggtcgtctctccttcttcctgaataagacaacgtaccactgttataagattccaagtgaattccttcagaggaagagaaggacaacataagaaggcgtggatgacagactttcagttaaactaacaaagaaagaacactgcagcaccatctatgcctacctttttctcagcgtttataaaaaaaaattcatattccctacaaagcaaaactatggtataacaggacaactaagactgccctggcaccagagaaactacaatctagatgtgctctgcttccagtcggccgagaagcctgcagcaaatcacctaaacacttaaggtctttgtgtgccatccacacccaactgcaactagagactttcattagcccctttctgtctcagagctttcggtggttctacaagtcaccagcctggatctctaacaatgtgtctctccaaagctgttaatacattcacatccaaaatatctccagccacgaaatccta

SEQ ID NO: 729805 - DNA, 547 bp, Homo sapiens
aatgaattcatcaattttttaaaaagaagcatgagatcaaaggtagaactaagtggtgaatttcacaaagtagacctaggcaatttcaaattggctgctatacttttcaaggtaaaggacacaaaccaaaggtacctatatattcttttcatgatatttatttcaaggagacagatcaaattaaaaacttcaagaatgttttctgcctggtaaataaatattccagcaacccacataggcacagactcagacacttagtccaatagaactccaaagaggttttcctgacactgagaagagggggtgagttttgggggaaaaatttttaaaaataaagtacttccagtctatatattgtaaactcacctattcatggatttgtgaaatttagaaacagcctaataaaaattctaggacaactgagttgtcacaacgtcacaagagcacaaattcatattgagtgacttttctagtaatatgaacaaaaccaacataaatttccctcaacatatcagaaataatatatattctatttagttccaagaaa

SEQ ID NO: 729806 - DNA, 478 bp, Homo sapiens
aaaaagagttacagtgagctaagtataacttattgaaaacatttttttaatttagtatagcctaactgtgtttatacagtctacagtagtatacagtaatatcctagacctccacattccctcgccactcactcactcactcaccgactcactcagagcaacatccagtcctggaagctccattcacagaagctattggaagagatgctcaaagaagaaaaaattaccataatccaataaagaagaagacctgagatccaggaagcagatgatctgaactgcagagaaagttcaggaaagttccctcattcatgatgatgggaaataacagtaaattctgtacagcagtcttggacaacaaccaatctaaactggcacagtgcagaggcaatcaacagagaacataatattgatagaatgcctgacgcttttgattgtattcacaggaaacataaacaattggaagacagtttatgaa

SEQ ID NO: 729807 - DNA, 498 bp, Homo sapiens
tgccacgcagaaaaacgaggggttgcaactgccacgcagcaactgccacacagaagaaggagggactgcaactgccatgcagcaactgccacacagaaaaaggaggggttgcaactgccacgcagaaaaaggaggggttgcaactgccacgcagcaactgccacgcagaaaaaggaggggttgaaaagggagtagcttctgatattcagaagctattggaagagatgctcaaagaagaaaaaattaccataatccaataaagaagaagacctgagatccaggaagcagatgatctgaactgcagagaaagttcaggaaagttccctcattcatgatgatgggaaataacagtaaattctgtacagcagtcttggacaacaaccaatctaaactggcacagtgcagaggcaatcaacagagaacataatattgatagaatgcctgacgcttttgattgtattcacaggaaacataaacaattggaagacagtttatgaa

SEQ ID NO: 729808 - DNA, 650 bp, Homo sapiens
gtaagtacgaatcggccttaggttccctgcctcaagaccctattctcctgcctcacttttagctaagggttattacaaaagagtcagaaagttaagacaaaatatgaaagtttataaagtaaaaagagttacagtgagctaagtataacttattgaaaacatttttttaatttagtatagcctaactgtgtttatacagtctacagtagtatacagtaatatcctagacctccacattccctcgccactcactcactcactcaccgactcactcagagcaacatccagtcctggaagctccattcacagtaagtaccttatacaggtataccatttttacatcttgtatagtgtatttctactgtgccttttctatatttaaatttatttaaatacacaaatattacgtgttaaaattgcctataggattcagcacggtaacgtgctgtacagacttgtagctaagtagcaataggcactgccatatagaaggtgcagtagggtataccatctaggtttgtgtaagtacactccttgatgttggtacaacaatgaaatcacctagctgtgcatttctcagaatgtatccccactgtcaagtgatacatgactgtatattaatatgaagatgaaacctagctatgtaaaga

SEQ ID NO: 729809 - DNA, 517 bp, Homo sapiens; identical to SEQ ID NO: 728402

SEQ ID NO: 729810 - DNA, 1417 bp, Homo sapiens; identical to SEQ ID NO: 21

SEQ ID NO: 729811 - DNA, 238 bp, Homo sapiens
gtccaggcaagcccctagctcctactttttggccttgacgtgcagcgcccggggctgcaccgggtgtaactcgggcctacagggggcgccctcggaagaggcgggcggcagcaggagccgcaggtcgggcctgaactgccgctgggagaggaagcagcgcccttgccaggaacgtggggctgtggtagcagcaacacctgctccagcttcacctccagcagtgctgcgccgcacacgg

SEQ ID NO: 729812 - DNA, 381 bp, Homo sapiens
tttttttcaggttcctgtatcttcatgtcgagttgctcattgcccaacgtagaggactaggaatcaggattcggtggctatatgctggaggctggacgcgggagcgcggctcgcctcattgcagttgttggcagtgatggagagatagcatcgcggctggagagtctttccatcgtgttccactgtcgcagctacacaccagatatgaagactacaagcaacctcaaaaggtcttttcatttgttcagcatttgaaacttcttcctgacaccagaggggctcttcttagctgtctttttcctgggttattcctggtaaactagctgatatttgtttcaaagcatatgtctctaataaagtgccagtctctcttaaaaaaaa

SEQ ID NO: 729813 - DNA, 377 bp, Homo sapiens
gcaccatcctctgatccagggactgtgagcaacagggccccgtggccaggacatctctcaccctccagttaaaatctcgccagttgagtctgcccatgaaagtaggcgctgaactgcccaataaatccacaagtaagagttgcaagaaggagccaaaaagggctgagctgaatgactcatatatgaaataatttgataattaatataaataggaaatttaaagtctccagctgagtgacagaaaacaccttaaaaagctcaagagagaggaaaggaagaaaataaacctataattgcaaaataaaagcattgaaagaagccgtgctcaaggtaagatgctacagatgcaataaattcatgttttaacattaaaaaaa

SEQ ID NO: 729814 - DNA, 842 bp, Homo sapiens
ataaaccgaaacttctctgccttcccgctgcaagagtgaatgagcgatccctctcaactgactcaaaatgtttgcctcacccaggagggctccctatgcctctccttttttcctttcatctgcattattcccgttgccaaaatctggagcctggtaaaggcccagtagcggtggcaacaatagagctgtgtgtcaccccagtgagctgaaagagcagacatcaagctctatgccagagaacagtggggcatccccaaggtcctgctggaaggcagctctgatctggaactgggaaggacaacacacagtcaagctctttctcgtctcagagaatccagcagaatcttcagggatccttccagaccaggaagactctcacactctgcagagaagttgcggcttgtttagcatttgacctacattcagaaacgaccagcctcccaactttcagctctaaggattacttaaaaaaacaaatggtgttcattctcagatatcttgcctttctcaggagagaaaaatgaagcttgcaattagccagcaaactagcacatacacaaacacacacacacgtacatacactccaacacagggagcaatgtggtatgttgttgaccagctggaagttaggatctcaaaggaaagaacaggataacttaagaggcacttctgggactgcagagctgagctggtggttctgaagagccatcggagtgtgggttcaggcagcttccctaattcagaagcagccccaagtgaatagatgacaaagaagtggatgtgaacatgacagaaaaagccagtcatggcttagaataaattttattattgttctttaaaaa

SEQ ID NO: 729815 - DNA, 143 bp, Homo sapiens; identical to SEQ ID NO: 513934

SEQ ID NO: 729816 - DNA, 1252 bp, Homo sapiens; identical to SEQ ID NO: 257223

SEQ ID NO: 729817 - DNA, 1434 bp, Homo sapiens; identical to SEQ ID NO: 257225

SEQ ID NO: 729818 - DNA, 363 bp, Homo sapiens
gtgaatggctacttcctggcaggccgggacatgacgtggtggccgattggagcctccctcttcgccagcagcgagggctctggcctcttcattggactggcgggctcaggcgcggcaggaggtctggcgtactgtaggaggtttgctttctctgggagccctttagagtccggagggacttggccttggcctgcccttaaggctgagtttagagctttccactcatactcttccttcctctcccacatttcttgatctccaccccacccccatgccagccacccccatgccagccacctccctggaaaccagggatacagaaataaacaagacctggccctggtctgccaggggctcgcactg

SEQ ID NO: 729819 - DNA, 446 bp, Homo sapiens
attggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagaggtgagtagcaaaccccgtaccgcagtcttcgccagatgcccttggcgtactgtaggaggtttgctttctctgggagccctttagagtccggagggacttggccttggcctgcccttaaggctgagtttagagctttccactcatactcttccttcctctcccacatttcttgatctccaccccacccccatgccagccacccccatgccagccacctccctggaaaccagggatacagaaataaacaagacctggccctggtctgccaggggctcgcactg

SEQ ID NO: 729820 - DNA, 453 bp, Homo sapiens; identical to SEQ ID NO: 411517

SEQ ID NO: 729821 - DNA, 552 bp, Homo sapiens
aggcaacattcgaaacccaggtgccactccttcaggaaggtaccatcaagctccaaggactcttatcctctttctccttccccactacctagtcattagagcgtcagcatccacttcttgaaaggaagatgcctgtttttcacatatcccagaaaaccccattttaggacagcatttagcagagtatattcaggatcccactaacctttttggaagacatgacttccagatgatataaggctccatcaggaactgtgcaggactgtgcactctgttgatactcacatggtggaattatattgcctttggccaaccctaaagccatcaagatagcaggtttggaataattcactgtcgaagtcttcttgagctgagcagtcatgtgagcttggaagatgatccctctccagctgatccttcagctcaggccatcatctacatctggattcctgacccggagaaactatgagtaatgtgtgctgcttttgagccactaagctacatggtaataggctatgcttcaataaacaataatacacttgaaaaaaaaaa

SEQ ID NO: 729822 - DNA, 839 bp, Homo sapiens
aggcaacattcgaaacccaggtgccactccttcaggaaggtaccatcaagctccaaggactcttatcctctttctccttccccactacctagtcattagagcgtcagcatccacttcttgaaaggaagatgcctgtttttcacatatcccagaaaaccccattttaggacagcatttagcagagtatattcaggatcccactaacctttttggaagacatgacttccagatgatataaggcaagaataagaaatttcagtgacagggaacagaaatcatatttctgcattcaggatcatgttttcttggctccatcaggaactgtgcaggactgtgcactctgttgatactcacatggtggaattatattgcctttggccaaccctaaagccatcaagatagcaggtctggtctaccgagaagagagatcaaagagctcttcagctgttcccagctccccacacaaatctacctaacaaagtcccgataaacagtctgttttctggagtctatcaatactgatgaggtcttgttcttttggccaggctggagtgcagtggtacagtcgtgactcactgcagcttcaaacacctgggttccagcattcatcccacttcagcctcccgtgtagccgggactacaggtccctatcttttttgttggagaatgaaattaaaaaagatttggacactcattggttgtacacattgttactggggaatgtgttgattggaggccttgttagctaacagagcaaagagtaaatatacacatatgtttacaaatttctacaagtctccatatgtatctgcattaaattaaacatgaattcctacagc

SEQ ID NO: 729823 - DNA, 451 bp, Homo sapiens
tgcctcctggactcaaagaatcctcctacctcagcctcccaagtagctaggaccacagagttgtgctctcctgcagcgttttgcggacggctggctatcttacccagaatcaatcacactgggaccctgaaaaaaaaaaaaaaaggaaaaaagagcaagggagtaattctagcctgtttttacaagaacacagtggctatagacagtgccagtgtgaagatgactcagcaaacgtggagaaccaaagattctagggcagcaccaaaactgggaaagcaattacagcagaagttgccttccccatggtagcttagcaacttcgtgtctctccaaggcagagaggaaaatcaagtctaacaggccttcccgaaggctaggtgtgaaataccagaagccatctttgtttctggcgatgtcactaaataaatatttgttgatataaagtattaca

SEQ ID NO: 729824 - DNA, 583 bp, Homo sapiens
ggctggagcagccttagatgccaggtcagggtggcccgggggccactgcctccagctgtgtctagtgctgcagggatctcggcatgaggccccttctcccaggaggggaggcacagcctggagacacaggccccatccttcccaatggggacacttcagggagcggctctcaggtcccgagaaagaccttcctggccacaggagacacacggacatcgggaacggacggaggaaggatgtgcagttgcagccttttcagcagacgccctgagaacgggaggtcaagagttggagcagacgggtcgacagggcctcagacctaaggcaggagcaccccctatgccagacctcctgggtcacaggatatgcacggacattgggaagggatggaggatggacggaggaaggacgtgcagttgcagctctttctgcagatgccctgagagaggagcaagaaggtcctcgccagatgctcctggacttgctttggactttcccttgctcttggacttgctctggcacctgtgctcttggacttcacagcctctagaactgtgagaaataaatttccgttcagtataaa

SEQ ID NO: 729825 - DNA, 353 bp, Homo sapiens
gaccaggagaccatccctgcagcagccgggccatgctctgaggatgtgggacgaggacccccactgtctctgagtacagggcctcagacctaaggcaggagcaccccctatgccagacctcctgggtcacaggatatgcacggacattgggaagggatggaggatggacggaggaaggacgtgcagttgcagctctttctgcagatgccctgagagaggagcaagaaggtcctcgccagatgctcctggacttgctttggactttcccttgctcttggacttgctctggcacctgtgctcttggacttcacagcctctagaactgtgagaaataaatttccgttcagtataaa

SEQ ID NO: 729826 - DNA, 256 bp, Homo sapiens; identical to SEQ ID NO: 274819

SEQ ID NO: 729827 - DNA, 665 bp, Homo sapiens
agcctggagacacaggccccatccttcccaatggggacacttcagggagcggctctcaggtcccgagaaagaccttcctggccacaggagacacacggacatcgggaacggacggaggaaggatgtgcagttgcagccttttcagcagacgccctgagaacgggaggtcaagagttggagcagacgggtcgacagggcctcagacctaaggcaggagcaccccctatgccagacctcctgggtcacaggatatgcacggacattgggaagggatggaggatggacggaggaaggacgtgcagttgcagctctttctgcagatgccctgagagaggaggtaggagcacccttgctgtggtttgaatgcttctctcctccaaaactcatgttgaaatttcattgccattgtaacagtatgaagagtgattaggtcataaggtccccacctcatgggtgggattggtgctgttataaaagggtgagttcggccccctcttgctctctttcttgccttccgccatgtgatgacacagcaagaaggtcctcgccagatgctcctggacttgctttggactttcccttgctcttggacttgctctggcacctgtgctcttggacttcacagcctctagaactgtgagaaataaatttccgttcagtataaa

SEQ ID NO: 729828 - DNA, 566 bp, Homo sapiens
acttgaacccaaggctggcacaaaagccagaaggtgttactctccaccagctcagggattgtgaagatctctgtgcagactccactctgtggttggacagcatccctgagacatgcattttggaaattgtgatcaaccagaatccagaacacgctgtgcttaatggagtgaactgcctgtgaagcgcaggtgtgaggggcggatgataagtgacagtgccggtgcccccagcgcccttttacctgatggctcacccggcctacagctgcgcccttccctttgaatcgtcttgggtaacgggtgctgctttggaaatgcctggaaggtcatgtcctttgtctggggatggcttccagctgtggttgactgatagcagggggcacagaaggccagacacaacttgcctcaggtgggccgactctgagggtttgttcggcctccacgtggacttcagctgagcctgcatctttgcttggcttttcccactggcctattctgcttccctctccttaagggttctcccaggagaactcccttaataaatcacttgcacaaggaaaaaaaaa

SEQ ID NO: 729829 - DNA, 825 bp, Homo sapiens
gaatcatgagagatgaaattgcaacaacagttttctttgtcacaagattggtgaaaaaacatgataaactaagtaaacagcaaatagaagactttgcagaaaagctgatgacgatcttgtttgaaacatacagaagtcactggcactctgattgcccttctaaagggcaagccttcaggtgcatcaggataaacaacaatcagaataaagatcccattctagaaagggcatgtgtggaaagtaatgtagatttttctcacctgggacttccgaaggagatgaccatatgggtagatccctttgaagtatgctgtaggtatggtgagaaaaaccatccatttacagttgcttcttttaaaggcagatgggaggaatgggaactatatcaacaaatcagttatgcagttagtagagcctcatcagacgtttcctctggcacttcctgcgatgaagaaagttgtagcaaggaacctcgtgtcattcctaaagtcagcaatccgaagagtatttatcaggttgaaaacttgaaacagccctttcaatcttggttacaaatcccccgcaaaaagaatgtggtggacggccgtgttggcctcctgggaaacacttaccatggctcgcagaagcatcctaagtgttacaggcctgctatgcaccggctggacagaattttataacccacatctgggaatgaatttgcagcacctggtagaagaaggcaccttggaaggcactgccttgggcttccatggcaggaagatgagaagaaatcttcagggtgatttctggagcctgaaaagaataaaaaacaaaaccaaacctatc

SEQ ID NO: 729830 - DNA, 720 bp, Homo sapiens
tcttaatactcatatttagaacctatattctaaacctccttgtgaagtttatctcttctcgcttagaaaccatcaagcttcagatggtgctgaaaatggagccgaaaatgaaactgccctcctacgagggacccttaaatcaaccccaggaggagccctagctgctgttccccacacaacgccactctccagcaggaagtagccagaagaaatcgtcacccagtttcccctagcagcagttatggatttcattcctgaggggggaaatatgttataggaggcagaaagaaatgatttaggtagacatttagggtaaagtgagtccccagcagaaaactttccttttaacaaaaagcactaaaaacagacttgggcggatgtctgcagctgcaagaagatgtgtgggaacagacacagaaactctccctcccagataagcaagacaaagaaacacagaataagagtccatctatgtggtcagagaatgggataagagctgatttaaaaaaactctgctctatatagaaggcacacctggtcccaaccaaaccactggaccctaggaggataagacctcctctgctcatgagccccctcctcagtagcccatttataaaaaccctgacaattttactaccacttggcaacccgctcgggacccctctctgtgatggagagctgttcttttcttttgcctattaaactcctgctccaaactca

SEQ ID NO: 729831 - DNA, 590 bp, Homo sapiens
tctagttctgggcaattatcctacaaatcctgccagaaaccatcaagcttcagatggtgctgaaaatggagccgaaaatgaaactgccctcctacgagggacccttaaatcaaccccaggaggagccctagctgctgttccccacacaacgccactctccagcaggaagtagccagaagaaatcgtcacccagtttcccctagcagcagcgcagtaagattgaggagctaaaaacagacttgggcggatgtctgcagctgcaagaagatgtgtgggaacagacacagaaactctccctcccagataagcaagacaaagaaacacagaataagagtccatctatgtggtcagagaatgggataagagctgatttaaaaaaactctgctctatatagaaggcacacctggtcccaaccaaaccactggaccctaggaggataagacctcctctgctcatgagccccctcctcagtagcccatttataaaaaccctgacaattttactaccacttggcaacccgctcgggacccctctctgtgatggagagctgttcttttcttttgcctattaaactcctgctccaaactca

SEQ ID NO: 729832 - DNA, 482 bp, Homo sapiens
tcagtagactccagcgtggattttaattgcctcaatcagcagtcattctccccagccgtcactcagagcctggacggtgggtcccgcgatctagcccttggctacgcaggaacggtgcgcccccgggtacggcgcggttcagcaggcaggcgtcaggttctaccaaggcgctgaaatgagcccatcagcgggtaggagcccttcccccgccgtcccctccccaggctcgtgaacggcgcctgatgcccgcccggggcgcgagctctcgaggtcgcagtgacctcagcacctgcttggaggaaaacggcgcgggaaccccgcttccttcccctcagctggagccagacctcaaacaaaaccccaatcgatgcacacagaaaactcctctgggccacgcttcccgcctcgccgaggtctccccagtctgcccctcgctgacgctggcgcgcagcggctgtggcagcacccgggacagcggccgc

SEQ ID NO: 729833 - DNA, 471 bp, Homo sapiens; identical to SEQ ID NO: 243214

SEQ ID NO: 729834 - DNA, 656 bp, Homo sapiens
  misc_feature (35)..(35): n is a, c, g, or t
caaaacccgcaggagaaacaggtccgactcagtantgcagtcgcaataacatgtctgctcccgaggttaacattcaagcgtttctactttgaaattcagcaagagtttctgggccttatgtttgagggtaccttttgctgcagttgtgaatattcagtacattgccagctcttggtcactgagtgattgagttagggctccgcaagagactttggggagtgaagtggatctcttcctcatcttttggtcctctgaaatgtgtgttctgaagccatggggctcgtcttctggggtgttcccctgcaggtgctggtgaaggtaacctggggcttaatgatggagtccctgatcatttttgcacaagacaggttgctgaggggtcggcaagcatctgacttgcccaatcccctggatatggtgagccccgccatgcttttattctgtatcgcttttgtctttattgctgctttcaacatttacgtttggttacagttaactattttcggagtgtggtgattgaagacaatttcatcatcccactgtacttttttttttgagactctgtctcaaataaagaaaaaaaaaaagataaaaataatttttaaaaagtaaagataggcctgggcaacagagtgagactctgtctcaaataaaga

SEQ ID NO: 729835 - DNA, 420 bp, Homo sapiens
aaaggaaaaattcattagctactttggcggatactaggaaattgattctttttttttttttaactcataaatggaggttgaaacccaacctatttatcctgtcttccctaagtgagctgtagttcagggcaaccaaaccactgaggagccaagtttctctctctaggagtattctagctaaataaatgaggaaggagtgatggaccaagatggtggccatggagccacccctaatgcattagtggaccaggcaataatcatcaatggctgctaatatcacaaaaggagagacaggcagacatttcgtgtcccctgatgggatgcagtaggaggaaccaccacccgtaaggcagatatgccaaagattcaaacttgaatctgattaaacctctaagtccatctgccaacttgcaaaaaaaa

SEQ ID NO: 729836 - DNA, 614 bp, Homo sapiens
tcattcctaactttgtagttgggacagacctctgattaacaagagaaaaacaagcaagtttactaaggcatgcagcccacagcacgtgggagaaacctcagtgaaactcaaagcgcagtggcttagaagtctggctcatcttcaacaatacatttgtggagaaatgacaggacaatggaaagcaattttaggtgtccgaaggcaagaaaccgtgggaagataaatatatgggaagaaactagtggaatacgtgtgtttgtacattcttctgctgacatccctgagctggtaagaatggtctccggtaaaagagaatttacatcctgtctttagatgaaaagaggggaggatctagagagctcttcctccattggctgcttcttaattgcctttacttcaaaatatttgtcaaaaaggcatatttgggggtgacatattctgattaccttcagaagcttgtctttatacacatttatttcttttagggtagattttactttcatttgtcactaatatgattgcttcagtacacagcattctgtggcatggcttcatgctttagcactgtggctctgaattaaagcctgaaacaatttataaaaatactggtaaaa

SEQ ID NO: 729837 - DNA, 991 bp, Homo sapiens
aaccaatgaaagtaaatagcctaagggtacaaacataagtaaatctataaattaaagccaaagaatgataagcacaaattcaaggcagtgatttcctctagctacagagggaagggaatgaagtaaggaaaaggtgaacaaggagcttaaaagtatgataattatatgtgttggtttggccaaacagtcctggtttacctagcacagttctggtttgctgattgcctggtgtaatgattaatagcactgtcactccccaaattgtcattgtttggataatgaattatatgcatcctttttagagtaaaagtaacttttttctccttaaactggatggagggcatgtgggtctttatcattcttccttatacatgtatttttaaaatataatttaaaactagtcagtattttaaaatataatttaaaactttagtcagtgttagtcactgtgttagtgacaacacagtaaaaaaaaaaatttgtaagataaatcaatataaataggatccaaatgaactcttttcatctgggtggatacagggataaataacatactatatgcctggcattgtattaagcttgttactgatattacttcatattcatagcaagacatttaggtaggcattattatctccattttacacatgaagaatctaagacacaaagactatacataatttaaccaaagtcatattatatgtgacagcgcagaatttgaacccaagcagtgtgacatcagactacatgctcttaactaccatgccagagcccataacagattttcttaaccttttttatgccacagatccctttgacagtctggtgaagcctatagagtcctttttagagtaatgtcttttgtacatcaaatataatgcacaggattataaataaaatcaattatactaaaatatggtaatcaaaatatttaacaaatgtatactatacctgtactttttattaatgcattaaataaataataaaatct

SEQ ID NO: 729838 - DNA, 394 bp, Homo sapiens
tgggccttgactttctcctatggccgagccctgcaggcctctgctctaaaggcttggggtgggaagaaggagaacctgaaggcagcccaggaggagtacatcaagcgagccctggccaacagcctcgcttgtcaaggaaagtacactccaagtggccagtctggagccgcagccagtgaatctctcttcatctctaaccatgcctactaaccagagctgatctaaggctgctccatcgacactccaggcccctgcctacccacttgctattgaagaggggccttcaggctctttcccatcactcttgctgccctcgtgtgtgcagtgttgtctgtgaatgctaaatctgccatcccttccagcccactgccaataaacagctatttaaggggga

SEQ ID NO: 729839 - DNA, 2677 bp, Homo sapiens; identical to SEQ ID NO: 172361

SEQ ID NO: 729840 - DNA, 1174 bp, Homo sapiens
cttctgggccaccgggaggcggtgaagtgtaggctgggcgtggggggctccgaccccgggggccatccgggggacctggcgcccaactctgacccagtggagggagccactctgctgcccggggaggacatcaccacagtgggctctactccggcctcgctggcggtgagcgccaaagacccggacaagcagcccgggccccagggcggcccgaaccccagccaagccggccagcagcagggccaacagaagcagaagcgccaccggacgcgcttcacccccgcacagctcaacgagttggagaggagcttcgccaagactcactaccccgacatctttatgcgtgaggagctggcactgcgtatcgggctgaccgagtcccgagtgcaggctgcctgtgcgttcctgtatcgagttatctccttctctacccggaaactggtccccatcgccatcccccaatggacacgcaaggcccgtctccggccagtatagcgacatcccggaagaagctcctcaaaatcgaagcccggcgttgtcgggctacagggttcgcctcctccgcctgagaaggcaacctcagcgcccccccgggcggcccagccgagcgcacacctcaactcctgctcgcattattgacaaatattaccccctaatgagtttgtgttaagcgtttggataaaaggaggaatgcaacaattatacagaaaacaagagaaaagagcaaataaggcgaatgagcgccttttaaaaaagtgctacacccaggtttcacggcgtggctttattaccttaagtatcaccctccctctgcactcaggcgaaatattcctagctttgatgtttgcaaggggtttgaactttcgtagtctaccagtgcgctgggggcagctgacgagattcccaaagccggtgagccccgttttgttttggagtcctctaaggaagctacggtgggggaggggaaatgaaggctttctgttgtggatatcatgtctgaagaaggggcattcagaacgggaaaggttgacaggcagtagaggaaatcattgctgaccccttattctcctccaaccactctccaagctgtaaattatatataacctagaaaatcacacctataattattctgaaaattggtgaataaaagtataagcctagtgaatcccagatt

SEQ ID NO: 729841 - DNA, 624 bp, Homo sapiens
gatattgcaggcttaatccatgttgctcacaccttcatatagcagtgcctcttacagaataaactattgttaaataggaacccatcttgtcaatcagttgcttcatgcccagggaagagagtatgttttataggctttgtgtgcagcctgttaggccagcgtttaattgacatagactgttgtttctcaaacaacagttctattacgtacgtatgcaagtaatttctgtgcttcaaggagcttcagagagattgccttgttcaaagccctatggttattcaaatggtagagccaaaaatttgatctatgttctgacttaactccatgggctttggaccttggcagaggaaatggtgtctttgaactgtagtctgtagtcctagaaattgaataaactatttcctaaatagaggtaagagactaggatcctagcaacttctctaagttaacaaaaggggaaaaatatccccataccatttttctcttcattctattaatgagggctagagtcgtttcatagattgaatagtttcaagagcatattgagcagtgcctggctaacagctgaaagtctgccatttcatgcaactttgttaggctttagaagtgaagcaggaatataga

SEQ ID NO: 729842 - DNA, 585 bp, Homo sapiens
attttgtatttttagaaaaggaatggggatcacaccaaggcagaagtgcttgctgggggacagacactggcttggctgggatcaagtagcctctttctgctctccagcccagcggactggaagcagcagatcagcactcttcttcctggacaggggtaatgagaatgagtattttcctttaaagctcacttgtttccgtattctaagcggacgcgaacattgttcttttctcgtgctttcccactttcaagacccaccaacacctgcctgcccacatttcgagttatcttcgtcggctcctgcaagcccgcactcttctccgcggtggctactctccgctcatccagactcccgccctcactgcgccttcttcctgcgatgaccgaggaggtggtgggagaccaccacttgcgagcttccaaaggactttcaaacctgaaccgcagagtcagagccctcgcgccgtagaaaagtcaggagcgccccggggcccccatcggaagcttcgtgccttcccgtggaaaggtcgcgagcagggaaggccttcgtggccactgagtcccctactccaggggcggcggccgc

SEQ ID NO: 729843 - DNA, 484 bp, Homo sapiens
tctgtcctattcccaattgcatgcttttcctcttgcataggcactgatcttccaaatcaaagtgggatggtctgctggacagcctcaataccactgagtaagctattagtgccctcctggggtaaggggacccagggatctagaatccaaggtatggaggtttttcctgcccacatttcgagttatcttcgtcggctcctgcaagcccgcactcttctccgcggtggctactctccgctcatccagactcccgccctcactgcgccttcttcctgcgatgaccgaggaggtggtgggagaccaccacttgcgagcttccaaaggactttcaaacctgaaccgcagagtcagagccctcgcgccgtagaaaagtcaggagcgccccggggcccccatcggaagcttcgtgccttcccgtggaaaggtcgcgagcagggaaggccttcgtggccactgagtcccctactccaggggcggcggccgc

SEQ ID NO: 729844 - DNA, 1177 bp, Homo sapiens
ggtgcaggttttgcaaaaacaaaccattgatttggaaatcataaatatattctaaattttaatatagttacttatgttaaacataatgtgttaaagttttagcatattctttttgactaatcattagttacttatgttaaacataatatgttacatttttgacatattcttttgactaattaatcatttcctttttaaactcggagaggcaatggggggtacagagtgagacaggaaggcagcctctgtaacaacctgaggactcatggttggggaaagatgtcatctacttttagtcaagagataaatgttttacctgctaatagggaaacccacccaaaagcacagagaaaagtctggtcaaaacattgcattgcatctaataaaaactaattaactggtttaaaagcaaaagatcccttggtactgcaaaactcaatcgctttcacaataaatagataaactgctttgtgggaagaatttactaatacatggaagaacttccattagaaactacatgtttatttgatttcttaaaacgtatttaggcataatgtgtgttctaattattttcatttcttgaagaatatgtattcttatacaattcttattgttgacaattttgtggctacacttttgtcttttcttctttccttcctttctctctattatgccttctttttccccttttttcttcgtcaaaattcttaagccttctaaagtcaatcctgtcacaatgaaaatacattaaaatggctataacgtccgatccatgaacttcagtgaactctaaagactcctcaaatatacgcagatgtataggattcttacgtttctcctaatttctactagagaatctgtctcttatctcttcttccccagctgttccttctattcaccccatattaacccaagcatgaagcacagccctaatatttgttaaaaaatccaaaagcttgtgaagttttaatgaaaccctagaacttggaaagtattatatcaaactacagaaagttgaaaatttaatgtttgtctccctcttcttaaaggtcctctactcaacctttagactgacaaactcctcacggcttgcctcaatgtcttaaatgcttttcccaccgctttttttgttctacttccgattttctgtttttagcaaaccttgatgtttctggga

SEQ ID NO: 729845 - DNA, 498 bp, Homo sapiens
tagaattccagggcaagtaaaatgtaaatgagtgatgaaacaacatcactcctcacaacccgggtgatttgcaaagtcaccagggaatttcaggacacctggattacaaaaccatagcaagacttggagtccgcattagcatagtgaagtggaagctgccagctcagttaagggctatgcctagaactggcatagcaccacttctcccatgttctcgtggtcaaaggagttacaaggcccacccagatgaaaagggatggagaaatagattctacctctggatggggactggcaaagtcacattgaagagcatgtggaatgggaattgtgttgtatggtagccattttggaaaatacaatctactgcaacagatgattaaaatacttaaaaagaaattttagtgtgttatcgtctttaaacattgtacaaatttaaggtgtataatgtgatgttttgatgtatattttattaaagtgattactagtcaagcaaattaa

SEQ ID NO: 729846 - DNA, 546 bp, Homo sapiens
accacacacgtgtcctaattattccaaaggtgatacatttgcatgtttccctttaaactcctttccctctgtcactctgtggagggttcacatgctgcaatatttctgttccaagtaaagatcacaggttttgatcctcagtcctcagtatacacacctcttttagggatttctgggcttcttgactagctcaagctcttcagaggcatgcactttatcttggtgttcagtcttgactggtttaaacttttgatgtccagaaggttttcttcatgtgttgttgtgtggaattgtaaatattttctagcttttgtaaggttgtggctcatatttatatttctcctggtttgaaagaagagagagaaagaagtatgtcaaattgagactcttagattggaaatctgaatttatttacacgattgagattgatctagagttttattttttctgctgtaactgaaatttggattcaagattatatgtgttttgtgaatatgtttggtaacattgtgacttttctataatttagggaagtttgatgtagga

SEQ ID NO: 729847 - DNA, 774 bp, Homo sapiens
aagagacataagacataagagtctcattacgttgcccatgctggtatcgaactcctgggctcaagagatcctcccaccccagcctctgaattagctaggactacaggccagtgccagtacacccggctggctagaattttcttctttttaaaggctgcattgtttccattgtatttccatttgcatgtgccacattttctttatccatccaatgatggacacttaggttgattccacatcttggctattgtgaataatgctgcaatgaacatgggagtgaagatatctctttgatacactgatttcaattcctttgaatatatatgcagaagtgggattgctggataatatggtaattaaaattttagttttttgaggggcctccatactcttttccaaaatggctgtactaatttacattcccaccaacaatgttcaaggatttcatattcttgacattcttaccaaaattgtcacagtttgtaaaaggtagtctaataagtggcctaagtgaatgtgacaacacttcattgaaagcaatcttaggtttttccaactatagtcaataataacttaattgtacattctaaaataactcaaagagtgtaattggattgcttgtaacttaaaggataaatgcttgaggggatggatgcctcattctccatgatgtgcttatttcacattgcatgcctgtatcaaaacattacatttatcccataatatacacacttactatgtaccccccaaaaataaacattaaaattaagtttt

SEQ ID NO: 729848 - DNA, 1005 bp, Homo sapiens; identical to SEQ ID NO: 249068

SEQ ID NO: 729849 - DNA, 871 bp, Homo sapiens; identical to SEQ ID NO: 248300

SEQ ID NO: 729850 - DNA, 580 bp, Homo sapiens
cattttatgcctgatattcctgcattctgtgggaggttattctttgcattgtaggatattaatagtatctttaggctataccaccacataccagtagcatcaccacctaatcattataattcaaaatgtctccagacactgacaagtgttctatggaaacaaagtcattccttgttggaaaccacttgtaaacaaaaagtctagtaatggtggaattatacagtgacagaaaagctcaggtttttctgattaggttgaaaaagctgctcagaaattaaatcctactgtgttcataaaaaacaaggaacccagccctgaagcaaagaactcatcagggaagttgttttctctttcaagtctatgatttcaaatgaccttaaagtggtcatctttacagtcagagaagcatatgtgtgttggggaggagaaaaaagaaggaaatgaggcagactttagaattatacctaggaaagaactgtatgtttggttataaactagatccaataaataaataaatggtttccacataactacttggcaaaggtacaataagcctattgtgagaaaaaaaaattaaggc

SEQ ID NO: 729851 - DNA, 942 bp, Homo sapiens
  misc_feature (31)..(31): n is a, c, g, or t
  misc_feature (435)..(435): n is a, c, g, or t
  misc_feature (780)..(780): n is a, c, g, or t
aggagaacaaacttacggctaggtacgaggnctgggtgtgctagagcccagctgctggcggctgctggaatatcctacctgataggattaaaaggcctagtggagctgggggctctcagtggttaaacaatgcccaacaaccaaccagctggcccttggtctcctctctttcctcctttggttaaagagcatctcagccagcttttcccaccagtggtgctgttgagatattttaaaatattgcctccgttttatcgaggagagaaataataactaaaaaatataccctttaaaaaaacctatatttctctgtctaaaaatatgggagctgagattccgttcgtggaaaaaagacaaggccaccctctcgccctcagagaggtccacctggtttgtcattgcaatgcttttcattttttttttcggtaatggttncatttcagttccgctggctattcttcctaatctatatccatagatctaaggggcaaacagatactagttaactgcccccacctctgtctccctgtcttctttagatcggtctgattgattttcaaaagtggacccaaacttagggaattctgtgattaaggggtggctggtggcaaggaggggcaggggatatggggacgtgactgggacaggttcctgccttatcattttctccctaggacattcccttgtagcccccagaattggtctgggcccaaaattgaatagaagcagaaaaacatttaggggataaccatcagggccagtagaattaagcctctccanctgttcccaaccataaaaagggtctcccagctttccatctctggccaatatgctttatcccaaaaaaaagcgataacgttcagacgtcggccattagaaatttaagggaatttccagcagcaagcatgctttgatatctggttcagactatcatcaggaaga

SEQ ID NO: 729852 - DNA, 757 bp, Homo sapiens; identical to SEQ ID NO: 250833

SEQ ID NO: 729853 - DNA, 583 bp, Homo sapiens; identical to SEQ ID NO: 250834

SEQ ID NO: 729854 - DNA, 571 bp, Homo sapiens
ccacagagaattccacatgtctccactccccgggcagtgttggcactggctaactggagaaactgtgggcacagccgcccaggcaccaccacatggcgcaatccatcgattgtgggaactgtaaaggagaaaggagaatagtctgcgaccactgagccctgcctcctcaagcagacctcacagccagcagccctggaggagcaacattaagccactgggattcccccaacttcaggcagatctggtactcagatgcagagactactacttttatcttgaagtcagtctgtgctgctctgaagcttttagatgggcaacaatgaaagtgaagacccacctttactgtgtctttcttttcaggaatgacagcagatttgtaatctcgatgttttggtagtttctcaataaagagcctaaggaaacagttcaaaatgattatgaagcaaatggtccaaatgtccataagaccctaaagctatgcaacccccttatcctgaagcccttatatgaaaggttccagaagtgcagcggagggagagctaatacacccagctgggccatgctcctttcc

SEQ ID NO: 729855 - DNA, 474 bp, Homo sapiens
ccacagagaattccacatgtctccactccccgggcagtgttggcactggctaactggagaaactgtgggcacagccgcccaggcaccaccacatggcgcaatccatcgattgtgggaactgtaaaggagaaaggagaatagtctgcgaccactgagccctgcctcctcaagcagacctcacagccagcagccctggaggagcaacattaagccactgggattcccccaacttcaggcagtgagtagggatctcattctaatggcaccaaaaaaagggctgtaaagtgtcttctccaatcttgggccacagctgtaaggagcacattacttcaagaagagaaaatagtaggctttaattattcaagttaagaaaagggcaaactactaccttaagaaaagttttcttaaaaataaccttaagaatgtaattggattgtttgtaactcaaaggataaatacttgaggggatggaaa

SEQ ID NO: 729856 - DNA, 454 bp, Homo sapiens
gatttggcctcccaaagtgctgggattataggtgtgagccactgtgtccagccaaggaggctgtttgaactgcatgattgaaaacacatttgcaaaagtagttttagggtattttttaattgcctctggtttgaactgaatggaaaaatcttggctgatttcaatgtatagatcttcaaaagaagtttaaaaggatagtaagatctgttttaaatgtgcacgtgtgtctgaaggctggttaaggaaatcataacagggtttgggaccgattagccagccgttcttcagccccaaggtcctcaaaacactcagatttgaagatgatcccgtcttgttccgtggtctcgtccgctcctccacggtcattcttttcgaacctggccgccagtatgtgccctgagagtctatttctcttgtaaatcattgtaatattcttgactttggtttaaataaa

SEQ ID NO: 729857 - DNA, 6435 bp, Homo sapiens; identical to SEQ ID NO: 205032

SEQ ID NO: 729858 - DNA, 1800 bp, Homo sapiens; identical to SEQ ID NO: 720740

SEQ ID NO: 729859 - DNA, 1883 bp, Homo sapiens
ccctttccccactgtggtgtgataagaggctgccctcacagtcacaatgctcccgggtcacagaggtgctgggccccaggccagcctctgcctgggaagttctctctgggaacatctggtgggtactacaggccctattccaggccctatggcctgtggaacctcaccacgggggggagggctgggccagacggagacatcacctgtggtgtcagccccatggatgagacagagtggatacacagacatcccaaggctgaggacctaagggttgggctcatcagctgggcaggaacctacctcacctttgaggcatgcaagaatacagtcactgcaactgcgaagagtttgggcaggagacagacctgggagatcttggtgagcaatgagcatgagacacaggccgtggtgcgactaaagagcgtgcagggcctctacctgctgtgtgagtgtgatggcaccgtgtgttatggccgcccaaggaccagccaccatgggtgctttctactgcgtttccaccggaacagcaagtggaccctccagtgcctaatctctggtcgttatttggagtccaatggcaaggacgtgttttgcacttcccacgtcctctcagcttaccacatgtggaccccccgaccagccctccatgtccacgtgatcctctacagccccatccaccgctgctatgcccgggctgaccccactatgggccgcatctgggtggacgcagcagttccctgcctggaggagtgtggcttcctgttgcatttccgagatggatgctaccacctggagacctctacacaccacttcttgtcccatgtagaccggctgttctcccaaccctcatcacagacagcttttcacatgcaagtgcggcctggagggcttgtggcactgtgtgatggagaaggaggcatgttatatccacagggcacgcatctgctcttgggcatgggctgcaaccccatgaggggtgaggagtggttcatcctacagcactgcccaacctgggtcagcctcaggtcaaagactgggcggttcatctcagtcatctacgatggtgaggtgcgtgctgcttctgagcgcttaaaccgaatgtccttgttccagtttgaatgtgacagtgagagccccactgtgcagcttcgttcagccaatggctactacctatcccagaggcgccacagggcagtaatggctgatgggcaccccctggagtctgacacgttcttccgaatgcactggaactgtggcaggatcatcctgcagtcctgcagggggcgcttcctgggcattgcacccaacagcctgctgatggccaatgtcatccttccaggcccaaatgaggaatttgggattttatttgccaatcgctccttccttgtattgcgaggtcgttatggctatgtgggctcctcatcgggccatgacctcatacagtgcaaccaggatcagcccgaccgcattcatctactaccctgccgaccgggtatctaccacttccaggcacaggggggatccttctggtcaataacatcctttggcacctttcgcccttggggcaagtttgccctcaacttctgtatcgagcttcaggggagcaacttactcactgtactggcccccaatggcttctacatgcgagccgaccaaagtggcaccctgttggcagacagtgaagacattaccagagagtgtatctgggaattttaggtcaatgggatgtcacctaccaaaatccaaatcctccaggaaaaactactacactaaatggaccaggaacctcagagtcaagatccaagagaagaacatctgttacaacttttcctacccagtttagcaaaacacctgttttatgcaacaatacatcacaacaggcc

SEQ ID NO: 729860 - DNA, 1337 bp, Homo sapiens; identical to SEQ ID NO: 256737

SEQ ID NO: 729861 - DNA, 1092 bp, Homo sapiens
ccctttccccactgtggtgtgataagaggctgccctcacagtcacaatgctcccgggtcacagaggtgctgggccccaggccagcctctgcctgggaagttctctctgggaacatctgacctgggagatcttggtgagcaatgagcatgagacacaggccgtggtgcgactaaagagcgtgcagggcctctacctgctgtgtgagtgtgatggcaccgtgtgttatggccgcccaaggaccagccaccatgggtgctttctactgcgtttccaccggaacagcaagtggaccctccagtgcctaatctctggtcgttatttggagtccaatggcaaggacgtgttttgcacttcccacgtcctctcagcttaccacatgtggaccccccgaccagccctccatgtccacgtgatcctctacagccccatccaccgctgctatgcccgggctgaccccactatgggccgcatctgggtggacgcagcagttccctgcctggaggagtgtggcttcctgttgcatttccgagatggatgctaccacctggagacctctacacaccacttcttgtcccatgtagaccggctgttctcccaaccctcatcacagacagcttttcacatgcaagtgcggcctggagggcttgtggcactgtgtgatggagaaggaggcatgttatatccacagggcacgcatctgctcttgggcatgggctgcaaccccatgaggggtgaggagtggttcatcctacagcactgcccaacctgggtcagcctcaggtcaaagactgggcggttcatctcagtcatctacgatggtgaggtgcgtgctgcttctgagcgcttaaaccgaatgtccttgttccagtttgaatgtgacagtgagagccccactgtgcagcttcgttcagccaatggctactacctatcccaggtgagaccttggcttcctgagcaagagaaaccttaagctctgagctctccctccctagacttccttctcctttttcaaggcaaatgatgagaggatgatgtgggctgtggaggcacttgttgataaacattcattttcacccaatgggggctccttta

SEQ ID NO: 729862 - DNA, 2005 bp, Homo sapiens; identical to SEQ ID NO: 256738

SEQ ID NO: 729863 - DNA, 2250 bp, Homo sapiens; identical to SEQ ID NO: 256736

SEQ ID NO: 729864 - DNA, 2814 bp, Homo sapiens; identical to SEQ ID NO: 257114

SEQ ID NO: 729865 - DNA, 922 bp, Homo sapiens
acgtgccccgtcccgttgccccggcgaccgcggcggtttgttctcaggccccggcctttctcaccgtgcgacgccccaacccgccgctccgccgcggtggtacgctccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaacccacctgcaggaacattccattcagtatgaacgggctaaattccaggaactcctcaataagcagcctagtatgtatataatgtgagggcaggagtg

SEQ ID NO: 729866 - DNA, 1891 bp, Homo sapiens
acgtgccccgtcccgttgccccggcgaccgcggcggtttgttctcaggccccggcctttctcaccgtgcgacgccccaacccgccgctccgccgcggtggtacgctccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaacccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaaac

SEQ ID NO: 729867 - DNA, 1753 bp, Homo sapiens
acgtgccccgtcccgttgccccggcgaccgcggcggtttgttctcaggccccggcctttctcaccgtgcgacgccccaacccgccgctccgccgcggtggtacgctccaggccgcgaggcccaccgagcggacgccagtggatgacccgcggcgggggaggaggagttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaacccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaaac

SEQ ID NO: 729868 - DNA, 1751 bp, Homo sapiens
ataccatcagcaaaatgccagacgtcaaggagagtgtgcccccgaaatatcctggcgactcagagggcagagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaacccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaaac

SEQ ID NO: 729869 - DNA, 822 bp, Homo sapiens
acgtgccccgtcccgttgccccggcgaccgcggcggtttgttctcaggccccggcctttctcaccgtgcgacgccccaacccgccgctccgccgcggtggtacgctccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggcccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaaac

SEQ ID NO: 729870 - DNA, 684 bp, Homo sapiens
acgtgccccgtcccgttgccccggcgaccgcggcggtttgttctcaggccccggcctttctcaccgtgcgacgccccaacccgccgctccgccgcggtggtacgctccaggccgcgaggcccaccgagcggacgccagtggatgacccgcggcgggggaggaggagttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggcccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaaac

SEQ ID NO: 729871 - DNA, 1779 bp, Homo sapiens
acgtgccccgtcccgttgccccggcgaccgcggcggtttgttctcaggccccggcctttctcaccgtgcgacgccccaacccgccgctccgccgcggtggtacgctccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctcccttctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaacccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaaac

SEQ ID NO: 729872 - DNA, 1985 bp, Homo sapiens
acgtgccccgtcccgttgccccggcgaccgcggcggtttgttctcaggccccggcctttctcaccgtgcgacgccccaacccgccgctccgccgcggtggtacgctccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaacccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaaac

SEQ ID NO: 729873 - DNA, 1573 bp, Homo sapiens
acgtgccccgtcccgttgccccggcgaccgcggcggtttgttctcaggccccggcctttctcaccgtgcgacgccccaacccgccgctccgccgcggtggtacgctccaggccgcgaggcccaccgagcggacgccagtggatgacccgcggcgggggaggaggagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagaatgaccatagtgaaggagatctagactgaaggcttcaaggtccagagacttagctgttcccaattctgccactgactcaccctgggtattgggttctgggccacatgttatcttctgaaaatgtaggagagggatcttccaggttctgggccggatgaaaatggacatggtgaactacactatccagagccttcaacccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaaac

SEQ ID NO: 729874 - DNA, 1693 bp, Homo sapiens
acgtgccccgtcccgttgccccggcgaccgcggcggtttgttctcaggccccggcctttctcaccgtgcgacgccccaacccgccgctccgccgcggtggtacgctccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaacccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaaac

SEQ ID NO: 729875 - DNA, 1555 bp, Homo sapiens
acgtgccccgtcccgttgccccggcgaccgcggcggtttgttctcaggccccggcctttctcaccgtgcgacgccccaacccgccgctccgccgcggtggtacgctccaggccgcgaggcccaccgagcggacgccagtggatgacccgcggcgggggaggaggagttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaacccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaaac

SEQ ID NO: 729876 - DNA, 1219 bp, Homo sapiens
  misc_feature (2)..(2): n is a, c, g, or t
  misc_feature (5)..(5): n is a, c, g, or t
  misc_feature (8)..(8): n is a, c, g, or t
gncanganggcggcgcggtcgtcgtcgggggtggcggcggcagagggggcggcggccctggcggcagcggagacggcagccgtgacggtggcagcggcggcgcgggacctgggcctgggggaatgaggcggccgcggcgggccagcggcggagccgtgtagcggagaagctccccctccctgcttcccttggccgagccgggggcgcgcgcgcacgcggccgtccagagcgggctccccacccctcgactcctgcgacccgcaccgcacccccacccgggcccggaggatgatgaagctcaagtcgaaccagacccgcacctacgacggcgacggctacaagaagcgggccgcatgcctgtgtttccgcagcgagagcgaggaggaggtgctactcgtgagcagtagtcgccatccagacagatggattgtccctggaggaggcatggagcccgaggaggagccaagtgtggcagcagttcgtgaagtctgtgaggaggctggagtaaaagggacattgggaagattagttggaatttttgagaaccaggagaggaagcacaggacgtatgtctatgtgctcattgtcactgaagtgctggaagactgggaagattcagttaacattggaaggaagagggaatggtttaaaatagaagacgccataaaagtgctgcagtatcacaaacccgtgcaggcatcatattttgaaacattgaggcaaggctactcagccaacaatggcaccccagtcgtggccaccacatactcggtttctgctcagagctcgatgtcaggcatcagatgactgaagacttcctgtaagagaaatggaaattggaaactagactgaagtgcaaatcttccctctcaccctggctctttccacttctcacaggcctcctctttcaaataaggcatggtgggcagcaaagaaagggtgtattgataatgttgctgtttggtgttaagtgatggggctttttcttctgtttttattgagggtgggggttgggtgtgtaatttgtaagtacttttgtgcatgatctgtccctccctcttcccacccctgcagtcctctgaagagaggccaacagccttcccctgccttggattctgaagtgttcctgtttgtcttatcctggccctggccagacgttttctttgatttttaattttttttttttattaaaagataccagtatgagatgaaaacttcc

SEQ ID NO: 729877 - DNA, 1339 bp, Homo sapiens
  misc_feature (2)..(2): n is a, c, g, or t
  misc_feature (5)..(5): n is a, c, g, or t
  misc_feature (8)..(8): n is a, c, g, or t
gncanganggcggcgcggtcgtcgtcgggggtggcggcggcagagggggcggcggccctggcggcagcggagacggcagccgtgacggtggcagcggcggcgcgggacctgggcctgggggaatgaggcggccgcggcgggccagcggcggagccgtgtagcggagaagctccccctccctgcttcccttggccgagccgggggcgcgcgcgcacgcggccgtccagagcgggctccccacccctcgactcctgcgacccgcaccgcacccccacccgggcccggaggatgatgaagctcaagtcgaaccagacccgcacctacgacggcgacggctacaagaagcgggccgcatgcctgtgtttccgcagcgagagcgaggaggaggtgctactcgtgagcagtagtcgccatccagacagatggattgtccctggaggaggcatggagcccgaggaggagccaagtgtggcagcagttcgtgaagtctgtgaggaggctggagtaaaagggacattgggaagattagttggaatttttgagaaccaggagaggaagcacaggacgtatgtctatgtgctcattgtcactgaagtgctggaagactgggaagattcagttaacattggaaggaagagggaatggtttaaaatagaagacgccataaaagtgctgcagtatcacaaacccgtgcaggcatcatattttgaaacattgaggcaaggctactcagccaacaatggcaccccagtcgtggccaccacatactcggtttctgctcagagctcgatgtcaggcatcagatgactgaagacttcctgtaagagaaatggaaattggaaactagactgaagtgcaaatcttccctctcaccctggctctttccacttctcacaggcctcctctttcaaataaggcatggtgggcagcaaagaaagggtgtattgataatgttgctgtttggtgttaagtgatggggctttttcttctgtttttattgagggtgggggttgggtgtgtaatttgtaagtacttttgtgcatgatctgtccctccctcttcccacccctgcagtcctctgaagagaggccaacagccttcccctgccttggattctgaagtgttcctgtttgtcttatcctggccctggccagacgttttctttgatttttaattttttttttttattaaaagataccagtatgagatgaaaacttccaataatttgtcctataatgtgctgtacagttcagtagagtggtcactttcactgcagtatacatttatctacacattatatatcggacatataatatgtaaataaatgacttctagaaag

SEQ ID NO: 729878 - DNA, 384 bp, Homo sapiens; identical to SEQ ID NO: 284788

SEQ ID NO: 729879 - DNA, 2564 bp, Homo sapiens
  misc_feature (1)..(1): n is a, c, g, or t
  misc_feature (368)..(368): n is a, c, g, or t
natccctgcagtggaagtgaggaggaagaaaggtgaactccttttctcaagcacttctgctctcctctaccagaatcactcagaatgcttcccgggtgtatattcttgatgattttactcattcctcaggttaaagaaaagttcatccttggagtagagggtcaacaactggttcgtcctaaaaagcttcctctgatacagaagcgagatactggacacacccatgatgatgacatactgaaaacgtatgaagaagaattgttgtatgaaataaaactaaatagaaaaaccttagtccttcatcttctaagatccagggagttcctaggctcaaattacagtgaaacattctactccatgaaaggagnagcgttcaccaggcatcctcagatcatggatcattgtttttaccaaggatccatagtacacgaatatgattcagctgccagtatcagtacgtgtaatggtctaaggggattcttcagaataaacgaccaaagatacctcattgaaccagtgaaatactcagatgagggagaacatttggtgttcaaatataacctgagggtgccgtatggtgccaattattcctgtacagagcttaattttaccagaaaaactgttccaggggataatgaatctgaagaagactccaaaataaaaggcatccatgatgaaaagtatgttgaattgttcattgttgctgatgatactgtgtatcgcagaaatggtcatcctcacaataaactaaggaaccgaatttggggaatggtcaattttgtcaacatgatttataaaaccttaaacatccatgtgacgttggttggcattgaaatatggacacatgaagataaaatagaactatattcaaatatagaaactaccttattgcgtttttcattttggcaagaaaagatccttaaaacacggaaggattttgatcatgttgtattactcagtgggaagtggctctactcacatgtgcaaggaatttcttatccagggggtatgtgcctgccctattattccaccagtatcattaaggatcttttacctgacacaaacataattgcaaacagaatggcacatcaactggggcataaccttgggatgcagcatgacgagttcccatgcacctgtccttcaggaaaatgcgtgatggacagtgatggaagcattcctgcactgaaattcagtaaatgcagccaaaaccaataccaccagtacttgaaggattataagccaacatgcatgctcaacattccatttccttacaattttcatgatttccaattttgtggaaacaagaagttggatgagggtgaagagtgtgactgtggccctgctcaggagtgtactaatccttgctgtgatgcacacacatgtgtactgaagccaggatttacttgtgcagaaggagaatgctgtgaatcttgtcagataaaaaaagcagggtccatatgcagaccggcgaaagatgaatgtgattttcctgagatgtgcactggccactcgcctgcctgtcctaaggaccagttcagggtcaatggatttccttgcaagaactcagaaggctactgtttcatggggaaatgtccaactcgtgaggatcagtgctctgaactatttgatgatgaggcaatagagagtcatgatatctgctacaagatgaatacaaaaggaaataaatttggatactgcaaaaacaaggaaaacagatttcttccctgtgaggagaaagatgtcagatgtggaaagatctactgcactggaggggagctttcctctctccttggagaagacaagacttatcaccttaaggatccccagaagaatgctactgtcaaatgcaaaactatttttttataccatgattctacagacattggcctggtggcgtcaggaacaaaatgtggagagggaatggtgtgcaacaatggtgaatgtctaaacatggaaaaggtctatatctcaaccaattgcccctctcagtgcaatgaaaatcctgtggatggccacggactccagtgccactgtgaggaaggacaggcacctgtagcctgtgaagaaaccttacatgttaccaatatcaccatcttggttgttgtgcttgtcctggttattgtcggtatcggagttcttatactattagttcgttaccgaaaatgtatcaagttgaagcaagttcagagcccacctacagaaaccctgggagtggagaacaaaggatactttggtgatgagcagcagataaggactgagccaatcctgccagaaattcatttcctaaataaacctgcaagtaaagattcaagaggaatcgcagatcccaatcaaagtgccaagtgagcttgaagttggatatccaaaatggccgtgcaagcttaggctggggattctggatgcaacgtctttacaaccttacctagatatctgctactcacatttttggtagtgtttcaaacgttctttatccagacagacaatgtttaagagaaacaacttatttctgttaatatttaccggtagaattcacaccctctatcataaacatatgctgcaga

SEQ ID NO: 729880 - DNA, 717 bp, Homo sapiens
agtctggtttgccctcgtagctatttcctggagggaaggggtagctacagtttcctgtccctcttcagcacttctccagctccatatcgcagaaatggtcatcctcacaataaactaaggaaccgaatttggggaatggtcaattttgtcaacatgatttataaaaccttaaacatccatgtgacgttggttggcattgaaatatggacacatgaagataaaatagaactatattcaaatatagaaactaccttattgcgtttttcattttggcaagaaaagatccttaaaacacggaaggattttgatcatgttgtattactcagtgggaagtggctctactcacatgtgcaaggaatttcttatccagggggtatgtgcctgccctattattccaccagtatcattaaggatcttttacctgacacaaacataattgcaaacagaatggcacatcaactggggcataaccttgggatgcagcatgacgagttcccatgcacctgtccttcaggaaaatgcgtgatggacagtgatggaagcattcctgcactgaaattcagtaaatgcagccaaaaccaataccaccagtacttgaaggattataagccaacatgcatgctcaacattccatttccttacaattttcatgatttccaattttgtggaaacaagaagttggatgagggtgaagagtgtgactgtggccctgctcag

SEQ ID NO: 729881 - DNA, 576 bp, Homo sapiens
actcttctggtccccacagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgccccttgggcctccccccagcccctcctccccttcctgcacccgtacccccgtggtctttgaataaagtctgagtgggcggc

SEQ ID NO: 729882 - DNA, 1626 bp, Homo sapiens
ggcacgaggacgtggggtggtaccccaggcctgggtcagacagggacatggcaggggacacaggacagaggggtccccagctgccacctcacccaccgcaattcatttagtagcaggcacaggggcagctccggcacggctttctcaggcctatgccggagcctcgagggctggagagcgggaagacaggcagtgctcggggagttgcagcaggacgtcaccaggagggcgaagcggccacgggaggggggccccgggacattgcgcagcaaggaggctgcaggggctcggcctgcgggcgccggtcccacgaggcactgcggcccagggtctggtgcggagagggcccacagtggacttggtgacgctgtatgccctcaccgctcagcccctggggctggcttggcagacagtacagcatccaggggagtcaagggcatggggcgagaccagactaggcgaggcgggcggggcggagtgaatgagctctcaggagggaggatggtgcaggcaggggtgaggagcgcagcgggcggcgagcgggaggcactggcctccagagcccgtggccaaggcgggcctcgcgggcggcgacggagccgggatcggtgcctcagcgttcgggctggagacgaggccaggtctccagctggggtggacgtgcccaccagctgccgaaggccaagacgccaggtccggtggacgtgacaagcaggacatgacatggtccggtgtgacggcgaggacagaggaggcgcgtccggccttcctgaacaccttaggctggtggggctgcggcaagaagcgggtctgtttctttacttcctccacggagtcggcacactatggctgccctctgggctcccagaacccacaacatgaaagaaatggtgctacccagctcaagcctgggcctttgaatccggacacaaaaccctctagcttggaaatgaatatgctgcactttacaaccactgcactacctgactcaggaatcggctctggaaggtgaagctagaggaaccagacctcatcagcccaacatcaaagacaccatcggaacagcagcgcccgcagcacccaccccgcaccggcgactccatcttcatggccaccccctgcggcggacggttgaccaccagccaccacatcatcccagagctgagctcctccagcgggatgacgccgtccccaccacctccctcttcttctttttcatccttctgtctctttgtttctgagctttcctgtctttccttttttctgagagattcaaagcctccacgactctgtttcccccgtcccttctgaatttaatttgcactaagtcatttgcactggttggagttgtggagacggccttgagtctcagtacgagtgtgcgtgagtgtgagccaccttggcaagtgcctgtgcagggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgcccctccccaccagggcttcagcaggagccctggactcatcatcaataaacactgttacagca

SEQ ID NO: 729883 - DNA, 1886 bp, Homo sapiens
ggcacgaggacgtggggtggtaccccaggcctgggtcagacagggacatggcaggggacacaggacagaggggtccccagctgccacctcacccaccgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttttttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttttttttttttttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccttatcagaagacattggaaagagggattccctttggtgtttggtcttctacttagaaaaacctattgcagttagtttatcttgtagtattcatctttgtattctgaggataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttctgttgtgcattcaattcttattttaaataagactaagtataggcattgtacctgacattgctacgtttctaccagtgtttcaatttaaagtgctagtgtttaaaaacattttcaagggataaggccttctgtactttgcttatttgaagaatcagtggtaggagcagtgaagtaaattctatggagtacatttctaaaataccacatttctgaaatcataaataagtttattcaggttctaaccctttgctgtacacaagcagacagaaatgcatctgttacataaatgagaaaaagctattatgctgatggagcatgctttttaaatcctttaaaaacactcaccatataaacttgcatttgagcttgtgtgttcttttgttaatgtgtagagttctcctttctcgaaattgccagtgtgtacttggcttaactcaagaacagtttcttctggattccttatttgatttatttaacctaattatattctaatattgcaaatattaccataagtgggtaaaagtaaaattcctcttctg

SEQ ID NO: 729884 - DNA, 2653 bp, Homo sapiens
ctcactgcctgtataatcaggtctttattcaaaagaagctgtccaaaatgatttgacctttatggaataatcaaatttaagagtttatgcagcaggcttcttctcctctgtagtaggtttcttctctgcaggcttcttttcaggggctggtttcttggtagctgctgccttttttcccaccagaggcttcttctgcttcttaacaccaacagcagccttctttcctttcttacctaccacaggcttcttgcctgcaaccgccgccttctcatctgatttggcttgtagtgccgctgctgcagcagctgccttatccacccggagcttgtgattcctggcctggcgaagaatggtgttccggcgcatggtctttgcatatgggtttagcttcaacatgattctcaagtttttcagtgggttcttctttaggactctgcgatggatcttcttgcgtggtgctcgaagggctctttggatctctgggcttttcaagattctgctaagatctgtattaatcatcttgtgcatgggaagattgtagttactcttgagggaagcggctttacgccaagtgccgtacaattcatctaacttccggaaagcactttcagtccaaatgcagaaacgtcccacatgcccaccaggagcaagcttcaaaatgttcagcttgcttacattaagcagagtaattccagggatgtttctgaaggccttgatgataccattatcctcattatagatgatgcacgggcccctgcgctggatacggcgacggtttctcattttgcctttgccagctctcattcgctgagaggcatagacctttttgatatcattccaggctttaagtttcttaaggagcaaaacagcttccttggtcttcttgtagccttcaactttatcttcaactaccaaaggaagttcaggaacttcctcaatacgatgacctttagacatgaccagtgctggtagggctgaggcagccagggcagaacagatggcgtatcgtttttgggttgtgttcactctacgatgccaacggcgccaggttttggttggtgcaaacattcggcctccacgacacatgtttccaaaagcaccctggccagagcggtgagtcccaccacctcgaactctgggaattcgagccacagctctgccagtaccccaagactcagcactagtctgatgacctgctaattcactgacagcatagggctgtctgttgtttttgcgcaagttggtcaccaggagggcgaagcggccacgggaggggggccccgggacattgcgcagcaaggaggctgcaggggctcggcctgcgggcgccggtcccacgaggcactgcggcccagggtctggtgcggagagggcccacagtggacttggtgacgctgtatgccctcaccgctcagcccctggggctggcttggcagacagtacagcatccaggggagtcaagggcatggggcgagaccagactaggcgaggcgggcggggcggagtgaatgagctctcaggagggaggatggtgcaggcaggggtgaggagcgcagcgggcggcgagcgggaggcactggcctccagagcccgtggccaaggcgggcctcgcgggcggcgacggagccgggatcggtgcctcagcgttcgggctggagacgaggccaggtctccagctggggtggacgtgcccaccagctgccgaaggccaagacgccaggtccggtggacgtgacaagcaggacatgacatggtccggtgtgacggcgaggacagaggaggcgcgtccggccttcctgaacaccttaggctggtggggctgcggcaagaagcgggtctgtttctttacttcctccacggagtcggcacactatggctgccctctgggctcccagaacccacaacatgaaagaaatggtgctacccagctcaagcctgggcctttgaatccggacacaaaaccctctagcttggaaatgaatatgctgcactttacaaccactgcactacctgactcaggaatcggctctggaaggtgaagctagaggaaccagacctcatcagcccaacatcaaagacaccatcggaacagcagcgcccgcagcacccaccccgcaccggcgactccatcttcatggccaccccctgcggcggacggttgaccaccagccaccacatcatcccagagctgagctcctccagcgggatgacgccgtccccaccacctccctcttcttctttttcatccttctgtctctttgtttctgagctttcctgtctttccttttttctgagagattcaaagcctccacgactctgtttcccccgtcccttctgaatttaatttgcactaagtcatttgcactggttggagttgtggagacggccttgagtctcagtacgagtgtgcgtgagtgtgagccaccttggcaagtgcctgtgcagggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgcccctccccaccagggcttcagcaggagccctggactcatcatcaataaacactgttacagca

SEQ ID NO: 729885 - DNA, 2098 bp, Homo sapiens
gcaggagcacgtggagaggccgggtagccacagcggcagctccagcccggcccggcagcgacatggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgtggagaaaccctacaaatgtgagttttgtggaaggagttacaagcagagaagttcccttgaggagcacaaggagcgctgccgtacatttcttcagagcactgacccaggggacactgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgtgccccttggtccagacaccgcctgctcccacctcggagatggttccagttatcagcagcatgtatcccatagccctcacccgggctgagatgtcaaacggtgcccctcaagagctggaaaggaaaagcatcctccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactctgtcaaagtgatcgacaaggaaggggaggtgatggatgtgtatcggtgtgaccactgccgcgtcctcttcctggactatgtgatgttcacgattcacatgggctgccacggcttccgtgaccctttcgagtgtaacatgtgtggagatcgaagccatgatcggtatgaattctcgtctcacatagccagaggagaacacagaagcctgctgaagtgaatatctggtctcagggattgctcctatgtattcagcatcgtttctaaaaacagttgacctcgcctaacagattgctctcaaaacatactcagttccaaacttcttttcataccatttttagctgtgttcacaggggtagccagagaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacag

SEQ ID NO: 729886 - DNA, 1566 bp, Homo sapiens
gtgagaagcgccactgctttgatgtcaactataattcaagttacatgtatgagaaagagagtgagctcatacagacccgcatgatggaccaagccatcaataacgccatcagctatcttggcgccgaagccctgtgccccttggtccagacaccgcctgctcccacctcggagatggttccagttatcagcagcatgtatcccatagccctcacccgggctgagatgtcaaacggtgcccctcaagagctggaaaggaaaagcatcctccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactctgtcaaagtgatcgacaaggaaggggaggtgatggatgtgtatcggtgtgaccactgccgcgtcctcttcctggactatgtgatgttcacgattcacatgggctgccacggcttccgtgaccctttcgagtgtaacatgtgtggagatcgaagccatgatcggtatgaattctcgtctcacatagccagaggagaacacagaagcctgctgaagtgaatatctggtctcagggattgctcctatgtattcagcatcgtttctaaaaacagttgacctcgcctaacagattgctctcaaaacatactcagttccaaacttcttttcataccatttttagctgtgttcacaggggtagccagagaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacagccataaaataagtatctgttacgagtaactgaagaccccattctccaagcatcagatccatttcctatcacaacatttttaaaaaatgtcatctgatggcacttctgcttctgtcctttaccttcccatctccagtgaaaagctgagctgctttgggctaaaccagttgtctatagaagaaaatctatgccagaagaactcatggttttaaatatagaccatcatcgaaactccagaaatttatccactgtggatgatgacatcgctttcctttggtcaaggttggcagagcaagggtataaagggggaaattgtttggcagcaccaacagaaaacaaacaagcaaaaaacagcta

SEQ ID NO: 729887 - DNA, 335 bp, Homo sapiens
ggcccagccaatgaagatgaagacataggagatgagccgtagtgtgcagactaaacactgatgcctgtagatattgcttaggcttagtgtagagaagaaatcagctctccaaggaaaacttgcaattgtaggtttagttaggagtgattctgttttgttaatttcacaaatatttgcatttcatagttgtaggttatcagcaaattttgagaatttaaggtgcttatccagtgttccaattatattaacttcacttaaaacatgatgtttgactattttccattataaaagtaatacatgtttattgtagaaagtttgtctggggtgttttctga

SEQ ID NO: 729888 - DNA, 1975 bp, Homo sapiens; identical to SEQ ID NO: 643469
  misc_feature (921)..(921): n is a, c, g, or t

SEQ ID NO: 729889 - DNA, 1996 bp, Homo sapiens; identical to SEQ ID NO: 643472
  misc_feature (921)..(921): n is a, c, g, or t

SEQ ID NO: 729890 - DNA, 1404 bp, Homo sapiens; identical to SEQ ID NO: 728415

SEQ ID NO: 729891 - DNA, 1248 bp, Homo sapiens; identical to SEQ ID NO: 258206
  misc_feature (20)..(20): n is a, c, g, or t
  misc_feature (29)..(29): n is a, c, g, or t
  misc_feature (36)..(36): n is a, c, g, or t
  misc_feature (39)..(39): n is a, c, g, or t
  misc_feature (57)..(57): n is a, c, g, or t

SEQ ID NO: 729892 - DNA, 702 bp, Homo sapiens; identical to SEQ ID NO: 262017

SEQ ID NO: 729893 - DNA, 1961 bp, Homo sapiens; identical to SEQ ID NO: 260646

SEQ ID NO: 729894 - DNA, 2068 bp, Homo sapiens
  misc_feature (864)..(864): n is a, c, g, or t
  misc_feature (882)..(882): n is a, c, g, or t
  misc_feature (957)..(957): n is a, c, g, or t
  misc_feature (1093)..(1093): n is a, c, g, or t
  misc_feature (1257)..(1258): n is a, c, g, or t
  misc_feature (1292)..(1292): n is a, c, g, or t
  misc_feature (1303)..(1304): n is a, c, g, or t
  misc_feature (1353)..(1353): n is a, c, g, or t
  misc_feature (1355)..(1355): n is a, c, g, or t
  misc_feature (1404)..(1404): n is a, c, g, or t
  misc_feature (1465)..(1465): n is a, c, g, or t
  misc_feature (1566)..(1566): n is a, c, g, or t
  misc_feature (2052)..(2052): n is a, c, g, or t
  misc_feature (2054)..(2054): n is a, c, g, or t
  misc_feature (2056)..(2056): n is a, c, g, or t
  misc_feature (2058)..(2058): n is a, c, g, or t
  misc_feature (2061)..(2062): n is a, c, g, or t
  misc_feature (2064)..(2066): n is a, c, g, or t
tggggctgcgcgtgagaaggtggcggtgtaggcacctgcgctcggggaaggctggcggcggcggccgggccatggccagagaccccctcctctgggctccctgaagtcctggggagccgtgacccatgggatcgtcgagcagccgggtgctgggccagccgaggcgagcccttgcccagcaggaacagggtgccagggccaggggctcggcccggaggccggacactggagacgatgcggcgagctacggcttctgttactgcccgggcagtcacaagcgcaagcggagcagcggggcctgccgctactgtgacccggactcgcacagggaggagcatgaggaggagggggacaagcagcagccgctcctcaacacccctgcaaggaaaaaattaaggagtacatccaaatatatttatcaaacattatttttgaatggtgaaaacagtgacattaagatttgtgctctaggagaagaatggcgattacacaaaatatatttatgtcaatctggctacttttctagtatgttcagtggttcttggaaagaatccagcatgaatattattgaactggagattcctgaccagaacattgatgtagacgcactgcaggttgcgtttggttcactgtatcgagatgatgtcttgataaaacccagtcgagttgttgccattttggcagcagcttgtatgctgcagctggatggtttaatacagcagtgtggtgagacaatgaaggaaacaattaatgtgaaaactgtatgcggttattacacatcagtagagatctatggattagattctgtaaagaaaaagtgccttgaatggcttctaaacaatttgatgactcaccagaatgttnaactttttaaagaactcngtataaatgtcatgaaacagctcattggttcctctaacttatttgtgatgcaagtggagatggatgtatacaccnctctaaaaaagtggatgttccttcaacttgtgccttcttggaatggatctttaaaacagcttttgacagaaacagatgtctggttttctaaacagagaaaagattttgaaggtatggcctttcttgaaactgaacnaggaaaaccatttgtgtcagtattcagacatttaaggttacaatatattatcagtgacctagcttctgcaagaattattgaacaagatggtatagtaccttcagaatggctgtcttctgtgtataaacagcagtggtttgctatgctgcgggcagaacaagacnntgaggtagggcctcaagaaatcaataaagaaganctagagggaannagcatgaggtgtggtagaaagcttgccaaagatggtgaatactactggngntggacgggttttaacttcggctttgacctacttgtaatttacaccaatngatacatcattttcaaacgcaatacactgaatcagccatgcagcgggtctgtcagtttacngcctcgaaggagcatagcatttagattacgcttggcttcttttgatagtagtggaaaactagtatgtagtagaacaactggctatcaaatacttatacttnaaaaggatcaggaacaagtggtgatgaacttggacagcaggtttctgaccttccctttatatatctgctgtaacttcttgtatatatcaccagaaaaaggaattgaaaataatcgccacccagaagatccagaaaactgaagatctcatcagttggaaacagtagcactttgaaaactttcaggccagctttaatttaatggccctactgatattcacatctaaggtgactaacaatgacaaaggccttatgaactgtacggacaatacagaagactattcttatcctcattgcatttctatgcatatacaaaaaaaaccattttaaagccaagaaaatatctgtcaaaccatttctgtcagtacgatgtcaactcatgcttttaattcagcatcagcagaaaatgactgtaggtaaatctcacatttatctgcacaaaatatagatttaatttttagcttaaactttgtttctacttagtagtgnancnanttnncnnncg

SEQ ID NO: 729895 - DNA, 1870 bp, Homo sapiens; identical to SEQ ID NO: 128464

SEQ ID NO: 729896 - DNA, 1107 bp, Homo sapiens; identical to SEQ ID NO: 267536
  misc_feature (729)..(729): n is a, c, g, or t

SEQ ID NO: 729897 - DNA, 8733 bp, Homo sapiens; identical to SEQ ID NO: 86623

SEQ ID NO: 729898 - DNA, 8834 bp, Homo sapiens; identical to SEQ ID NO: 86626

SEQ ID NO: 729899 - DNA, 8668 bp, Homo sapiens; identical to SEQ ID NO: 86624

SEQ ID NO: 729900 - DNA, 8535 bp, Homo sapiens
gccatgttgatttctgatccttgagcttttctgtgcttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggaaagagaagcctccggaccagaagctggttgttcgcagctctagggacaactatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccggctgatgtttgagggaacacggggtagcactgcctacctggacatcgccctggatgccctctctatccgccggggctcctgtaatcgcgtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttggggagtatccggaaacacactctcttctcaggacaacctgggcccaactggcaggctgtttctgtcaattacacagccgtgggacggatacagtttgccgtggtaggcgtttttggaaagaccccagagccagctgtggcagttgatgcaaccagcattgctccttgtggggagggttttcctcagtgtgactttgaagacaacgcccatcccttctgtgactgggtccagacttccggggatggtggacactgggccctcggacataaaaatggacccgtccatggcatgggccctgcgggaggtttccctaatgcagggggtcactatatctaccttgaggctgacgagttctcccaggcaggccagtcagtcagactggtgagccggcccttctgcgccccaggtgacatctgcgtggagttcgcataccacatgtatggccttggggagggtactatgctcgaactcctcctgggaagtcctgcggggagtcccccgattcctctctggaaacgcgtggggtctcagcgcccttactggcagaacacctccgtcaccgtcccctcaggacaccaacagcccatgcagcttattttcaagggcatccagggaagcaacacggcctctgtggttgctatgggtttcatcttgatcaatcctgggacttgtccagtaaaagtgctaccagagcttcctcccgtatctccagtttcttccactggcccttctgaaaccactggcctcacagaaaaccctacaatctccaccaagaaacctacagtttccatagaaaaacccagtgtcaccacagaaaagcccacagtccccaaagaaaagcccaccattcccacagaaaaacccaccatctccacagaaaaacccaccattccttcagaaaaacccaacatgccctcagaaaaacccaccattccctcagaaaaacccaccatcctcacagaaaaacccaccattccctcagaaaaacccaccattccctcagaaaaacccaccatttccacagaaaaacccaccgtccccacagaagagcccaccacccccactgaggagaccaccacctccatggaagagcctgtcatccctacagaaaaacccagcatccctacagaaaaacccagcatccccacggaaaaacccaccatctccatggaagagactatcatctccacagaaaaacccaccatctccccagaaaaacccaccatccccacagaaaaacccaccatccccacagaaaaatccaccatctccccagaaaaacccaccacccccacagaaaaacccaccatccccacagaaaaacccaccatctccccagaaaaacccaccacccccacagaaaaacccaccatctccccagaaaaactcaccatccccacagaaaaacccaccatccccacagaaaaacccaccattcccacagaaaaacccaccatctccacagaagagcccaccacccccactgaggagaccaccatctccacagaaaaacccagcatccccatggaaaaacccactctccccactgaagaaaccaccacctctgttgaagagactaccatctctacagaaaaactcaccatccccatggaaaaacccaccatctccacagaaaaacccaccatccccacagaaaaacccaccatctccccagaaaaactcaccatccccacggaaaaactcaccatccccacggaaaaacccaccatccccattgaagagactaccatctccacagaaaaactcaccatccccacagaaaaacccaccatctccccagaaaaacccaccatctccacggaaaaacccaccatccccacggaaaaacccaccatccccactgaagagactaccatctccacagaaaaactcaccatccccacagaaaaacccaccatctccccagaaaaactcaccatccccacagaaaaacccaccatctccacggaaaaacccaccatccccacggaaaaacttaccatccccacggaaaaacccaccatccccacagaaaaacccaccattcccacagagaagctcacagccctgaggccaccccatcccagccccacagccactgggctggcagccttggtgatgtctccacatgctccaagtacccctatgaccagtgtgattctgggcactaccacaacctccagatccagtacagagcgctgccctccaaatgcccgctacgaatcctgtgcttgtcctgcttcgtgcaagagccccaggcctagctgtgggcccctctgtcgggagggctgtgtctgcaaccctggctttttgtttagtgacaaccactgcatccaggcctcttcctgcaattgcttctacaacaacgactactatgagcctggggcagagtggttcagccccaactgcacagaacattgccgctgctggcccggcagtcgggtcgagtgccagatctctcagtgtgggacacacaccgtgtgccagcttaagaatggccagtatggatgccacccctacgcaggcactgccacctgcttggtctacggagaccctcattatgtcacctttgacgggaggcactttggcttcatgggcaagtgcacttacatcttggcccagccctgtggcaactcaacagacccattcttcagggtgacagccaagaatgaggagcagggacaggaaggcgtgtcctgcctgagcaaagtctacgtgaccctgcccgagagcaccgtcaccctgcttaagggcagacgcactctggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgtcagaagtaccaggtggtgaattccccgtcttgtgattcatctctgcagagcagcatgtcggggccagggttctgtggacggctggtcgacactcatggcccatttgagacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgcccaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatgctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtgggaactacaacaacaacagcttggatgacaacctgcgccccgacagaaagcttgcaggcgattccatgcagctgggggccgcctggaagttacctgaatcctctgaacctggctgtttccttgtgggtggcaagccctccagctgccaggagaacagcatggcagacgcctggaacaagaactgtgcgatcttaataaaccctcagggacccttctctcaatgtcaccaggtggtgcctccccagtccagctttgccagttgcgtgcatggtcagtgtgggaccaagggcgacaccacagccctgtgccgctccctgcaggcctacgcgtccctgtgtgcccaggctggccaggcccctgcctggcggaacagaaccttctgccctatgaggtgcccacctggcagcagctacagcccctgcagcagcccctgcccagacacctgcagcagcataaacaacccgagggactgccccaaagcactgccctgtgctgagagctgtgaatgtcagaaaggccacatcttgagtggaacctcctgcgtgccccttggccagtgtggctgcactgacccagcgggctcctaccacccggtcggggagcgctggtacacagagaacacctgcaccaggctctgcacctgctccgtccacaacaacatcacctgcttccagagcacctgcaaacccaaccagatatgctgggccctggatgggctgctccgttgtcgggcctcaggtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctaatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtctgcggcatgtgtgggaacttcaatgatgaggaagaggacgaactaatgatgcccagcgatgaagtagcaaatagtgacagtgaatttgtgaacagttggaaagataaggacattgacccaagttgtcagagtctcctggtagatgagcagcagattccagcggaacagcaggagaacccgagtggaaactgcagggcggccgacctccgcagggcgcgggaaaagtgcgaggcagcgctccgggctcctgtgtgggcccagtgcgcctcccgcatagacctcacgcccttcctggtggactgtgcaaacaccctctgtgagttcggaggtctctaccaggccctctgccaggctctgcaagccttcggggccacctgccagagccaggggctcaagcccccactctggagaaacagcagcttctgccctctggaatgccctgcctacagcagctacaccaactgccttccctcctgctcaccctcctgctgggacctggatggccggtgtgagggcgccaaagtcccctctgcctgcgctgagggctgcatttgtcagcccggctatgtgctgagtgaagacaagtgtgtccccagaagtcagtgtggctgcaaggatgcccatggtggctccatccctctgggcaagagctgggtctccagcggttgcacggagaagtgtgtctgcacgggaggagccattcagtgcggggacttccgatgcccctctgggtcccactgccagctcacttccgacaacagcaacagcaattgtgtctcagacaagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtcaacaaccagaagatggccgtcccctacaggccaaatgaacacctgcgggtcaccctgtggggccaacggctctacctggtcaccgactttgagctggtcgtcagctttggtggaaggaaaaatgcagtgatctccctacccagcatgtacgaggggcttgtgagtggcctgtgcggaaactacgacaagaaccgcaagaatgacatgatgctgcccagtggcgccctgacccagaacctcaacacctttggcaacagctgggaggtgaagaccgaggacgcactcctgcgcttccccagggctataccagcggaggaggagggacaaggggcggagctgggcctccgcacgggcctccaagtgtccgaatgtagcccggagcagctggcgagcaacagcacccaggcctgtagggtgctggcagacccccagggcccctttgctgcctgtcaccagacggtggccccagagcccttccaagagcactgcgtgctggatctgtgctctgctcaggacccaagagagcaagaggagctgcgttgccaggtcctcagtgggtacgccatcctctgccaggaggcgggcgctgccctggctggctggcgggaccgcaccctctgcagctgggcagcagctttctgactgaggactgctctcagcggtgcacctgtgccagctcacggatcctgctgtgtgagcccttcagctgcagagcgggggaggtctgcaccctggggaaccacacccaaggctgctttccagaaagcccgtgtctgcagaacccctgtcagaatgacgggcagtgtcgggagcagggagccaccttcacctgcgagtgtgaagttggttacgggggaggcctgtgtatggagcctcgagatgcgccacctcccagaaagccagcatctaacctggtggccgtcctactgggactgctggtgcctgtggtggtcgtactactggccgtgaccagagagtgcatttacagaacgaggaggaagagagagaaaacgcaggagggagacagactggccaggctggtggacacagatactgttctggactgtgcctgttaagttgctcagttttgagctgtcttcagacaagaagattaaataaatttatatatttatttatttg

SEQ ID NO: 729901 - DNA, 8470 bp, Homo sapiens
gccatgttgatttctgatccttgagcttttctgtgcttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggaaagagaagcctccggaccagaagctggttgttcgcagctctagggacaactatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccggctgatgtttgagggaacacggggtagcactgcctacctggacatcgccctggatgccctctctatccgccggggctcctgtaatcgcgtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttggggagtatccggaaacacactctcttctcaggacaacctgggcccaactggcaggctgtttctgtcaattacacagccgtgggacggatacagtttgccgtggtaggcgtttttggaaagaccccagagccagctgtggcagttgatgcaaccagcattgctccttgtggggagggttttcctcagtgtgactttgaagacaacgcccatcccttctgtgactgggtccagacttccggggatggtggacactgggccctcggacataaaaatggacccgtccatggcatgggccctgcgggaggtttccctaatgcagggggtcactatatctaccttgaggctgacgagttctcccaggcaggccagtcagtcagactggtgagccggcccttctgcgccccaggtgacatctgcgtggagttcgcataccacatgtatggccttggggagggtactatgctcgaactcctcctgggaagtcctgcggggagtcccccgattcctctctggaaacgcgtggggtctcagcgcccttactggcagaacacctccgtcaccgtcccctcaggacaccaacagcccatgcagcttattttcaagggcatccagggaagcaacacggcctctgtggttgctatgggtttcatcttgatcaatcctgggacttgtccagtaaaagtgctaccagagcttcctcccgtatctccagtttcttccactggcccttctgaaaccactggcctcacagaaaaccctacaatctccaccaagaaacctacagtttccatagaaaaacccagtgtcaccacagaaaagcccacagtccccaaagaaaagcccaccattcccacagaaaaacccaccatctccacagaaaaacccaccattccttcagaaaaacccaacatgccctcagaaaaacccaccattccctcagaaaaacccaccatcctcacagaaaaacccaccattccctcagaaaaacccaccattccctcagaaaaacccaccatttccacagaaaaacccaccgtccccacagaagagcccaccacccccactgaggagaccaccacctccatggaagagcctgtcatccctacagaaaaacccagcatccctacagaaaaacccagcatccccacggaaaaacccaccatctccatggaagagactatcatctccacagaaaaacccaccatctccccagaaaaacccaccatccccacagaaaaacccaccatccccacagaaaaatccaccatctccccagaaaaacccaccacccccacagaaaaacccaccatccccacagaaaaacccaccatctccccagaaaaacccaccacccccacagaaaaacccaccatctccccagaaaaactcaccatccccacagaaaaacccaccatccccacagaaaaacccaccattcccacagaaaaacccaccatctccacagaagagcccaccacccccactgaggagaccaccatctccacagaaaaacccagcatccccatggaaaaacccactctccccactgaagaaaccaccacctctgttgaagagactaccatctctacagaaaaactcaccatccccatggaaaaacccaccatctccacagaaaaacccaccatccccacagaaaaacccaccatctccccagaaaaactcaccatccccacggaaaaactcaccatccccacggaaaaacccaccatccccattgaagagactaccatctccacagaaaaactcaccatccccacagaaaaacccaccatctccccagaaaaacccaccatctccacggaaaaacccaccatccccacggaaaaacccaccatccccactgaagagactaccatctccacagaaaaactcaccatccccacagaaaaacccaccatctccccagaaaaactcaccatccccacagaaaaacccaccatctccacggaaaaacccaccatccccacggaaaaacttaccatccccacggaaaaacccaccatccccacagaaaaacccaccattcccacagagaagctcacagccctgaggccaccccatcccagccccacagccactgggctggcagccttggtgatgtctccacatgctccaagtacccctatgaccagtgtgattctgggcactaccacaacctccagatccagtacagagcgctgccctccaaatgcccgctacgaatcctgtgcttgtcctgcttcgtgcaagagccccaggcctagctgtgggcccctctgtcgggagggctgtgtctgcaaccctggctttttgtttagtgacaaccactgcatccaggcctcttcctgcaattgcttctacaacaacgactactatgagcctggggcagagtggttcagccccaactgcacagaacattgccgctgctggcccggcagtcgggtcgagtgccagatctctcagtgtgggacacacaccgtgtgccagcttaagaatggccagtatggatgccacccctacgcaggcactgccacctgcttggtctacggagaccctcattatgtcacctttgacgggaggcactttggcttcatgggcaagtgcacttacatcttggcccagccctgtggcaactcaacagacccattcttcagggtgacagccaagaatgaggagcagggacaggaaggcgtgtcctgcctgagcaaagtctacgtgaccctgcccgagagcaccgtcaccctgcttaagggcagacgcactctggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgtcagaagtaccaggtggtgaattccccgtcttgtgattcatctctgcagagcagcatgtcggggccagggttctgtggacggctggtcgacactcatggcccatttgagacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgcccaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatgctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtgggaactacaacaacaacagcttggatgacaacctgcgccccgacagaaagcttgcaggcgattccatgcagctgggggccgcctggaagttacctgaatcctctgaacctggctgtttccttgtgggtggcaagccctccagctgccaggagaacagcatggcagacgcctggaacaagaactgtgcgatcttaataaaccctcagggacccttctctcaatgtcaccaggtggtgcctccccagtccagctttgccagttgcgtgcatggtcagtgtgggaccaagggcgacaccacagccctgtgccgctccctgcaggcctacgcgtccctgtgtgcccaggctggccaggcccctgcctggcggaacagaaccttctgccctatgaggtgcccacctggcagcagctacagcccctgcagcagcccctgcccagacacctgcagcagcataaacaacccgagggactgccccaaagcactgccctgtgctgagagctgtgaatgtcagaaaggccacatcttgagtggaacctcctgcgtgccccttggccagtgtggctgcactgacccagcgggctcctaccacccggtcggggagcgctggtacacagagaacacctgcaccaggctctgcacctgctccgtccacaacaacatcacctgcttccagagcacctgcaaacccaaccagatatgctgggccctggatgggctgctccgttgtcgggcctcaggtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctaatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtctgcggcatgtgtgggaacttcaatgatgaggaagaggacgaactaatgatgcccagcgatgaagtagcaaatagtgacagtgaatttgtgaacagttggaaagataaggacattgacccaagttgtcagagtctcctggtagatgagcagcagattccagcggaacagcaggagaacccgagtggaaactgcagggcggccgacctccgcagggcgcgggaaaagtgcgaggcagcgctccgggctcctgtgtgggcccagtgcgcctcccgcatagacctcacgcccttcctggtggactgtgcaaacaccctctgtgagttcggaggtctctaccaggccctctgccaggctctgcaagccttcggggccacctgccagagccaggggctcaagcccccactctggagaaacagcagcttctgccctctggaatgccctgcctacagcagctacaccaactgccttccctcctgctcaccctcctgctgggacctggatggccggtgtgagggcgccaaagtcccctctgcctgcgctgagggctgcatttgtcagcccggctatgtgctgagtgaagacaagtgtgtccccagaagtcagtgtggctgcaaggatgcccatggtggctccatccctctgggcaagagctgggtctccagcggttgcacggagaagtgtgtctgcacgggaggagccattcagtgcggggacttccgatgcccctctgggtcccactgccagctcacttccgacaacagcaacagcaattgtgtctcagacaagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtcaacaaccagaagatggccgtcccctacaggccaaatgaacacctgcgggtcaccctgtggggccaacggctctacctggtcaccgactttgagctggtcgtcagctttggtggaaggaaaaatgcagtgatctccctacccagcatgtacgaggggcttgtgagtggcctgtgcggaaactacgacaagaaccgcaagaatgacatgatgctgcccagtggcgccctgacccagaacctcaacacctttggcaacagctgggaggtgaagaccgaggacgcactcctgcgcttccccagggctataccagcggaggaggagggacaaggggcggagctgggcctccgcacgggcctccaagtgtccgaatgtagcccggagcagctggcgagcaacagcacccaggcctgtagggtgctggcagacccccagggcccctttgctgcctgtcaccagacggtggccccagagcccttccaagagcactgcgtgctggatctgtgctctgctcaggacccaagagagcaagaggagctgcgttgccaggtcctcagtgagctgggcagcagctttctgactgaggactgctctcagcggtgcacctgtgccagctcacggatcctgctgtgtgagcccttcagctgcagagcgggggaggtctgcaccctggggaaccacacccaaggctgctttccagaaagcccgtgtctgcagaacccctgtcagaatgacgggcagtgtcgggagcagggagccaccttcacctgcgagtgtgaagttggttacgggggaggcctgtgtatggagcctcgagatgcgccacctcccagaaagccagcatctaacctggtggccgtcctactgggactgctggtgcctgtggtggtcgtactactggccgtgaccagagagtgcatttacagaacgaggaggaagagagagaaaacgcaggagggagacagactggccaggctggtggacacagatactgttctggactgtgcctgttaagttgctcagttttgagctgtcttcagacaagaagattaaataaatttatatatttatttatttg

SEQ ID NO: 729902 - DNA, 8395 bp, Homo sapiens; identical to SEQ ID NO: 86628

SEQ ID NO: 729903 - DNA, 474 bp, Homo sapiens
agtcctaccagaagacacaaagatgatgcatccggatgaagaatatatcactgagattaatggccctgggttgcagccaaaagcatctcagagggtatgatgcatttcctgactgtggtcggctttccatgggtgaaacagaaaagtcttcaaatatcctcaccaactgctttcctagatttttcagccagttacttgaccatattaggaaaagaaaggtgagcttgggcttcaggacatagaaaacaacattagttatgctggaaagtatcaccaaagaagtgcagctcagacaagctgtattctattttgttcttttgaacataaacacctataaagggaccaaaagaaatctaaatgatcaacgggagcaatcctgaataggcaacaacaatcattattgccaagtgattgtcttatcatttgtcatcagtttttttttcagagtaattacatttaaatgtaaatgtgtct

SEQ ID NO: 729904 - DNA, 513 bp, Homo sapiens
agtcctaccagaagacacaaagatgatgcatccggatgaagaatatatcactgagattaatggccctgggttgcagccaaaagcatctcagaggtagaacactgttgcagatggtgatgttaccatttgaaaggtatgatgcatttcctgactgtggtcggctttccatgggtgaaacagaaaagtcttcaaatatcctcaccaactgctttcctagatttttcagccagttacttgaccatattaggaaaagaaaggtgagcttgggcttcaggacatagaaaacaacattagttatgctggaaagtatcaccaaagaagtgcagctcagacaagctgtattctattttgttcttttgaacataaacacctataaagggaccaaaagaaatctaaatgatcaacgggagcaatcctgaataggcaacaacaatcattattgccaagtgattgtcttatcatttgtcatcagtttttttttcagagtaattacatttaaatgtaaatgtgtct

SEQ ID NO: 729905 - DNA, 543 bp, Homo sapiens
gatgctgatctcgtttcgttatttttctgacttaaacggttaaatctaaacgcgattactaagaaaaaaaattttatacctatcattgtacacagaaaaaaaatagaaaaatgtttatataagcgtaaagctggtaggacaggaaaggaagccgaaacaaaaagtaaagaaaaatccacaaggacaacttttggagctagtgcctgagattttggatttctgagtcccaggaggtgctgatatcatttatctgcggactcgtattatgaagcgcaaggtcctagagcgtgtgattttacaggcataaggaatataagatgaaggctgagacaaaataggatgggtggcctaattttcttcccccaccctctcgtccctcccatacacatacaacctgacaactaaaagggccgcactccatggaagaactcctgcagagttggactccccaccggcaaacaggaggaggctatgaagaaacttgcctgtctccgattttcttgggaattgaaaaaataaaatttttaagcctttcatgaaaat

SEQ ID NO: 729906 - DNA, 883 bp, Homo sapiens
cggtgaatgattcagctccaaaatcccatttgattgcctgctctttccagacacaactgcagcaaactggattgtctagacacagatgatgagacagagtttagggtgcaagaagctaactagggatcaacacctgtgtaaggaagcaggtggaagcacaattgaagttgagaaagatgaagaggttgaactgccctgcaggccagatagagccttgccaaaccagtggggaactcggaggaagtcctgcctgccagtttcccatgtggagccgaaacagtcgtgcttttatctctccaccttgctcagtcaccagatgcaggccacgcccagaagggtatgtttttctctgcagctcagactgatgttgaggagctgggagctggaagccacctgctgactgcactccctgcagctggtcagcccatccttctcgaggggcatctgaatggcatcttcatcaggtctacaattttatgtacatgccacattctgggctttcccactttgaagcaattatcagttatgaatgttaggaacactttgtacaagttttaccgtgaccaaatgctttcatttctcttgggtaaatatctaggaatggaattgctgggtcatgagacacaaacacaacacgtaagcctaggcctatatgggagcaggatcatccacgtcactgtctttcacctccacatcttgtcctactaaaaagtctgcaggggtaataacacacacggagccgtcatctcctatgataccaacaccttgttctggggtactcccttcagggacctgcttggctgttccacaattaactttttttttttaataagtagagagtacactctaaaataacaataaaaatatagtaaatacaaaaaaa

SEQ ID NO: 729907 - DNA, 728 bp, Homo sapiens
cgcatgatgaggcggttccacgccagtctgaaacccgaaggggatgtggggctgtcgccgtacctggcgggatggagggcactcgtcgagttcctgactcccctcggctccgtcttcgccttcgccactgctccagctggcctaagacggcggctgcggggaccggcgggaacggagcggaccgcccggggtggggccgcgcagcccggggtcagtcctgcagcccgcgccgcggccgcctccgtatcccgcctcttccgtgacgtcgccgcggcgagggccgcccccggcagggaatggcgttgagctccctctgtccgcagtctcggaaagacgggaggagctgtgaggaataaaaaagcaatatttggcagcgtcgacgtagggcgttttgtgtgatgacgacaggcgcttaagggaaataaaaaacgaaggtgagaagatgtgtcatctctgttctcggcagccgagagactcacgctcccccggcctatcgtagtcactcccgtggcttcggttgccaaacacacgctgagtctccagcccagacttgtccctgagcttcacccctgtgcagccaagtatacagcaagcatcctgcacactccacagacgctgcaaatgcaacgcgtccaacacgggtcccaccaccatccccctaagaactacacctcctcctgtgttccctgtctctgtgaataaatggcaccctcacccttcagctaccc

SEQ ID NO: 729908 - DNA, 1210 bp, Homo sapiens
cgcatgatgaggcggttccacgccagtctgaaacccgaaggggatgtggggctgtcgccgtacctggcgggatggagggcactcgtcgagttcctgactcccctcggctccgtcttcgccttcgccactagggaggccttcaccaaggtgacagacctggaggctcgggtgcacggcccggacgcggagcactactggtcgctggcggccatggcggcgtgggagcggagggcgggactgctggagcagccgggggcggccccccgggacccgacccggagctcgggctctcgcacgctgctcctgctgcaccgcgcgctgcgctggtcccagctctgcctccaccgggtggcgaccggcgcgctgggaggcccggaagcgggcgtgcagtgcagcgacgcctaccgtgcggccctgggtccgcatcacccctggctggtccgacagaccgcccgcctcgccttcctcgccttcccgggtcgccgccgcctgctggagctggcgtgtcccggagccaccgaggcggaggcgcgggccgcgctgctccgggccgccggcaccttggaggatgtctacaaccgcacccagagcctgctggccgagcgcggcctgctccagctggcctaagacggcggctgcggggaccggcgggaacggagcggaccgcccggggtggggccgcgcagcccggggtcagtcctgcagcccgcgccgcggccgcctccgtatcccgcctcttccgtgacgtcgccgcggcgagggccgcccccggcagggaatggcgttgagctccctctgtccgcagtctcggaaagacgggaggagctgtgaggaataaaaaagcaatatttggcagcgtcgacgtagggcgttttgtgtgatgacgacaggcgcttaagggaaataaaaaacgaaggtgagaagatgtgtcatctctgttctcggcagccgagagactcacgctcccccggcctatcgtagtcactcccgtggcttcggttgccaaacacacgctgagtctccagcccagacttgtccctgagcttcacccctgtgcagccaagtatacagcaagcatcctgcacactccacagacgctgcaaatgcaacgcgtccaacacgggtcccaccaccatccccctaagaactacacctcctcctgtgttccctgtctctgtgaataaatggcaccctcacccttcagctaccc

SEQ ID NO: 729909 - DNA, 476 bp, Homo sapiens; identical to SEQ ID NO: 728419

SEQ ID NO: 729910 - DNA, 2584 bp, Homo sapiens; identical to SEQ ID NO: 466048

SEQ ID NO: 729911 - DNA, 930 bp, Homo sapiens
  misc_feature (1)..(1): n is a, c, g, or t
ntatgaagaaaatggtgtacatgttaacttaaatggtttcattatttctcttcaggatttttaagatgtgggatcagaatatatgttactattttgagaattagaaataataagaaaaacagaatgtatacattaaaagtcatgcctaaatttccaaagagtagtttttttaatgccagagtttaaataaaatattattttccagagagtaacttttctaaaggtcctaaattctgaaaagagagaaaactactgttataaacaagtttattactaaaagatgcaattcattactatgatttattattattttgtacatgtaaaccttgataaataaacagcatctcaacccaagtttattactcattgcacagttcaaagcaactatgactctcaaaatagcaacagaaggtggggagggtcttttccctttgtttatatagtatttgctaaaaatgaactttactattttgtggctttatagggttacaccatttcattctaaagagaaacaaaaagtaaaccattggccatgtggctttcaaacagtatttcaaagagaatattactgaaatatttttgtgctgttacagtcttaatcaaacattattacaaagatcagatacggaaaaaatagaggagtctccccttaattgttccctttgaaataaattgttttaaattattacagaagttatagctgtatgtacatgcacatttgtatatttacaagtctcatgtacttaatctcaatattgcaaattagctaggtttactatagagttaactgcttttatctagcatttataatcttgtagtataacctattttcaaataactaaaatttaattgatgtcatcaatggtacacatgaaaatgatacaaatttataaactaataaaatgtaactcgtcattgatagtaccatta

SEQ ID NO: 729912 - DNA, 727 bp, Homo sapiens
ttcctatggtcaggtgctgtgctgtgtgctgagtatggaggaggtaggctgagatagatgtgacctttgctcttgcaaagctgatatactaagggttggacagatgctaaatgtgcaaagaaacccaatacttgcagatggtgctgggtactaccaaggaaagaaatagggtatatgacagagtacctggaaagggcactggccagcttttatgggcagggaggtcaaagcaaacctgtctggagatgagacaggccaggaaaatcagggcaggggccagagtagggcaaatgtggtgcctagagcctcatttttttttttagacggattctcgccctgttgcccaggctggagtgcaatggcaggatctcggcccactgcaacctctgcctcccaggttcaagcaattctcctgccccagcttcctgagtagctgggattacagtacagcctcaaatttaaggagggactcactcacaggattgtgcaaatgcaaagttggcttttgcatgaccctgggagtaggtgcctccttaaattttgcaccctcagcaactccatcacctgtcactttgctagtcccaaccctgatgggaacaaatgcagggaaggcattccagatggcgggaacagcaagtacaaaaatccagaggccagaaaggcctggtgtgtttcaggaacagaaactcggctcccatgactgaaatggagtagggaaatcctaatg

SEQ ID NO: 729913 - DNA, 543 bp, Homo sapiens
taatcacttcattttgggggtaggggtgtggattttaaaactttgaagactatgtcacactcaccttgcccctcacctctggccttgacaaccatcttgctttacaagtgaattccgccaggtttctaaagatggtcacaacacaggtgccaggaatgccttcctgggtacatggagttcccgcccacgaccacagaagacattacacaaaactgcccaaaaagtatgaaatggcaatctgacaacaacctgacttaaaagccagtaaagacatcagaaaagatgttggtgtgcagcaagaaacccttcgcagcacctcacatgggcaaaaccaaagaggtaagaccctgatcttcctaatggcagacagtgaactacgaccaccccagaaatcacataaaagcatagaaggtaatttctattcaacaaataattactggcactcacagagaaaagcatggtgggacacaaattaatcaggcaaggcactgccctcgaggcactttcagtcttggcggggagtagtggagggcagaaggaaaa

SEQ ID NO: 729914 - DNA, 1407 bp, Homo sapiens; identical to SEQ ID NO: 270120

SEQ ID NO: 729915 - DNA, 466 bp, Homo sapiens
tcttgcttcctgttcaaacagtccctctgctatggctcttcctcagtagaaacaactggcaacaaaattcaagtttatgattcattcatcagcaaacatgtgagaatcatctacaaagaaccaagaattgtggtctgttacagaagtctcggtttacttcaatttctgttctgcttctctctttggcaccatcaggaaaccctagccccgtgtctgtgaaaactccaaagcttaacattctaaccactctagggagggaggatgggaggaagagagctgagtgtgcaccaaggagcggtaagatgccagacctgtgagtgaagaagcatcttggaagtggaccctatagctccaggcacctgctgacacatagtcggaggcaaaccacccagtcaagttcaacccaaattcctgacccaaaaaatcataagcaaaataaaatatttgtttaaagccaaaaaattgt

SEQ ID NO: 729916 - DNA, 488 bp, Homo sapiens; identical to SEQ ID NO: 271165

SEQ ID NO: 729917 - DNA, 497 bp, Homo sapiens
tcttgatctgtcaccaggctgaagtgcagtggtacaatcaaagctcactgcagtctcaacctcctaggctcaaacaatcctcccacttcagcctcccaaccagctgggaccacaggttgacatcaccacacccagtccctctgctatggctcttcctcagtagaaacaactggcaacaaaattcaagtttatgattcattcatcagcaaacatgtgagaatcatctacaaagaaccaagaattgtggtgaaaactccaaagcttaacattctaaccactctagggagggaggatgggaggaagagagctgagtgtgcaccaaggagcggtaagatgccagacctgtgagtgaagaagcatcttggaagtggaccctatagctccaggcacctgctgacacatagtcggaggcaaaccacccagtcaagttcaacccaaattcctgacccaaaaaatcataagcaaaataaaatatttgtttaaagccaaaaaattgt

SEQ ID NO: 729918 - DNA, 387 bp, Homo sapiens
atccacattcattcatcatgcttggcactatgggccctttccatctgaagccccctggttttcattagttttggaatttttttttctgttcttttttattattttctctcctccatttcctctggtctttcttatggtaatgaataaatattgaactgaggtacctgaaaataccaaagtaaggaactacataacctaccagtacaatactttgttgtattttcctcctaggaagaactgcctttcctatttctttttctttaggtctgttacagaagtctcggtttacttcaatttctgttctgcttctctctttggcaccatcaggaaaccctagccccgtgtctgtaagtgtacacaaaatttgaaggtgggcgcgggcttgta

SEQ ID NO: 729919 - DNA, 419 bp, Homo sapiens
tgccgtgcgctgagtgtccgcgtcgccctcgccgcagtcgcgggcaccccgctcggcgtcggtgcctgagggaggccgcgatggcggccgaggccctggcggcggaggccgtggcgtcgcgcctggagcggcaggaggaggacatccgctggctgtggtcggaggtcgagcgcctgagggacgagcagctgaactcgccctacagctgccaggcggaggggccgtgcctcacgcgggaggtggcgcagctccgggccgagaactgcgacctgcgccaccgcctgtgcagcctgcggctgtgcctcgccgaggagcggagccgccaggccacgctggagagcgcggagctagaggcggcgcaggaggccggcgcacagcctcctcctagtcaaagccaagacaaggacatgaaaaaaaaa

SEQ ID NO: 729920 - DNA, 744 bp, Homo sapiens
cgaaaaggctgcaggagctgaaggcaaagggagagctggtggattgcagggtgtcagcccagaaacggctgagctcgctgcaaaagggggtgttcaagcctggagcccacgtggacttctactataaataagcccatgtctttggcttcctgaacctttctgcccccactttcagacacacccccagagccccgtggctccccacaccctgccatggtggcagtcctgccttacacagataaacactcatgtctactgtcctaccttcacacatagcctgctgtgatgagcttccaggtcgctggccttaccagttgtcgagagtctggatgtggcaccctggattatgaggaggcttaggagagaggttatgggtattcatgtctctatccccaggaatagaatttaagggatgggaagagcaggaaaagaagctgaaacacacaagagaagaggttgtgtctcctgctcatagctagtccatggggagagggaagagtgacctgagtcaaataggagaacgcatgcagattcgcagatggcctggtagggaggaagagcagagggtacaagtccccgctcacacagatgccccttgctgaggggagcagcagcttctgttgaactttgtgtcctcactctgatgtctacttcctccagaatccaccaccccttccccaggctgggagaaggggccgttgggtgtctatgtacatggccaaggcagatacaaataaaattaaa

SEQ ID NO: 729921 - DNA, 1742 bp, Homo sapiens
cggcggcaaaaaccggcggcggcgggagcaaaatgccgcaggggcaaaaagccgcaaaaagccgcggcggcgggggcaagaagccgcggtggcgggagcaaaaatctgcggcggcaaaaaggggcggcggcgggggcaaaaagccgcaaaaagcctcggcatctgacccatgataaaaagtcctggctctgtgcctgctacagctccatctccatctactctccagggagagctccttgccaactcacatgtccatgggggtgtggagcttcctgcagccaggatcccagtggtctgcagcgagaatcaacgaagtacaactgagagcccagagagagtaaaatcagcaaaatggcaagaatgtacagctccaaacacctgctcctccacagaaacagggaaaaacaagcagaactgtcagaaacgatgttacaagagacgagaagacctgaactctgggacagtctggggagaaaagaatccaaaaagggttgaggcagcaagggctgagctcccacgggtgccccggcccaaaggtgcaggtccaggctgttttccaggtggcattcagtgcaggttcttcaatgccactggaaggcatgaaaaacccactgtagctgctgcttcttccttttcttaagctctgaaaatgcaaacactttttcaaggttttcagatatgcccagctggttacccaggtgccccgatggggaaaggaaggaaatggtgagaatcttcagcacagcggatcacatcaccctggaagagaccagtcctgcctgcgcatagcacaagcagccgcaggctagaggcagtcatgtcaggcctcctccatacagcatctctcctgcttttttttcaaacggccctaatcacttaatttggtcatcttccctgtcacaatggggcacctggcgctatagacacttgggaaacacacagatctgggatcctacagtgtccaggtgaagacgccgggagtcagagaggaaagtcttttgaagcctccaaaaggaatgcacaggaccccacttgaagaggtggcgtgcccagtggcggatacaggccccacacatcgcagcagtaaacagggactccacggtgtccagctctccagcctggggtttctcatcacccagtgattccaaaagaaacgatctacaatggcatgactaagttccagaaacaaataaacaaaatactgagggaagcccattggtcactttgattcttcaaaggtgacaattgtccctccctgaaatcttatgagtgcatgaacagactattctaatgtaaatgaaattcacactaaaactgattgaaagatgattctgtttccaaggtactttgtattctcaaattgcatctgcttaccctggccccctcaaaatggaagagtgatgactatttgtcttcgtaacactgtggggacacagagccttaaatggaagagtgtcaaaagcaacattccataaagggctgtcacttccaattttcaagcgaggttggaaaccaaccatgatgtatgaaacactgttggccaaagtgcacaattagtaatacaaaatgaataatataaactattgtaaatatgtgtggacatcgtggcaatttggacatcaaaaacactgccaaattcagaaagaggaagctgtaaactcatggctgttaggaagcttaacttctgtgtactagaacctatcaaaattaaatttctccatgtcaatccgtccaaacaaaca

SEQ ID NO: 729922 - DNA, 663 bp, Homo sapiens
ggacatacagattctgtgaacagcattgagttttttcctttctccaatactcttctcacaagctctgcagacaagaccctgtctatatgggatgcaagaacaggtatatgtgagcagtcactttatggtcacatgcattctatcaatgatgccatttttgatcccaggggtcacatgatagcatcctgtgatgcctgtggggttacaaagctgtgggactttcggaagctgttaccaattgtgtccatcgatataggtccaagtcctggcaatgaggtgaattttgattcatcaggtcgagttttagctcaggcaagtggcaatggtgttatccatttgctagatcttaaatctggggagattcacaaattgatgggccacgaaaacgaggcacacacggttgtgttttctcacgacggggagattctcttttctggaggctctgacggcacagttcgaacgtggtcttgaccgtcagcacatcccgctgcagagggcattccctttaaggcttgaaaatgcctcctgtagtcccaaaccagcaaagaactggttaaatgtgccagcaggtaacatttacagtctgctttaaaacatgctttggacatatattttagtgctcatactgttactaataaaaaaataactttatgctcaaaaaaa

SEQ ID NO: 729923 - DNA, 620 bp, Homo sapiens
ggtatatgtgagcagtcactttatggtcacatgcattctatcaatgatgccatttttgatcccaggcacaaaggccttcatgaaatgatggtgccatgctctgggacttcccagcctccagaactggtcacatgatagcatcctgtgatgcctgtggggttacaaagctgtgggactttcggaagctgttaccaattgtgtccatcgatataggtccaagtcctggcaatgaggtgaattttgattcatcaggtcgagttttagctcaggcaagtggcaatggtgttatccatttgctagatcttaaatctggggagattcacaaattgatgggccacgaaaacgaggcacacacggttgtgttttctcacgacggggagattctcttttctggaggctctgacggcacagttcgaacgtggtcttgaccgtcagcacatcccgctgcagagggcattccctttaaggcttgaaaatgcctcctgtagtcccaaaccagcaaagaactggttaaatgtgccagcaggtaacatttacagtctgctttaaaacatgctttggacatatattttagtgctcatactgttactaataaaaaaataactttatgctcaaaaaaa

SEQ ID NO: 729924 - DNA, 949 bp, Homo sapiens
tgcgcgcaggcgtagttaagagagcgcattttgacttcgaggcaccgccgacgttactgtgtcgccatggggcgccgtccagctcgctgttaccggtattgtaagaacaagccgtacccaaaatctcgtttctgccgaggggttcctgatgccaagatccgcatctttgacctgggtagaaagaaggcaaaagtggatgagttcccactcggtggccacatggtgtctgatgaatatgagcagctgtcttctgaagccctggaggccgcccgtatttgtgccaacaaatacatggtgaaaagttgtggcagagatggctttcacatgcgagtgcggctccatcccttccatgtcatccgcatcaacaagatgttgtcctgtgctggggctgacaggctccagacaggtatgcgaggtgcctttggaaaaccccagggtactgtagcccgggtccacattggtcaagtcatcatgtccatccgcaccaagcttcagaacgaggagcatgtgattgaagccttgcgcagggccaagttcaagttccctggacgccagaagattcatatctccaagaagtggggcttcacgaagtttaatgctgacgaatttgaagacatggtggccaagaagtgcctcatccctgatggttgtggagtcaagtacgttcccagtcatggccccttggacaagtggcgggttctgcactcatgaaggttttggcagtactgtctccttgggccatgctggtctgacttatgcttactaataaattctgtttactggcaaaaaataaattttccaggggatcggcaaaggggaactcgggggggccgaccactttggccttaggagggagaaaccgccgcgggaatgcacaacgctggatggcgacgccacacaaacaaacagaaagaatatataaaaaaaaaaatatataatcaaatacatc

SEQ ID NO: 729925 - DNA, 594 bp, Homo sapiens
tggagacagataccatcggggctggcgaggggccacagcaggcagtgccctggtcagcctgggtcacgaggcatggctgggtgcgctggtgggtgagccacatgcccccgagctggatccagtggtggagcacctcgaactggcggcaaccgctgcagcgcctgctgtggggtctggaggggatactctacctgctgctggcactgatgttgtgccatgcactcttcaccactggctcccacctgctgagctccttgtggcctgtcgtggccgcggtgtggcgccacctgctaccggctctcctgctgctggtgctcagtgctctgcctgccctcctcttcacggcctccttcctgctgctcttctccacactgctgagccttgtgggcctcctcacctccatgactcacccaggcgacactcaggatttggatcaatagaagggcaaccccatcccactgcctgtgtctgttgagccctggcctagggcctgagaccccacggggagagggagggcaatgggatcagggctccctgccttggcagggcccagacccctagtccctaacaggtagactggcctgaccccggact

SEQ ID NO: 729926 - DNA, 431 bp, Homo sapiens
agaccctcgggatctccgtttacagttcaggacctcagctgcactttggcgctaacgccctgtttcccagggctgtgagggaccaaccaaatatgaagctgttgatttctccaaaataaccatcaaaagtctgatgagataaagagcacactggaaactgggaatgctttgatggaaattctgcaagtaatggacgctctggcttgccttggtgactgtcaaataaaagcaagtatatactcagttctctccacacttcccacatacttaccaagcaaaaagcccatgaaaaatctgcagcagcctctgatagcaggaagacattatgtggtactcctgaactttcactcctggtccatcaactacaccgtgattctcagcagctaaacactaaaaataaaaatgattttaggacagttgcttcagtaatt

SEQ ID NO: 729927 - DNA, 452 bp, Homo sapiens; identical to SEQ ID NO: 283930

SEQ ID NO: 729928 - DNA, 438 bp, Homo sapiens; identical to SEQ ID NO: 283931

SEQ ID NO: 729929 - DNA, 568 bp, Homo sapiens
tcatttatttcttctagggtcacaagatgctgctcatgatttggatacactgaaaaagaataagaatgttttgaatttattgaagaagcaaaaagaaaagatggagtggttcttgttcattgtaatgcaggcgtttccagggctgctgcaattgtaataggtttcctgatgaattctgaacaaacctcatttaccagtgctttttctttggtgaaaaatgcaagaccttccatatgtccaaattctggcttcatggagcagcttcgtacatatcaagagggcaaagaaagcaataagtgtgacagaatacaggagaacagttcatgagttgcattgtagcagacaatggacaactgtagtttctgaattgacttctatagccatcttttcccttttttggagagtagactagcaaaattcccttttttctcttgccttttttatgcataaatggaggtcaatttgattgtcctgacctactgtataagtaaatttcaaatgtcattactttctctttgttattataatgtgtgattaaatgcttttttaaattgctaagggaaaaaaa

SEQ ID NO: 729930 - DNA, 2699 bp, Homo sapiens
aaccagaggcgcgggtcacagagacctagaacagctggaatccttcgcccccggcgcgcagccttcgcccgccggaatcgctgccttatccaccagcgggatgcttacctcgcccgccctctcgggtcaggcgggcccgggaggatgggagggtggctgctgagcgggagccgccacgtcttccacccgacatattgcctagagtttgctgtgacttagatcttgattcagagatggagaaatcaggcccatcttctaccatctctgagcagcagctgcagaggcaagagggatggattaacaccaaaacagacttggctgagcagagtctcatttcatctgagaaatggcttcaactgcatgggcttaagagcaacaaattgaccttgaaacagattttgtcacagatcggattcccacattgtgaagcttgaagaattccctttagcatttcttataaggcaggtctggtagtgatgaactccctcggcttttgtttatctgtgaaagtctttatctctccttcatttgggaaggacagctttgattatgtggcgtctctggggagacctgtggcttctcggtatgctgatggtctgtttccacagctctacagagcagaagatggcagagtatacaatctgacagctaaatcagaactgatttatcagtttgtggaacatttaacacaagctgtggagagctacaagcagcgaatggactggctcaccagcaagagccggcagatttttggtgtcatcttggaacagtgcgtcaccatagtgctggattttggcggcattctggagggggagcttgatctgtgccgagaggctctaacaatggttctccaggagcaggtggctcacataaccgagttcaatatcatacgggtttctcaagagcctgtgaagtggcaggaaaatgctactcctgtgaccgaacagtccatagctactgccatcagttgggttgagaaactgacggttgagctgactgtgagcgaggctggccgcctggatgctctgctggaagccgggagagacaagactttactcttcttcacagatggatctgtcatctgtcacacactttccaaggtgaagtacgcgcaagctgatgactccatccatttttggatgtcaatgtattgacatgaattttgatagggacatttttggaaataaagctttacctggaagaagtgattagatggtggtgtgttatgtctctttgagccacagggtctgtgtttctgggagtgactctagtgatgggagtgttggggcagtggcaagccagtggagacacactctgggcaggcggggtcctttggccagcctggactccctgtgggaaggtctgcttgcctttggatacagttacttaacaattatgtgcttcctccactctggaagtctggggtttctgtaggtttcagactttacccagctgcatcaagaagtccattgttggagaaagaagccacgtgttggcatcttgaaagatagcccccagtggtcaccggcctgtgtttatcaatactgagggcaatggtttgtaattggaaacacattgcttttccttccaaggccaaaagaacaaatgttttccattaaagaagaaccagatacaagctagtttgttccttggtcctttgagtttgttttaacatctgtaaaatttcaagtgtctggacaccttaataagcattcaaaaaaatggaacattcccaggctcagggtgtgtgtgcatgagcctgggcacacagctgttctctttgtctatgaacctggctattgtggtcacagctgcctgtggccccctgacctgactgcaggatccgccagtgaccctgtctttctgtttcactccttctggttcgtgcctctcctttctccggggttcattcctattccaggaagtaaggaacaattcagtgagttccagggaagtcctatggaagaaaaggaatcaagaaagaagcttccaggcactgatcatcaaatgcagcctgaaagcttttgagaagagaccgtggagcagcacatgcaagccctgcacagaccgctgtgcccctctgcccacagccttgatctgggggtggtctcaaggaaaattctagcaaatgcaactgccttgcatataaaaatgccgtgtcctatgttttatgaggagttaaaaaacacatgtgtgtgtggcaggggggagtgggttcccataagtcctgcttctctgctccacacctgtcatgcccatcccagcgagttctgaattcatccagatggctgcagtttgctctgaatagaaaagatggaaggcttaaagaattttttgagcagctaatataaacacctagactgttcctactgatgacagcctgctgcaagttagcatctccctccatgagcgggtgctgagaggagccaggaaagtgggcattgtcttgtgcccacaaattaacatgcaagtcccgtttctataccaagcccacatgaggagtagggctgaaccacgtgcttggtcatggagaaggaagatgcccagagaggctcctggccccctccaggcacaggctttgtaaccaccgcgggccaggaagactgaaacaggaagcaacgagagagagccttgaggtctaagaagagcacatgcagagtgggaggtctgttgaaatgctggctcgacacatagcactg

SEQ ID NO: 729931 - DNA, 2582 bp, Homo sapiens
aaccagaggcgcgggtcacagagacctagaacagctggaatccttcgcccccggcgcgcagccttcgcccgccggaatcgctgccttatccaccagcgggatgcttacctcgcccgccctctcgggtcaggcgggcccgggaggatgggagggtggctgctgagcgggagccgccacgtcttccacccgacatattgcctagagtttgctgtgacttagatcttgattcagagatggagaaatcaggcccatcttctaccatctctgagcagcagctgcagaggcaagagggatggattaacaccaaaacagacttggctgagcagagtctcatttcatctgagaaatggcttcaactgcatgggcttaagagcaacaaattgaccttgaaacagattttgtcacagatcggattcccacattgtgaagattatgtggcgtctctggggagacctgtggcttctcggtatgctgatggtctgtttccacagctctacagagcagaagatggcagagtatacaatctgacagctaaatcagaactgatttatcagtttgtggaacatttaacacaagctgtggagagctacaagcagcgaatggactggctcaccagcaagagccggcagatttttggtgtcatcttggaacagtgcgtcaccatagtgctggattttggcggcattctggagggggagcttgatctgtgccgagaggctctaacaatggttctccaggagcaggtggctcacataaccgagttcaatatcatacgggtttctcaagagcctgtgaagtggcaggaaaatgctactcctgtgaccgaacagtccatagctactgccatcagttgggttgagaaactgacggttgagctgactgtgagcgaggctggccgcctggatgctctgctggaagccgggagagacaagactttactcttcttcacagatggatctgtcatctgtcacacactttccaaggtgaagtacgcgcaagctgatgactccatccatttttggatgtcaatgtattgacatgaattttgatagggacatttttggaaataaagctttacctggaagaagtgattagatggtggtgtgttatgtctctttgagccacagggtctgtgtttctgggagtgactctagtgatgggagtgttggggcagtggcaagccagtggagacacactctgggcaggcggggtcctttggccagcctggactccctgtgggaaggtctgcttgcctttggatacagttacttaacaattatgtgcttcctccactctggaagtctggggtttctgtaggtttcagactttacccagctgcatcaagaagtccattgttggagaaagaagccacgtgttggcatcttgaaagatagcccccagtggtcaccggcctgtgtttatcaatactgagggcaatggtttgtaattggaaacacattgcttttccttccaaggccaaaagaacaaatgttttccattaaagaagaaccagatacaagctagtttgttccttggtcctttgagtttgttttaacatctgtaaaatttcaagtgtctggacaccttaataagcattcaaaaaaatggaacattcccaggctcagggtgtgtgtgcatgagcctgggcacacagctgttctctttgtctatgaacctggctattgtggtcacagctgcctgtggccccctgacctgactgcaggatccgccagtgaccctgtctttctgtttcactccttctggttcgtgcctctcctttctccggggttcattcctattccaggaagtaaggaacaattcagtgagttccagggaagtcctatggaagaaaaggaatcaagaaagaagcttccaggcactgatcatcaaatgcagcctgaaagcttttgagaagagaccgtggagcagcacatgcaagccctgcacagaccgctgtgcccctctgcccacagccttgatctgggggtggtctcaaggaaaattctagcaaatgcaactgccttgcatataaaaatgccgtgtcctatgttttatgaggagttaaaaaacacatgtgtgtgtggcaggggggagtgggttcccataagtcctgcttctctgctccacacctgtcatgcccatcccagcgagttctgaattcatccagatggctgcagtttgctctgaatagaaaagatggaaggcttaaagaattttttgagcagctaatataaacacctagactgttcctactgatgacagcctgctgcaagttagcatctccctccatgagcgggtgctgagaggagccaggaaagtgggcattgtcttgtgcccacaaattaacatgcaagtcccgtttctataccaagcccacatgaggagtagggctgaaccacgtgcttggtcatggagaaggaagatgcccagagaggctcctggccccctccaggcacaggctttgtaaccaccgcgggccaggaagactgaaacaggaagcaacgagagagagccttgaggtctaagaagagcacatgcagagtgggaggtctgttgaaatgctggctcgacacatagcactg

SEQ ID NO: 729932 - DNA, 599 bp, Homo sapiens; identical to SEQ ID NO: 273326

SEQ ID NO: 729933 - DNA, 938 bp, Homo sapiens; identical to SEQ ID NO: 273330

SEQ ID NO: 729934 - DNA, 924 bp, Homo sapiens
agttgtccagggctccctgagggaggccagcacaagagctctgccataaaaggacattggacagaagtgaagagtccaatcagaaactctttttgagagactgaacgcaaagcattcagagagtcagcaggctggagaggccaagacacacacacgaagaaggcaggacactcttctcctcctgcggttggactccaggctctatgaccttcaaactccaggacttacaccagttgcccctgggcactcaggacttctgcttcagactgacagttgcaggacagtgcagcattttattttaaagataccccacaacgtaggtggccagtcctgctgcagggcagatacgctcccttgattctgaggtctttgaacttgctgtgaagccacactacctgcgtcccagggtctccagcttgcagatggactgtggtgggacttctcagtcaccaagattgagagctgtactagcctggcatgcagacagcagctttagaatcagatctgccttctggcggcttcccacctaggagccatgggacctttgtgaagtcaccaattgtgctgtggatgcttcatttgtgaaggagaacaggactgccttgtgaaattacggatggtgctactaaaacatatcaataatttgaatttcacttttgtggatgctttaaacatcatagtcattagaaggtggatctggctgattgtactttaagttttcagtttgagctggagctttgtattataacaggagggtactggacaaggtgagttgctgatagcctccccccacctgccaacagacctatcattagatggaatgtaatggactttggccagttgttctccaccccagctctgacttagcggctctggcaagaatggatatatgagcctaaatacagagcttgttgtgctactttt

SEQ ID NO: 729935 - DNA, 701 bp, Homo sapiens; identical to SEQ ID NO: 273332

SEQ ID NO: 729936 - DNA, 687 bp, Homo sapiens
cagttattaagtggcaaagaccggatttgaatcaagatatctgatttttaaaattcaccttgtttcaaagcattttacttcacctaagaagttaatacacctcacaaccagataactccttcttttcaattagactgtgtctgtatctgggatcagttgcgaagcagaagtatgacgtgactaaggccaccgctgggttaggatacccccatccaagattgagagctgtactagcctggcatgcagacagcagctttagaatcagatctgccttctggcggcttcccacctaggagccatgggacctttgtgaagtcaccaattgtgctgtggatgcttcatttgtgaaggagaacaggactgccttgtgaaattacggatggtgctactaaaacatatcaataatttgaatttcacttttgtggatgctttaaacatcatagtcattagaaggtggatctggctgattgtactttaagttttcagtttgagctggagctttgtattataacaggagggtactggacaaggtgagttgctgatagcctccccccacctgccaacagacctatcattagatggaatgtaatggactttggccagttgttctccaccccagctctgacttagcggctctggcaagaatggatatatgagcctaaatacagagcttgttgtgctactttt

SEQ ID NO: 729937 - DNA, 346 bp, Homo sapiens
ggacactcttctcctcctgcggttggactccaggctctatgaccttcaaactccaggacttacaccagttgcccctgggcactcaggacttctgcttcagactgacagttgcaggacagtgcagcattttattttaaagataccccacaacgtaggtggccagtcctgctgcaggtgcggtttcaagcctttggagtttgaccttctagtccaaggtcattacagctgcaggcagaggctcccgcggggaaaagagcatttcctgggacgctggaactaaatgaatggcccactctccagttcagcccttgcctccttcccgacacataaagttcaagagccacgg

SEQ ID NO: 729938 - DNA, 407 bp, Homo sapiens; identical to SEQ ID NO: 400632

SEQ ID NO: 729939 - DNA, 1976 bp, Homo sapiens
atactcaacttcccagcctcccttgcagctagtggtaatcatgtgacccacttctggccagtaagatgaaaaaaggaagttcactggactggcagagggagcttgggagggcttttgctgatgccacttgttcttcttgccataaagacggtgtctgacttccaggcaacaatgcacacagaagttacaagtgtggatactagagtcagagcctggattccaatgctgcttcttaacagctgtgtgactttccacaagtaatgcaacatctctgggtctctgtttcctgttctgcaaaatgggggtactgtctacttgccccagggacctgctgtgctgaggatcattcccaggaagcacctagcaccatgctgggtcctggcaagccactgacaaatgttcactgtcacaatggccctgcttcctctggtgctcggcaccaggctgacatcgagtacacagtcaatgaagaaacaaggagactctgcaaggagatacattaggatgatgtactgacaaagccttgggaaaactgctggtgcctttgctggggggaagatttccagatggagctcctcaggatggcctgccaatccaataaactcaggttcctagaaagggcctcccccaaccccaccccacccccactctgtaagccccacccaaaccaggacagcagcaattctccccttcccctggtgtgccttccccggtggtctgtttctttaggacaggaacgcagctgtctggaaggcacccagggaagccattccttgggacatgtcccctgacccacccccggcaaggctgggatgacagaaggacaaacccagccaaacatatggacccgtggcccaggataggcaacagctgggccactgcctgacttttcttctgctccttggaatattctggcaatgagaagacatagtctcagcaacttatagacattttcccaggaaatcctaaccgctaagggaacaatttgctccattctcacacatttcaatctacttatttggaagaccaatccttgcgtgggcatgcacgcacatgcgcgcgcgcgcgcacacacacacacacacacacacacacacacacacccttcatgtggtcttgtgtagaagtacacaaacctgataatagcaaccactaatatttagtatatgctaagtaataaaagtagctactatagtcatcatctcatatagtcctcacaacaagcattgagacaggggctctatccacatttcacagatgaggacacagaggtgggctgcctttcacagaacaagctgctagccatgctggggctggcgtcggagcccaggtctaagaactctggtacaaggaatccactccctttcccggatttgcctcctccacctgtgcttaaggagttaaccttgtcggagaggttttctttccttggttatgttttctattctttgggtaagtttgacaaagtggggttctttttcatcgccagagtctgtgtccctggaggctgaggaaggaaccagaagttgcactttccaacatggatcgcctgctaattttccaaggcagctcagcccctgccagcgtcccctccctcctttgggctgagggcccaggaacccagcctcaaagttcagcttgcttcctccagcacgcacatttggaaattgaaatttcccacattttcaccacacaaaagccaggttgtatttttgttctcttcaaaatatgccaaaggaatttttcctaccccttgaactttctccaaaaataagtagaaaaagtcaagaccattttgccctgtaagctgagaatagaaaaatcaacatgcagggtgccatttccaggatgttacgaaacagcgaacatgtgaatccgtctcaacaccatttggcaactttggggatacagtagatgatatttctcacccacaaactcctcactgagtttatattaacattttgcttttttttttt

SEQ ID NO: 729940 - DNA, 564 bp, Homo sapiens
agaggcagaggaatcctagggagggggaagtgaggcatggacaggcagagggactgcactattcaagggcatgatggagagaagtacgtgcctggatttccaatttccctaaggataattttacaccagatcttctttattttaaaaatccaatccttttccttaataaccccatctgtccctgataccaccatttttttctaccagtctctcaggctagaaattttgtggttatctttgcctcttctctccttcatcctgtaaatcctacctgttgggaatacattactgtcctttcttcaaaatgttttatctgtcttttctttttcattctctgctattaactataacttcattctcagttccactgctgcctagctttctgtgccctgctagattcatcattattcatccaacaaacataaaaggaaaaaattggcctggcgcggtggctcacgcctgtaatcccagcactttgggaggccgaggcgggcggatcatgaggtcaggagatcaagaccatcctggctaacatggtgaaaccccgtctccactaaaaataca

SEQ ID NO: 729941 - DNA, 230 bp, Homo sapiens; identical to SEQ ID NO: 728428

SEQ ID NO: 729942 - DNA, 277 bp, Homo sapiens
  misc_feature (7)..(7): n is a, c, g, or t
gaacgcncgacaacgataagaaactttttttttttttctttctttctttctttctttctttttctttctttctttctttctttctcgctctcgctctctccctccctcgctcgttttctctctctctcgctcttgccctctcgctctctccctcgctcgttttctctctctctctctctctctctctctgtctctcgctctcgccctctctctctctctgtctctctctctctctctctctctctctctctctctctctctcttctgtcgtcttctc

SEQ ID NO: 729943 - DNA, 401 bp, Homo sapiens
  misc_feature (384)..(384): n is a, c, g, or t
ctttttttttttttctttctttctttctttctttctttttctttctttctttctttctttctcgctctcgctctctccctccctcgctcgttttctctctctctcgctcttgccctctcgctctctccctcgctcgttttctctctctctctctctctctctctctgtctctcgctctcgccctctctctctctctgtctctctctctctctctctctacttctatcattaaccctttacaccttttccccccccccccccctttttttttttccctttttgggggagttaaacccacggaggatatttaaaccccccttttttattttttaaaacaccccttttttgcccccgggggggctccccccccaaaaaaaagaagcnccccccccccccccgta

SEQ ID NO: 729944 - DNA, 387 bp, Homo sapiens
  misc_feature (228)..(228): n is a, c, g, or t
  misc_feature (240)..(241): n is a, c, g, or t
  misc_feature (268)..(268): n is a, c, g, or t
ctttttttttttttctttctttctttctttctttctttttctttctttctttctttctttctcgctctcgctctctccctccctcgctcgttttctctctctctcgctcttgccctctcgctctctccctcgctcgttttctctctctctctctctctctctctctgtctctcgctctcgccctctctctctctctgtctctctctctctctctcgcagccccgtatnaagtagtaaagnntttaaaggggggggcccccgggggggnccccccccccgggccccctttttccccctttttaaaaaggagaaaaaaaaggggggggggggaaaaaaatttttttcccccccccccccaaaaaaaaaaaaggggggggcccccccttt

SEQ ID NO: 729945 - DNA, 1604 bp, Homo sapiens; identical to SEQ ID NO: 256019

SEQ ID NO: 729946 - DNA, 2742 bp, Homo sapiens; identical to SEQ ID NO: 274510

SEQ ID NO: 729947 - DNA, 1861 bp, Homo sapiens; identical to SEQ ID NO: 273960

SEQ ID NO: 729948 - DNA, 1391 bp, Homo sapiens; identical to SEQ ID NO: 411805
  misc_feature (1387)..(1387): n is a, c, g, or t

SEQ ID NO: 729949 - DNA, 1388 bp, Homo sapiens; identical to SEQ ID NO: 263138

SEQ ID NO: 729950 - DNA, 1279 bp, Homo sapiens; identical to SEQ ID NO: 275052

SEQ ID NO: 729951 - DNA, 1604 bp, Homo sapiens; identical to SEQ ID NO: 273959

SEQ ID NO: 729952 - DNA, 1799 bp, Homo sapiens; identical to SEQ ID NO: 262932

SEQ ID NO: 729953 - DNA, 1606 bp, Homo sapiens
  misc_feature (762)..(762): n is a, c, g, or t
  misc_feature (1605)..(1605): n is a, c, g, or t
gaaacccataagtctgtttattaaatctcaggctaagaatactatacacaccttcattttattttgtcataattcttgtgaggcattccttagatgggttcagtatttaattttaaaagacaaagctattaagagaaaacataatgttactgggttttttttgtcacttttcttggctctatcaaattagaagtgcttgagatgtgacatgaccaattgaaataacatttccagattttgcagacttttgtaggaccatcttggttttacccagacataagacatctgttttcataggcttaacagtcttattctcattctttattttgctcagttctacttccaaacatatgaaatgaaatgacaaatgacatgagtgctatgtaattaggagagaattattttacctcagagagatttttcatcctcatttattttatattaagcatagcacactttcaatttcattttccttcttttgaatttttatcccatctgtttaggggattttaaaaacttagtctttaaaatgacttctgataagcagtagctgacttttttaaaagaaaatgtaaccaaaaattgttactttattcctgtgaagtatattgtaaagataggacatggtataatgtattggagtgggttttggtggtgtttttgttttattctgttttcttaactgttacatgatggcatttaataaagcatctgtaacattctggattaatcttaagaagaactaactttttctttgggcancaagctactctggaaataataattttccctatgttggttatttctcatggcagccttccactgcattttctttgtttgggtactttcttttcttcctgccgttcttagctttctatttttcaacttgagtttacaaaaggatgtgtattcaaagggtttcctacagttcccagtaccttgttaatcctgagaaattacccagtgagccaattctcacagtaaggtataaaaatagtcatccagaaagattacagaatgtggtaccactgtggttttaactaatggaagacttttaaaaccaagatggggagaagaaaacagcacaaatgttactatttccttcgatttttatctgcacaatctattttaggagagccttcaaatttaaaaaagtaatagagcttcaccactgctttattggatacactcaaagatcatcataattggggacaagaaagaaatcacctgcaaataaatcacaagaacagagcctacctgtgattactattgagcatatatccacaatgttcatttaaccaattttattccacaaatttagtccagcattttattgagtgctttaataagttctggtgtgtgaagttgggtggcttaacttctctaagtctgaatttccatattgtagaataaggaagtaattaacctttttttattttaataaactttattttcaagaacagttttagatttacagaaatactgtaaaaatagtacaaagaattcctgtatactctgttattaactctattattattaccttgtattattatggtacatttattataattaataactcaatattgagatgttgttaactaaatnc

SEQ ID NO: 729954 - DNA, 1040 bp, Homo sapiens
  misc_feature (762)..(762): n is a, c, g, or t
gaaacccataagtctgtttattaaatctcaggctaagaatactatacacaccttcattttattttgtcataattcttgtgaggcattccttagatgggttcagtatttaattttaaaagacaaagctattaagagaaaacataatgttactgggttttttttgtcacttttcttggctctatcaaattagaagtgcttgagatgtgacatgaccaattgaaataacatttccagattttgcagacttttgtaggaccatcttggttttacccagacataagacatctgttttcataggcttaacagtcttattctcattctttattttgctcagttctacttccaaacatatgaaatgaaatgacaaatgacatgagtgctatgtaattaggagagaattattttacctcagagagatttttcatcctcatttattttatattaagcatagcacactttcaatttcattttccttcttttgaatttttatcccatctgtttaggggattttaaaaacttagtctttaaaatgacttctgataagcagtagctgacttttttaaaagaaaatgtaaccaaaaattgttactttattcctgtgaagtatattgtaaagataggacatggtataatgtattggagtgggttttggtggtgtttttgttttattctgttttcttaactgttacatgatggcatttaataaagcatctgtaacattctggattaatcttaagaagaactaactttttctttgggcancaagctactctggaaataataattttccctatgttggttatttctcatggcagccttccactgcattttctttgtttgggtactttcttttcttcctgccgttcttagctttctatttttcaacttgagtttacaaaaggatgtgtattcaaagggtttcctacagttcccagtaccttgttaatcctgagaaattacccagtgagccaattctcacagtaaggtataaaaatagtcatccagaaagattacagaatgtggtaccactgtggttttaa

SEQ ID NO: 729955 - DNA, 1965 bp, Homo sapiens; identical to SEQ ID NO: 213449

SEQ ID NO: 729956 - DNA, 798 bp, Homo sapiens
aatgcgcgaggcctggacgggagtggccgaggcggttgggcggaggcggagcaggcgccatgtcagcccgggaagtggccgtgctgctgctgtggctgagctgctatggctccgccctttggaggtattccactaacagcccaaactatcgcatttttagtaccagaagtactattaagttagagtatgaaggaacattatttactgagtggagtgtgccagaaacttgttttgtgctaaataaaagctcacccacgacagaattgcgttgttcctcacctggtgttcacgctataaaaccaattgttactggcccagatgaagaagaacgctatttatttgtggaaagttctcatacttgctttctgtggtactatagagttagacatttctttaacaactttacccagcttatcactgtgtgggcatatgatccagaaagtgcagatcctgatgagttgctggggaatgcagaagaaccttcaataaattccatagtactcagcacacagatggccacattgggacagaagcctgtcatacatacagttctgaagagaaaagtttattcttcaaatgagaaaatgagaagggggacctggcgtattgtagtaccaatgacaaaagatgatgcactaaaggagattagaggaaaccaagttacttttcaggattgctttattgcagattttcttattctgttgacttttcctttgttgaccatacctgaaattcctggttatttaccaatctcctcaccacgtggtagtcaattaatggcttcctgggatgcttgtg

SEQ ID NO: 729957 - DNA, 2298 bp, Homo sapiens; identical to SEQ ID NO: 215907

SEQ ID NO: 729958 - DNA, 666 bp, Homo sapiens
aatgcgcgaggcctggacgggagtggccgaggcggttgggcggaggcggagcaggcgccatgtcagcccgggaagtggccgtgctgctgctgtggctgagctgctatggctccgccctttggaggtattccactaacagcccaaactatcgcatttttagtaccagaagtactattaagttagagtatgaaggaacattatttactgagtggagtgtgccagaaacttgttttgtgctaaataaaagctcacccacgacagaattgcgttgttcctcacctggtgttcacgctataaaaccaattgttactggcccagatgaagaagaacgctatttatttgtggaaagttctcatacttgctttctgtggtactatagagttagcttatcactgtgtgggcatatgatccagaaagtgcagatcctgatgagttgctggggaatgcagaagaaccttcaatagacctggcgtattgtagtaccaatgacaaaagatgatgcactaaaggagattagaggaaaccaagttacttttcaggattgctttattgcagattttcttattctgttgacttttcctttgttgaccatacctgaaattcctggttatttaccaatctcctcaccacgtggtagtcaattaatggcttcctgggatgcttgtg

SEQ ID NO: 729959 - DNA, 870 bp, Homo sapiens
aatgcgcgaggcctggacgggagtggccgaggcggttgggcggaggcggagcaggcgccatgtcagcccgggaagtggccgtgctgctgctgtggctgagctgctatggctccgccctttggaggtagagagacgccagtcgcaggtattccactaacagcccaaactatcgcatttttagtaccagaagtactattaagttagagtatgaaggaacattatttactgagtggagtgtgccagaaacttgttttgtgctaaataaaagctcacccacgacagaattgcgttgttcctcacctggtgttcacgctataaaaccaattgttactggcccagatgaagaagaacgctatttatttgtggaaagttctcatacttgctttctgtggtactatagagttagacatttctttaacaactttacccagcttatcactgtgtgggcatatgatccagaaagtgcagatcctgatgagttgctggggaatgcagaagaaccttcaataaattccctgatcacagctgtctcatgaaagatacatactctcctctggatgaattccatagtactcagcacacagatggccacattgggacagaagcctgtcatacatacagttctgaagagaaaagtttattcttcaaatgagaaaatgagaagggggacctggcgtattgtagtaccaatgacaaaagatgatgcactaaaggagattagaggaaaccaagttacttttcaggattgctttattgcagattttcttattctgttgacttttcctttgttgaccatacctgaaattcctggttatttaccaatctcctcaccacgtggtagtcaattaatggcttcctgggatgcttgtg

SEQ ID NO: 729960 - DNA, 345 bp, Homo sapiens; identical to SEQ ID NO: 215912

SEQ ID NO: 729961 - DNA, 1240 bp, Homo sapiens
aagggggagctggctgtccctccacctcccatctgccattccgaggcatcatctaacgtccccggcgtcccctctcattctggtgtcccctgtgttctagaggaagcatggactgtgtctccaggatgggctgtgggagctgtggggctcccaggggggcaggagccctcaggggagaggggtggggcacgtgggtgcgcaggtaggccgtcctggagcagagcagtgtagggccaagccctgtgtcttctgctgcttctcactggctctggggcaggtggcttcctcacctgcacgatgggaatgaccctggagttctggggaacttggtgagatcaggaccttcccccagcagtgccccccaggtgcctgacgtactgttgtgctgttggtggtattattaccacctcgggccatgcgatgacccttttgcttatctgcaaaataaagcgggtttggcagcaagaaaatcaaagtgaaactggtgaagaaagggccggcctcacgagaccccggggactcagacccagtgagcgcacctcttgctgcctcctgcatccacaccgccaccccgcgggaaggcaggacgagctgcttgccaggtgacctcccgtgcctcagtttcccccatgaccacgaggcggtgagagctccgccgagctgccccagggataactgagctgggcttggtgcggctgcggccagtacgctggtcctgcccctcttgttggtcaaatctcaagcagacttgtcccaggaccctgggtcctgtgtgtggcagatggtcctccctgcctgccccggcccccgccttccccatgggcctacggccaggactggaggacttgccccagcctaggttggccctctggccaggggaccgtccgggattcccgggcccaggcccactgaggtctgccatggacaagtgtaagatgcccaggacccccttccttggcagtgcccagatgggcccaggcccggcttctcccccagggcggctggcggctgcataaaccctgctcccccagggccctggcaaaggccgggcacccagcccaggagactccacaaagggttaaggggcgcaggcggctgtgcccacagtggggcggagcagccgggctggtgctgggccaggagcacgggcgaaggcgctgcattttaatgaatcgttattgccggcgaggcctttgtctttctttatccggtgcacaataaaagaattaattagacagaa

SEQ ID NO: 729962 - DNA, 1234 bp, Homo sapiens
ggcaggacccagcgctgcactcaagcctcagccaggcccttcctgcaggacccagcgctgcactcaagcctcagccgggcccttcctgcagaagtgcaggggcatcaggcaggtgatggaagccagaggctcagatcgcccactgcccaggccctgccagtgacgacatctgcttctctttcctgggaccagaggccccacctctgctccccacagcctggctctgccggcccagtcctgaggccactgcaaacaagggggctgtggcctcctgattactcactggccctcggctgcctgggagctgcagggacccacccaggctccctaccacctgcgaagcccacagtgccccccaggtgcctgacgtactgttgtgctgttggtggtattattaccacctcgggccatgcgatgacccttttgcttatctgcaaaataaagcgggtttggcagcaagaaaatcaaagtgaaactggtgaagaaagggccggcctcacgagaccccggggactcagacccagtgagcgcacctcttgctgcctcctgcatccacaccgccaccccgcgggaaggcaggacgagctgcttgccaggtgacctcccgtgcctcagtttcccccatgaccacgaggcggtgagagctccgccgagctgccccagggataactgagctgggcttggtgcggctgcggccagtacgctggtcctgcccctcttgttggtcaaatctcaagcagacttgtcccaggaccctgggtcctgtgtgtggcagatggtcctccctgcctgccccggcccccgccttccccatgggcctacggccaggactggaggacttgccccagcctaggttggccctctggccaggggaccgtccgggattcccgggcccaggcccactgaggtctgccatggacaagtgtaagatgcccaggacccccttccttggcagtgcccagatgggcccaggcccggcttctcccccagggcggctggcggctgcataaaccctgctcccccagggccctggcaaaggccgggcacccagcccaggagactccacaaagggttaaggggcgcaggcggctgtgcccacagtggggcggagcagccgggctggtgctgggccaggagcacgggcgaaggcgctgcattttaatgaatcgttattgccggcgaggcctttgtctttctttatccggtgcacaataaaagaattaattagacagaa

SEQ ID NO: 729963 - DNA, 706 bp, Homo sapiens
cgacacaatggagtgagcgaaggagacgagcaggttgtgccagcgccaggtgcgcagggggtcggcgcgcacgtgcacgggattgtgcacctgtgcctgcgaaaggctgaccagaagctggtgatcatcaagcagattccagtggaacagatgaccaaggaagagcggcaggcagcccagaatgagtgccaggtcctcaagctgctcaaccaccccaatgtcattgagtactacgagaacttcctggaagacaaagcccttatgatcgccatggaatatgcaccaggcggcactctggctgagttcatccaaaagcgctgtaattccctgctggaggaggagaccatcctgcacttcttcgtgcagatcctgcttgcactgcatcatgtgcacacccacctcatcctgcaccgagacctcaagacccagaacatcctgcttgacaaacaccgcatggtcgtcaagatcggtgatttcggcatctccaagatccttagcagcaagagcaaggcctacacggtgcctgggcatggaagggacctccagggcactagaagtcttgagggccaggacctaaccctgcctcctcccctccccctaaaaaacccttggccctttggcccctgtttgggtggttctgcaggaggaagccccttggcttgctttgagaagaagctgtccccaaatgggcttatgcacagagccc

SEQ ID NO: 729964 - DNA, 589 bp, Homo sapiens; identical to SEQ ID NO: 294771

SEQ ID NO: 729965 - DNA, 1468 bp, Homo sapiens
  misc_feature (1145)..(1145): n is a, c, g, or t
  misc_feature (1150)..(1150): n is a, c, g, or t
  misc_feature (1153)..(1153): n is a, c, g, or t
  misc_feature (1155)..(1155): n is a, c, g, or t
  misc_feature (1164)..(1164): n is a, c, g, or t
  misc_feature (1171)..(1172): n is a, c, g, or t
  misc_feature (1174)..(1174): n is a, c, g, or t
cgacacaatggagtgagcgaaggagacgagcaggttgtgccagcgccaggtgcgcagggggtcggcgcgcacgtgcacgggattgtgcacctgtgcctgcgaaaggctgaccagaagctggtgatcatcaagcagattccagtggaacagatgaccaaggaagagcggcaggcagcccagaatgagtgccaggtcctcaagctgctcaaccaccccaatgtcattgagtactacgagaacttcctggaagacaaagcccttatgatcgccatggaatatgcaccaggcggcactctggctgagttcatccaaaagcgctgtaattccctgctggaggaggagaccatcctgcacttcttcgtgcagatcctgcttgcactgcatcatgtgcacacccacctcatcctgcaccgagacctcaagacccagaacatcctgcttgacaaacaccgcatggtcgtcaagatcggtgatttcggcatctccaagatccttagcagcaagagcaaggcctacacggtggtgggtaccccatgctatatctcccctgagctgtgtgagggcaagccctacaaccagaagagtgacatctgggccctgggctgtgtcctctacgagctggccagcctcaagagggctttcgaggctgcgaacttgccagcactggtgctgaagatcatgagtggcacctttgcacctatctctgaccggtacagccctgagcttcgccagctggtcctgagtctactcagcctggagcctgcccagcggccaccactcagccacatcatggcacagcccctctgcatccgtgccctcctcaacctccacaccgacgtgggcagtgtccgcatgcggagggcagagaagtccgtggcccccagcaacacagggagcaggaccaccagtgtccgctgcagaggtatcccccggggacctgtgaggccagccatcccaccaccactgtcgtcagtgtatgcctggggtggtgggctgggcacccccctgcggctgccaatgctcaacacagaggtggtccaggtggcagctgggcgcacgcagaaagccggcgtcacgcgctctggggcgtctcatcctgtgaggagggcccacccctaggtgcaggacgaggcagactccttacngaggnacngnagcagccanagcccanntncaaccgacgaaccagggaagaccagaacggggtgacaataaagacggtcgacagtggggaaccacaacacgacgggccgaaggaaaacaagcacacacccaagacaaatcgcgaagcgacaaacagggggccaaagcacggcggcagcccctgaaaacacgagccaacacaggggacgcgcaaccgcgacaaaacaggtacaccccgtacaagcaacaccgaagaaaccgatagagaaacaaccaatacgacgaccaaccagacagggtgaagaggcaacaacacaccagagac

SEQ ID NO: 729966 - DNA, 955 bp, Homo sapiens
tagcagagagctctgtacgtggtaggtgctcactcccctattgtttgggtgtatgcctcctgataatgaacttgatcgtaacattattgttgcattatgcctgtattgtttccttaggtgaaggaagaatgcttttgagtacctaataggtggcaagctctgtgcctacttacatacatgaactattccttttaataacctttggaaataaagtggcatttccattgggcattagaaatctgaagactttcgtttacagctgttgcaacagcagaactagaattcgacctccgacatttctgctcaccagagggcatgaactgctggtttgtacctggcttgcagataccttctttgggcagcacaatgttcaaaattaaaaaaactaccaacacttctaaactggatactttgtatcaatatctgggtttctggcttctcttcatgggaaacaaacaaacaaacaaaaaggtttggtgaacactggggcccacattcctgcagggcaacagtcacatggagactttagatgggcacgtgcccagaacacactagagtccccatcgctccccattctcttacattctgttcccaactaggttcttataggcctgggtttgtgcctgttgcacacttatctactctcttgcttcccactggtcaggaagtctggcaaacttaaaaggcctctttttgttgctctctcctgtatggatctctcatcatagaggtgtgtgcatttctgactttgtgatttcaatactaaggaagctgtcggcacattatcaaggaaaacggggatcgctgctccccaacgtacacattctggtgtgccccagtaaaattctatattcagcctccaaactagctgggaaaaatgtggcaaatcatctacttgctccaattcaatagtgtttagaagtaagaagtcactgtgagcaatgccaccaagtgg

SEQ ID NO: 729967 - DNA, 801 bp, Homo sapiens
gtagcgaggcttgggtggcgaactcggcacgaggcttttaataacctttggaaataaagtggcatttccattgggcattagaaatctgaagactttcgtttacagctgttgcaacagcagaactagaattcgacctccgacatttctgctcaccagagggcatgaactgctggtttgtacctggcttgcagataccttctttgggcagcacaatgttcaaaattaaaaaaactaccaacacttctaaactggatactttgtatcaatatctgggtttctggcttctcttcatgggaaacaaacaaacaaacaaaaaggtttggtgaacactggggcccacattcctgcagggcaacagtcacatggagactttagatgggcacgtgcccagaacacactagagtccccatcgctccccattctcttacattctgttcccaactaggttcttataggcctgggtttgtgcctgttgcacacttatctactctcttgcttcccactggtcaggaagtctggcaaacttaaaaggcctctttttgttgctctctcctgtatggatctctcatcatagaggtgtgtgcatttctgactttgtgatttcaatactaaggaagctgtcggcacattatcaaggaaaacggggatcgctgctccccaacgtacacattctggtgtgccccagtaaaattctatattcagcctccaaactagctgggaaaaatgtggcaaatcatctacttgctccaattcaatagtgtttagaagtaagaagtcactgtgagcaatgccaccaagtgg

SEQ ID NO: 729968 - DNA, 784 bp, Homo sapiens
  misc_feature (231)..(231): n is a, c, g, or t
  misc_feature (440)..(440): n is a, c, g, or t
ccgctctccacccaccccgggccgaaagtgctgcctgcacaggttggtgtatggtcctttgagcaggaagaagacatgaagcacattcctgttagctacgacagagaggggcagggcacacactggacatttcaagcccctccagaaaagcaagtcttactgtgctgggagtacttgtggagtgcgggctgtgttgccctgggctttaattatttcaggaacatttaaccncagggttggcaggccggatcttgatacgtgtttcttagttggaaagactttggaccatagggaaatgtcttctcaattcttttaatttcagtaaggttgtcatttttcttcttgtggcctctggaatgtgacacagaactcaagggacaggaaggagatgagttggaggctgggacaggggtccctgccagggatgctggtgactcacntgacggtgttgatgtgtggagtccggtgcctggtttggggaatgttcgtgggatatgttccaaaggactgacggacctatcaggtactggaggtgaatggtcaagtctgatctcagggctgacagtgtcaggcaaggacaggaagttgacgttggactcattggctgaggttgcttgggacccagggagcaacgtgtgccaggacagatgggtctggggctaggaaggcaggtttgggctggagacttgggcttgggacgcatcccaggtagacagtggttgaggctgtggaaatgaccatgattgcctgggatgagagtggagacggacaagattccatctca

SEQ ID NO: 729969 - DNA, 623 bp, Homo sapiens
  misc_feature (231)..(231): n is a, c, g, or t
  misc_feature (440)..(440): n is a, c, g, or t
ccgctctccacccaccccgggccgaaagtgctgcctgcacaggttggtgtatggtcctttgagcaggaagaagacatgaagcacattcctgttagctacgacagagaggggcagggcacacactggacatttcaagcccctccagaaaagcaagtcttactgtgctgggagtacttgtggagtgcgggctgtgttgccctgggctttaattatttcaggaacatttaaccncagggttggcaggccggatcttgatacgtgtttcttagttggaaagactttggaccatagggaaatgtcttctcaattcttttaatttcagtaaggttgtcatttttcttcttgtggcctctggaatgtgacacagaactcaagggacaggaaggagatgagttggaggctgggacaggggtccctgccagggatgctggtgactcacntgacggtgttgatgtgtggagtccggtgcctggtttggggaatgttcgtgggatatgttccaaaggactgacggacctatcaggtactggaggtgaatggtcaagtctgatctcagggctgacagtgtcaggcaaggacaggaagttgacgttgggcgtacggggaggggatactctagagcg

SEQ ID NO: 729970 - DNA, 2068 bp, Homo sapiens
tgagatggagtctcgctttaccgcccaggctggagtgcagtggcactatctcagctcactgcaagctccacctcctgggttcacgccattctcctgcctcagcctccccagtagctgggactacaggcgctcaccaccacgcgcagctaattttttgtatttttagtagagacggggtttcaccgtgttagccaggatggtctcgatctcctgacctcgtgatccgcccgcctcggcctcccaaagtgctgggattacaggcgtgagccaccgcgcctggccaaaaaaagccatgctttttcatccttccagatcgtaacccaggtgttaagtttacatggaatgcctatgccccctcctcttcctagacgtagatatctcctctcccctaggaagtcttccttaactcatcctcagggagttatccacccttcttccagcacagggcacggcactaatggtgagctcttctcacatcttctgctgagactttgttctggggctgagtcccctccccaaccccctgactctcacacatagccccccatcagctgttttactccgtgccttactggatttggcctgtcctcaagaatggtaattatgaagagtggagaagtttggaccttgcctcctttaggggaaaggtaggacaggaatgtccctgcctggtactggtgggggaaatagtccgtatccccaactattaaggatttgtcccaggccaatggtgaacatgctgcattttatgtttggattgtgctgtaataagagcctcttccttccctcagaggatgtggctgggcttctatcctagagatggagtagaaggcacaactggtttgatagttactattttctgacctgtttgctgaagtgatttgcgaattgactttcctagggtgttgcctgagtcctttgaaatctccttctgacatctttcccttctgttgtgaaatatgttaagccacaggccaaactgctataagatcgaagtttgtttttttctcacctaataatagagaggtaatcagatggtctagggcagatttaactctacaaggttatcaggaactttgtttccttctgtcttattcagccattcccagtatgttttcttacccataagatcaaagcagactcatcagctccatatctgcattccactggggaaagagagagagaaaagagcagatttttaaaaaaagatatgactgagcattgctcagatcactgtggccacactttgctgaaagagatgctgggacatagaacctcttatctgggcagtcatgtgctgagttaaaactcagggattctgtgactacaagatgaaagacaatttggttgctgagatgcagttaatggcttctgttacatggagctcaatggacgtgcccaggaatgcttttggctgttattttgcagttaatacctcctgtaactaaagcatttgtttatgagttgacttgagagaagggctgatctcagagccgctttgagctaagttggattagtcacactaggaagttaattccacacctttcgtctaagtctcagtattgaggcctctccagttctcatgcaccctgatcttagggttagaatacttgaccctgatacctgcaccatgcttcatggttcctgagctctttctcctgtttcatttgagcctccaaactacatatttggtcatattgcctgcctaccccatgcctgctgcagaaatattcatccaggttaaccttgatatacacagagatggtcttggagaattgtgaatgtatgtactgtattgtcatcaaggatactgtcccttatttgaaggcatctaaagagaaactgttttcagatccaagtgctcagatctaaagcctctgcaacaagtcaggtggtggtcatgtttcccttctagttttggctgacaggaagctcagttcagtaccataactacagaacctgtcatctgtattttttgttctcaccccgtttttgttattttgtttctggttttttatattgaggtatgttttagatatagtttacaaaaataaaacgcacagatctt

SEQ ID NO: 729971 - DNA, 1326 bp, Homo sapiens; identical to SEQ ID NO: 223065

SEQ ID NO: 729972 - DNA, 1339 bp, Homo sapiens; identical to SEQ ID NO: 223108

SEQ ID NO: 729973 - DNA, 1445 bp, Homo sapiens; identical to SEQ ID NO: 399984

SEQ ID NO: 729974 - DNA, 1894 bp, Homo sapiens; identical to SEQ ID NO: 282318

SEQ ID NO: 729975 - DNA, 2316 bp, Homo sapiens; identical to SEQ ID NO: 222264

SEQ ID NO: 729976 - DNA, 1175 bp, Homo sapiens; identical to SEQ ID NO: 223369

SEQ ID NO: 729977 - DNA, 1998 bp, Homo sapiens; identical to SEQ ID NO: 220055

SEQ ID NO: 729978 - DNA, 1503 bp, Homo sapiens
atgcaattacaaatccaataccattgagcccttttgggacctatccctggaattccctgaacgctatcactgcatagaaaaggggtttgtccctttgaatcaaacagagtgcttgctcactgagatgctggccaaattcacagagacagaggccctggaagggagaatctacgcttgtgaccagtgtaacagtgagtgctgtgtggaggagggggcgtagtggggaagaataattggaatatcagtttaaggtgctgctttgtcctctttagtcaaaagtaacactaatgatattgaatggttctaaagcatcttttaaagatctttttctcccatttttctaaaaacaaaaaaacatggacttgttttaattatgtattaaaaaacaaaacaaggctgggcgttgtggctcacgcctgtaatcccagcattttgggaggccaaggcggacagatcacttgaggtcaggagtttgagaccagcctgaccaacatggtgaaaccctgtctctactaaaaatacaaaaattagctgggcatagtggcagatgcctgtaatcccagctactcgggaggctgaggcaggagaatcggttgaacccaggaagcggagggtgcagtgagccaagatcgcgccattgcactccagcctgggcaacagagcaagactccgtttcaaacaacaacaacaacaacaaatgaaacaaagacctaggagttgattgacctcctgattgacattagttgtcatcttggaagggattttaaagttgtggctcctgaaatggggactctgagaatgttagtacttagcttcttagtgctgtggggctgctgcttaaattcatgaatgtagagtctgacagttcttacttaatctaaacccagatggtatagcctttctgaagggtgcgatatcagaaaagcaagcttttgtactgaactggtagacttaatgtctgtcaaaagtgatgctaaagattggtacagtggaaccaagaaagcaagtcttaaggtgcattgctcagtggcagcttcatgaaatattttctgcattttgtttttattgttcacatgcctgaaaagttcacatttcagagagggtcatacggaagtatttctgtgttgtctgtaattttaaaatggaactcttacatatggttacagaggcatgttatcagggtccttccatcttgccacactaacacttaatgcttctgctaatccagtatggacagaggaaatgcagaacaaatatgtggatgcttatgtttggggtttgtggcatatatagatttggaaactaaaagtataaagttaatggactgtgcagagacctagaaatcaattttcagtcacataatagtttagattaccagttttgaagaaaaaaaaaatcttaggccaggtgcagtggctcatgcctgtaatcccaggactttgggagaccccaaggtgggcgccactgcactccagcctgggtgacagagcgagatgctgtctc

SEQ ID NO: 729979 - DNA, 1397 bp, Homo sapiens
tcacttccccttcctgcaccccatcctgatttgagggagcccaggatgacaaagagggagtagttgagcaaggtatggagtggcagtctctacaggagctcaaaggatgcatttgtccatctgccctgggctcagcttccacactcagagtcactcacatccctccaccgtcgccacagctcacttgtgtgcccacacagacaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcgctgctccttgccatgcttggcggccgct

SEQ ID NO: 729980 - DNA, 2455 bp, Homo sapiens; identical to SEQ ID NO: 226059

SEQ ID NO: 729981 - DNA, 405 bp, Homo sapiens
tgttgcaagtcccaagcctctcggggcctacaggcaaaccctgactgcccatgaagcagccgcaggtgccaaaggacccactgccaacaaggaaatgagggcagtggatcacacaccctggtgaaactgaggaggagcagagaatgaaacaggaaactggagacagcatgacttcagaccagcaaagaaaagtcaccaccctggaaactaatgctctaccctaaacaaagaaactacacactgctttttgccaaagaggctagtggtatgagtcaggaaaggacaagaatgaccaacttctcacaccctgaaccacattcaaagtctaagccaagagagcacctctggaagtcagagtaaagaattcccttcgaaataaaatatttgctttaacatttaaaaaaa

SEQ ID NO: 729982 - DNA, 463 bp, Homo sapiens
tgtcatccccccagcccagcgagcccctcgtgctgctggcggctgagcagaccagtggcagtttctcacagctctcaggaaagccccagctcacagcagacaggaacaatgacactgccattgaaatagacaactgcagcagctacaagataccctctccagtggcatctccaatcaatttgaatatacccatgagagctgccttgagccacagcctctgggaacaagaggactggaatgagcaccttctacaagttcatatagccagttacctaggagagcacttcttgggagcctgacacctaggcaaaacatgctcttccttgcatacgtgtacttgctaccacctcttataatgctccttttccactgtgagccaagtgaccttgggagaggtaagatggtgtttccaacaaggtgcttctctacttccaccaataaacttccaagtgagtccctaaaa

SEQ ID NO: 729983 - DNA, 542 bp, Homo sapiens
ataatagtttgtgattctgggtgtagaacataagactcactgaagtttctactttggttctttctttctctggaatcatgagccctgggggaagctggctgttgtgtcataaggaggcctgtggtccatgtgactaggaagtgagtcctcctgggaccagacaataagaagctaaagcctcttccaaaagccatgtgagagattcttgtgtcttgtgaatccccggccccatttgagccctcagatgattcagccctggaagacaactagactgcaacgttgtgagaggccctgagccagaagcattcagagaaacttctcctggattcctgaccatggataactgtgggagatgataaatatttgttgatttgagctgctaagttgtaggtgacttgttatgcagcagtagataactaatacagcttcacaagagaggatgaatcactgaactttttcatttgctctaaattcattataagatattaaacatgtcatttgcttttaatatttaataaaaatttccatggctatataagata

SEQ ID NO: 729984 - DNA, 496 bp, Homo sapiens; identical to SEQ ID NO: 225458

SEQ ID NO: 729985 - DNA, 1484 bp, Homo sapiens; identical to SEQ ID NO: 398630

SEQ ID NO: 729986 - DNA, 1322 bp, Homo sapiens; identical to SEQ ID NO: 224923

SEQ ID NO: 729987 - DNA, 1742 bp, Homo sapiens; identical to SEQ ID NO: 225317

SEQ ID NO: 729988 - DNA, 1740 bp, Homo sapiens; identical to SEQ ID NO: 672145

SEQ ID NO: 729989 - DNA, 1259 bp, Homo sapiens; identical to SEQ ID NO: 225846

SEQ ID NO: 729990 - DNA, 2114 bp, Homo sapiens
ctggccacagtatgaggtgttttctaaggcttgacattaggtatttcctagtgcaaaatttactgatcccgcgtaggctccaacctagagccaggattccttaatggaacacaaactgatttactttgaatatactcaagcttcacagcaaacacttcctgtttctattactgtccaagtcttcttaccatgcctgaggcagacaatttaaggcttgattcctcaccctttcccttcatctgctgaaatcccatttagttttagtgcaccaggcatgcactggtatttcatcctatgcattccttccacagcctgacctataaagggctgacactgagtcctggcttgttcagatcagagagaattaacacttttatttctttgatttcaaaagcttctgaggtaacttttgagctcgtaaatgtcaataatttgttgtcaagacaattatattcttaacccagctgctacatatagggaacatagagactgacagaaagtcagtgaatttagaattaaaacagtaagtttatctgattgactatgcttctcaaaatgtaaatggatgatacaaattaatacaaccaattcattttatttggtttggttttggtttttgaatgggtttatgggtttaagagacattgctctctgttgtttatgtgtattcagtgtcagaaaggaaaagtgagcaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccaagagaaattgacttctaaagaagaatgtctcagttcacagaagctggagatagaccttttaaagtctagtaaagaagagctcaataattcattgaaagctactactcagattttggaagaattgaagaaaaccaaggaacaatgaaggtgaaccctagtctcaggattgctagtctcaagatggtaccactgtaattctacctggaaaaggaggtgttttcattcctacagatatttttcataagataaatacccacagtgtatagtaatgaacctggataataaatatcttccagcaaatattttacttagaagacgattatattttttaaattttgagattaattgaatatatacaaacagaaaattaagtacaaatttattatgtttatggctcttatacaactatcaaggtaaaggaaatttaccaattaaatacaaagtagtaaaattcaaaatcacaataattaataatgttctgctgctacaaaatgagatgttgggtttaataatagaaggaagtagcactgttgaaatagaattaaatgggtcttgaattcatttgtgattggaatcagaagtcgcgagttctgaaagggtaaggtttactgcaacattgctaataaataatttcaagatgaaatatacaaagatgagatccaagctctaacatttacttgcaacatgaatatggtactgtgttcttctccgtcccccatcctcattccccctcctcctcctgctgctgtttggtcttcctttggaaattcatgatgccatatcagatggttttagaattctgcactttaataatgtaatgcatatgccatatataatatcccagagggatctgctataatattgcataatcgaattcatatttctgcagcaaaatgtgtggatactctcacaaggcaggataaatagagactatatatactgggccaggtgtggtgactcatgcctagaatcccagcactttgggaggccagggcaggaggatcacttgaggccaggaatttgagaccagcctgggcaacatagtgagacctcatctcttaaaaaaaaaaa

SEQ ID NO: 729991 - DNA, 1443 bp, Homo sapiens
ctggccacagtatgaggtgttttctaaggcttgacattaggtatttcctagtgcaaaatttactgatcccgcgtaggctccaacctagagccaggattccttaatggaacacaaactgatttactttgaatatactcaagcttcacagcaaacacttcctgtttctattactgtccaagtcttcttaccatgcctgaggcagacaatttaaggcttgattcctcaccctttcccttcatctgctgaaatcccatttagttttagtgcaccaggcatgcactggtatttcatcctatgcattccttccacagcctgacctataaagggctgacactgagtcctggcttgttcagatcagagagaattaacacttttatttctttgatttcaaaagcttctgaggtaacttttgagctcgtaaatgtcaataatttgttgtcaagacaattatattcttaacccagctgctacatatagggaacatagagactgacagaaagtcagtgaatttagaattaaaacagtaagtttatctgattgactatgcttctcaaaatgtaaatggatgatacaaattaatacaaccaattcattttatttggtttggttttggtttttgaatgggtttatgggtttaagagacattgctctctgttgtttatgtgtattcagtgtcagaaaggaaaagtgagcaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccaagagaaattgacttctaaagaagaatgtctcagttcacagaagctggagatagaccttttaaagtctagtaaagaagagctcaataattcattgaaagctactactcagatttggcacagcaattgccgaaataccacgatggcacaatctcacacatatgtaacctcagtggaagaaggaaacatgaacgtgcccagcggggaccaatgaaggtgtctgatcacaatcctgtaaacagctggcaacgaggaacacggcgatactgccaaagcaactctctcaattcatgctgccaggagaagcagaacaaccggtctgttatggataccaggtcgatgacttaacagtgagatccagacctggagatctttgccgaacaacaagggcgcctgatctggc

SEQ ID NO: 729992 - DNA, 1155 bp, Homo sapiens; identical to SEQ ID NO: 226136

SEQ ID NO: 729993 - DNA, 2047 bp, Homo sapiens; identical to SEQ ID NO: 228622

SEQ ID NO: 729994 - DNA, 1374 bp, Homo sapiens; identical to SEQ ID NO: 224683

SEQ ID NO: 729995 - DNA, 946 bp, Homo sapiens; identical to SEQ ID NO: 227345

SEQ ID NO: 729996 - DNA, 1437 bp, Homo sapiens
gctcaccataccaggtatcaggaattattttagagtgaaagtaattgtaattaagacaatttactgccaatgcaggaaaaaccaaaagaacaatggaaaagaattgagagtatccaaacagatccatgcatataaagcagaaatagccattacaaatcgatggggggaaatatagcagggtcacttgttcacatgggaaaaagacattagaagcccatttcccattatacataacaatatatatcagtttgattaaggtcctaaacaagtaaaagcaaaatttaaaaacttttagaagaaaatatagaagaaaatctttataatctctgcatagagaagaactgttttaaaaagacataaaaagcagaagtcataaagaaaaagactgataaatctgactattttaaaatcaaaacttttgcaagacaaaaagacaccacaaataaaattttaaaataagccacagactgggagaaaatatttgcaatgcatatagctagcaaagaattagtatctagagtatataatgaacacaaaaagctataagaaaaatgattcaatagaacaacaaaggacacaaacaggcaaatcatcaatggtcaataaacatacaaaaagatgctgaataacactagaaaacagatgtaatacaaaaatgacacttaatacccatcaagctggcaaaagttaatgtgtgactgtgaggtgaggatgtggggaaatggggaactcacacacactgctgggggagtgaaaattggtccaaccactgtggaaaacaatttggcaagatccagttaaacttgaaaatgcatataacatacaactcagtaattccactaagtatacatgccaaacaaactctgtacatttgcaaaaatagatattaggatattaatttcagcactgataataatgaaaaattggaaacaacctaaatatccaactgcaggagaatggataagtagttgtggtatatgccacagttataatgaatgaactaaatgaacacatatctgtaggaataaacctgaaaagcagacttctgaatgaaaaaaattacagaaggatacaggtaatatttatgtaaattataaacacataataagcactactatgtatcatttatggatacaaatgaaatgaacatctaaaaccaagaaagggaagatgcacatcagcttcaggatatttagatatgtctgggaaagaagagtggggaacggtatacacgaggatgtttcaactgtttctgaaatatttttgaataaaaacctgaaaaacaagcaaaattttcgtatctgtttaatctgtgggtgatatttacatgggtgtttatattctctgaatgcttgaaatattttatcattaaaacaaaaatgtataatctcaaaatattaaaacaattataactaaaaacacaagagggtctcattc

SEQ ID NO: 729997 - DNA, 1752 bp, Homo sapiens
tagtcttaggaaacaaaaggtttattgaaatgcatgtagataaattatcatcagcataaaactgttatggagttttcaacatggggtcttttgctcttaaaatgaagtgaagctttgcaagtccattgtccaataggaaaaatattatatctctctgttcagataaagtcctttaaaaaagtaaatctcttttgaaacggtcttttaaacgtctccagcctgtttggctccccccaggtggtgttgctgtccttctccaattgtgagtctgttgaatgggattatcttcatagtggttttcttcatggaataccaccgggttttccaagtggcccaaataatgccattatcataaccattaggagtagatgcttttgagtaagtgccaccttggtaataaactccattgagatggccagcgtgacacttgttcatccaccaaccagatccatcctgttcagcacagttgccttcaaacttatcattgtcattgtcccaggtactgaactgcatgccattatgggatgtgaaaaacttgtcactaggatcatcgccaaaatcaaagccatcaaaggcatctccagcatccccaccagcgaagtaggcatatgttaggcggtacttgtcagcttcaggtcccaccttgaacatggcatagtctgcagtactggttctgccattccagtcttccagttccactcttaatgcatatgggatggcagactgtgtgcttatcaaatgaatcttctcatttcccagccaaaattctgttgtgccagtaggagacagatgtccaaatccttctttatattgaatccagtttttcttgaaatctacactgccatcaagtctcttctgaaacacagtccatccatttccagacccatcgatttcacagtagactaagaattgctggttagctttcagaggtttaataaagtaaagcccgctctgtttagctcccttattggcaatgtcttgacaatctttcccagtgatatcatggatttgcaccgtgtctttgcaaggttcctggcactgtgcttcaagctgggctaccttctctttcaggttaacaatcttttgattatttgaattatatatttcctgcaaatatcgaatacttgagtcatgtgttaaaatcgatgcttcatatttcataatttcttctaacattttcctggacttcaaagtagcagcgtctatcatatttggttttgatgattcatcaggattataagtgagttggattgcttttatcagctgtttgacttctgatgttttgttttcaacttgatgtaagatgtcttccaaagactgtagatccttgtctactttggtttgataagtagacaggaaatctgcaatgccacaggtagttggacaataactaccgaatctttcatctaagatgcagcagttgtctctggtagcaacatatgctacacatgttgaagagagaaataaaagagcatagaagtagagaattaaattccgggggtgcaaggaccaactcatgatgtctgagtgcccggagctccgagccttgtagtgtcagcatttatttatttatgtacctttgttatgatgggatatttttcatttgaaacttgttcataaaaatgtcaatgacattgatgactgatttgtacatatttttcatatagttttgtttaaaaaataattcacgcaaaatcttgaagtcatttttgctattgaaataaaccttaattaaaatatttcatcatcaca

SEQ ID NO: 729998 - DNA, 1885 bp, Homo sapiens; identical to SEQ ID NO: 508198

SEQ ID NO: 729999 - DNA, 2211 bp, Homo sapiens; identical to SEQ ID NO: 399355

SEQ ID NO: 730000 - DNA, 927 bp, Homo sapiens; identical to SEQ ID NO: 225950

SEQ ID NO: 730001 - DNA, 486 bp, Homo sapiens
agattaggtaatggcacaggttgcaaattagtctgcagtaggagtttgaccctgcaaatcagcctgtaggttatgatgctgtctctgctggcaaacagccagaattactgagaagacatttgtgcttcgtgtggacaaaactactggtcaaataagcatacgtgtccacgtctcccattctttaatccgaaatcattcaccgtttgaatccctcctttgggcatggaaaattaacaacatcacctctaaggatgaacacagaatacctgctgcttttgccacagcccagccgggactttccctgcaggtgtcctgggcaggcactgctggggactcccaggtgtgcactcctcggttggccgctgatgaacgcagagggaacagcctttgtaacccagagtgtatgggcggccctctaagcgcaccaggagcactgggaaagaaggtggtcactgctcttccaggaaatgaaaatatcccttgaaa

SEQ ID NO: 730002 - DNA, 935 bp, Homo sapiens
ccggggcacctgtctaaaaacaccccgcctccgaacgcgcgctcttgcggaattctcccgaaccgcatagcaaccgggggcagagtgcgagcccccagcggtgtgctgggatggaaaagcaggagccgctgaggatggactacggggcgtgttcccgaaaagccgggaagagatgtggcggggctgccgcgggcgtctctaaggccggcacgggtggcgtcttgactccctgcccctccagccgcggacctcggacggggggaagggggctcctccaagcggggagacggtcgccggccgagcagcagggctcctggccggcggagggtgctatgctctgcgggaccgccgggaagtcccagacaaggatctatgaaagataaaatgtggtgtgaggacacggcccagccccaccgtcgtcttccagccccaccatcgtcttccagccccaccgtcgtcttccagtcccaccgtcgtcttctagccccaccatcgtcgtcttggactctctgggtggcaccacgctgtgggtgctgctctcctctgtgtcccaaacgagtttgtgcctcactttgtcgggttttggctgtgacttggagcctcaccaagctcccttttcctctgtctcccattctcctctccaggccagggtggcttccccagccctcctccccgggtcctgcctgtgccgagccttcctcccaggagggaggtgatactgacttgagatcttatgggtgttttgtttgtggctgggcctggccgaccctctctccacggccttagatcacactctggatggataggacagtcgtcctcaatactgagcctctttggagcatacccactgatggtggttcacaagctacccacgcccacaggctgacccagatctccgtgaaattaaaaaatactgtgaaaggaaaaagagccaa

SEQ ID NO: 730003 - DNA, 1062 bp, Homo sapiens; identical to SEQ ID NO: 728433

SEQ ID NO: 730004 - DNA, 789 bp, Homo sapiens
ccgtctagatgggagtgataaggaccaagtatccctgggagaagaaaacagctctggtagcagatcactcaagcccgggaggtgtaggctgcagtgagctatgatggtgccactgtacttcagcctgggcaacagagaccccatctcttaaaaacaaacaaaaaaaagctctaagatctagtgccacctcctacaggtaggcacccggcgttctaggtaccctgctagaccagcccttccctgactccaccctgctgtagaatgatggcctctttctttctcttccaccaggctctagggcttggcagaggaaggggcaaggtatctctgcatcccttggacccagccacaccccaacacagagtgaatgtttcctaatgccattccctttccacaactccactccacgagagagaagtgacttaagcctgctaaggagcggagggaaaagttcaggaaggtttcagcatgctatcattagcgctatcattagctcttgaggactgaataggaatttactaggggtgggtgggggagaatattccaggcaaatggaagagaggtagatacaaaggcacagaggtatgtagggaacaataagggaaattgtgtatttgctgggggagggctaaagatgaggattcaaggccaggagcagtaatcccaggactttgggaggtcgaggtgggaggattgcttgagcccaggagttggaggctgtattgatctatgatggcgccactgtactccagcctgtacgacagagcaagactctgtctctaaaagaga

SEQ ID NO: 730005 - DNA, 378 bp, Homo sapiens
ccaggagttcaaggccagcccgggcaacacagtgagacccccatcgctacaagaaatttaaaaattagctgagtgtggtggtgcgcacccgcagtcccaggtgcttgggaggccgaggtgagaggattgcttgagcctaggagttcgaggctgcagtgagctatgatggtgccactgtacttcagcctgggcaacagagaccccatctcttaaaaacaaacaaaaaaaagctctaagatctagtgccacctcctacaggtaggcacccggcgttctaggtaccctgctagaccagcccttccctgactccaccctgctgtagaatgatggcctctttctttctcttccaccaggctctagggcttggcagaggaaggg

SEQ ID NO: 730006 - DNA, 1228 bp, Homo sapiens
ttctctctctctctctctctctctctctctctctctctctctctgtctgtctgtctgtctgcagcctcttgagcagctccaatattccctcccaccccctacttccatgacttctgaagcaactgtcattgacattctctctacagcccctggccgcagatacaaaggatgcatttcaagctctcccaagaactcttgcagtgctccatccctgtgtcctcagaaatggccctgagtctcagcagctcaaaaagactccaccatgtgaagacatgcttgattcccctcaccttcaccatgattgtaagtttcctgaggcttccccagaagtggaagcctgatagcccacagaactgtgagcctattaaacctcttttctttatcagttacccagtctcagaaaaactacttaatgtaattttttctagtttctgggagaataacaaaaagaaggaagattcagtaggaaaggaaagcaatgaagaagccaagaaagagacaaggaaccctggaaagagagtcagcaaagagagaaatagaaacattaatttcagaggagttggaagtgttgtgaactattaatcctttagctttgctttggacttgatagcaaaagtagctgcatgcagaagtaaaattgttaagaatgtcacataaaatgtgagggtgagctcagcatgaaggaacagcctcttccattggtgaggtgaagaaactgaagactttagccagagccaagtggctaattcagagtttaatacacctttgacctcaaaccctttgtggtcacctttgaacagtgcctccctctctgaaataaaatactggttctgtcattaattattaattattgattaatttctcttgattttcattttctcctatgcaaaattctgttactgaattacatgaattccaagacctctttctgatctaacatcccatcattcccctgttaaaaagataacataaaaccagaaacaaagtatgtaattgtaatgccaaatttttaaacatagttgattattccaccttgaaaatgtaaatactacatgaagcgtcaacaaataaaccattaggtcaatatttactgagagctgactctccatcagagtgatgcttgtaattgacatggagggcaaaatgattttaaaaagtaagattcctgccttcttggaactcagagacaaatgtgggaaatgggcaactcaagaaacaatttcaaaat

SEQ ID NO: 730007 - DNA, 746 bp, Homo sapiens
gttggatagtgagaagccactgcttccttgcaagaaccttcccaaatttctctaaccatgtgaagacatgcttgattcccctcaccttcaccatgatttttctgggagaataacaaaaagaaggaagattcagtaggaaaggaaagcaatgaagaagccaagaaagagacaaggaaccctggaaagagagtcagcaaagagagaaatagaaacattaatttcaggtgaagaaactgaagactttagccagagccaagtggctaattcagagtttaatacacctttgacctcaaaccctttgtggtcacctttgaacagtgcctccctctctgaaataaaatactggttctgtcattaattattaattattgattaatttctcttgattttcattttctcctatgcaaaattctgttactgaattacatgaattccaagacctctttctgatctaacatcccatcattcccctgttaaaaagataacataaaaccagaaacaaagtatgtaattgtaatgccaaatttttaaacatagttgattattccaccttgaaaatgtaaatactacatgaagcgtcaacaaataaaccattaggtcaatatttactgagagctgactctccatcagagtgatgcttgtaattgacatggagggcaaaatgattttaaaaagtaagattcctgccttcttggaactcagagacaaatgtgggaaatgggcaactcaagaaacaatttcaaaat

SEQ ID NO: 730008 - DNA, 496 bp, Homo sapiens
gagagaatctggctaagtgtctagcaggatgattgattaacaagatgttttgttttcatcatctcagagaagctgtattgaggtataattgatatgccaaataactggacacattcaacttgtgcaatttgatgagtttggagatacacatacatctgtgaaaccatcaccaaaatcaagaacaactttctctgatctctgtggacatgcttaaaatggctgactcacacagcaagactatttaactgtgcctaaaatcaacccacattcagatgctaactgtaatcctattccctgatccatcaggaaaaagagtctgattgacataacttgtcaagtgttcgccccagcttctatcaactatggggaaggaagggccagaagaggtgtaaccatcatggctaccaggtttcgaaatatttacattacatactgcatttattaaaatacaaattaaatctgcaataaaaaactaattgaccattaaaaaggattc

SEQ ID NO: 730009 - DNA, 454 bp, Homo sapiens
ccagagaataaaagggcattccttagggttgctgaggattttctttgattgtattctgctaatgtgtgtgcaaggcagatataacacatttgtggaaggctctagagacattttctacaaattttaccctggtttcagaacaactttctctgatctctgtggacatgcttaaaatggctgactcacacagcaagactatttaactgtgcctaaaatcaacccacattcagatgctaactgtaatcctattccctgatccatcaggaaaaagagtctgattgacataacttgtcaagtgttcgccccagcttctatcaactatggggaaggaagggccagaagaggtgtaaccatcatggctaccaggtttcgaaatatttacattacatactgcatttattaaaatacaaattaaatctgcaataaaaaactaattgaccattaaaaaggattc

SEQ ID NO: 730010 - DNA, 1595 bp, Homo sapiens
  misc_feature (2)..(3): n is a, c, g, or t
  misc_feature (7)..(7): n is a, c, g, or t
annaaantaagacaaacaaaactacaatggaagaagaaaacgtcctcaactagacatctgccaaaaatatcatccagaatgccctggcaagttcacttccatttagtgaagtgagataatttggcaattcacgcaagagactgagaaccaagcctcaagccctgcctctgattctgcaggtatggaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaagactctccatttcaagtgacaaaactgtactggcttaatgaaaagtgggactttattgcctcagcttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagatccttcccggccattggggtggaggcgttttgccccagcttcctgagggcagggtttttaaatagcatccaggccccgcatccagtgccagggggaggatctttgccccccaggattcctgctggcagaccagtaatgattgtggtggaatatatggagaatggatccctagactcctttttgcggaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactgacctcttccaaactctaacacttaacctctgctattctgcataaattctgagaaaagccaaattttctgtcggtctaagaagacatagcctacacccaactggagataattataaaaaataatgaagcagcatgaggggaaggtatttaatgtgtattttaaagttgggagagattctccttcacctaatttaggtgtttgtgaattggcttgactttttgaagttaatttttaagccttgaacatgtccaactttaagaactttaagaataaatattttaacacaaaaaaga

SEQ ID NO: 730011 - DNA, 1481 bp, Homo sapiens; identical to SEQ ID NO: 233048

SEQ ID NO: 730012 - DNA, 1388 bp, Homo sapiens; identical to SEQ ID NO: 285008

SEQ ID NO: 730013 - DNA, 3128 bp, Homo sapiens
acagactgttagtgcacatcaatatccattttgtcctcttcttttttggcatacaaccaaaacttacataggctttttatcattttactgggcctatgtaactgagttttagccagtggaatatgtccaagtgacatttgccacttctaggtctggcacattaacacttgatgtattacatttcagaccctcttatcattctgcagtgtgtttggcgatctgttgtttaagatctatatgcactggttactgttgcttgccttccattcctacccttactaatcagattcctattatagctacttctgtccttgattcattttgtatattagatgtgtgtgtgttcatgtgcatgcatgcaccctcacatgtaggtgtatatgggagtggtggtaaagacaggatatttcttcagttcatgggattttatttcaggagaattcaaacattcacgtattggagaagatgacacatttcttgaatgtctttggctttgagctgaatgcactaactagaagggacttcagattgtcctccttcgggggaggtaagtatattcttcatatacaggtaagagtgaaatgatagaagaatgttcctcctctccttttcttcctggacaacagatcaaatatttctcagatcttttacagctgaattggagtcacatggacaggtatgatcttaaaatataaaaaattattttaaaattacatgctaaaattttataaaaataaatgctaaaactaacttaaacggaagcatttgattaaaaaatttatccaaaaaagtttgaattttatatgaaacaggatagaagatgaaaaagctaaagaaataaaatataaataaattatggctggggacagtggctcacacctgtaatcccagcactttgggaggctgaggtgggaggactgattgaggctaggagtttgagacctgttatttgaggcacatgggaaggaaagttttctttgagatattccacattttataatattcttcaagagatttacagagttccttgagtgaattgttggtttgttcttaatactgaatttcctattcaaatttatttagaagttcatttcttacagtgatctcatctcctattaagatattcttcaaggtaggttcttggccagtttctcaatgacagatttttaaaaatattgttaatctttttattaatatgagaacataattgttccagatctggaggccatcctttaagcttcttgcaacagtctgggagcaaagagtttactcgccactgggtagtgggccatggacaccccagtctccaccagaagttcgggattgcaaaatgggactctggcagcaaatttcaaactgtatgccagacctggccctttgcagtgatataaaatttttcttgaggtgtctggaaagatggctgaataggaacagctctgctctgcagctcccagcgagatcaacgcagaaggagataatttctgcatttccaactaaagtacccagctcatctcattgggactggttagacagtgggtgcagcccacagaaggcaagcagaagcagggtggggtgtcgcctcacccgggaagcgcaaggggtcagggaactccctcccctagccaagggaagctgtgagggactgtgccgtgaggaacggggcattccggcacagatactatgctttccccacggtctttgcaacccacagaccaggagattcccttgggtgcctgcaccaccagggccctgggtttcaagcaaaaaactgggcagccatttgggcagacactgagctagcagcaggagtttttttcataccctagtagcccctagaatgccagcgagacagaactgttcactcccctggaaaggggcactgaagccagggagccaagtggtctagctcagcagatcccacccccacggagcccaacaagctaagacccactgggttgaaattctcgctgccagcacagcagtctgatgtccacctggaatgcttgagcttggtgcagggaggggcgtctgccattactgaggcttgattaggcagtttccccctcacagtgtaaacaaagctgctgggaagtttgaactgggtggagcccactgcagctcggcaaagttgctgtagcaagagtgtctctctagattcctcctctctgagcagggcatctctgaaacaaaggcagcagccccagtcagggacttatagataaaactcccatctccctgggacagagcacctgggggaaggggcagctgtgggcacagcttcaggacacttaaacgttcctgcctgctggctctgaagagagcagcagatctcccagcacagtgctcaagttctgctaagggacagactgcctcctcaagtgggtccctgacccctgtgcctccggagtgggagagaccttccagcaggggtcaacagacatctggtgggtgcccgtctgagacgaagcttccagaggaaggaacaggcagcaatctgtgctgttctgtagcctgcgctggtgatacccaggtaaacagggtctggagtggatctccaacaaactccagcagacctgcagcagaggggcctgactgttataaggaaaactaacaaacagaaaggaatagcgtcaacatcaacaaaaaggacatccacacaaaaaccccatccgaaggtcaccagcatcaaagaccaaaggtagataaatccatgaagatgaggaaaaaccagtgcaaaaaggctgaaaattccaaaaaccagaacaccttttctcctgcaaaggatcacaactccttgccagcaagagaacaaaactggatggagaatgagtttgacgaatttacagaaggaggcttcagaaggtgggtaataacaaactcctctgagctaaaggagcatgttctaacccaatgcaaggaagctaaaaatgaaaaaaggctggaggaattgctaactagaataaccactttagagaagaacataaatgatctgatggagctgaaaaacacagcacgagaccttcgtgaagcatacagaagtatcaatagctgaatcgatcaagcagaagaaaggatatcagagattgaagatcaacttaatgacataaagtgtgacgtcaagattagag

SEQ ID NO: 730014 - DNA, 1670 bp, Homo sapiens; identical to SEQ ID NO: 411855

SEQ ID NO: 730015 - DNA, 3894 bp, Homo sapiens
acagactgttagtgcacatcaatatccattttgtcctcttcttttttggcatacaaccaaaacttacataggctttttatcattttactgggcctatgtaactgagttttagccagtggaatatgtccaagtgacatttgccacttctaggtctggcacattaacacttgatgtattacatttcagaccctcttatcattctgcagtgtgtttggcgatctgttgtttaagatctatatgcactggttactgttgcttgccttccattcctacccttactaatcagattcctattatagctacttctgtccttgattcattttgtatattagatgtgtgtgtgttcatgtgcatgcatgcaccctcacatgtaggtgtatatgggagtggtggtaaagacaggatatttcttcagttcatgggattttatttcaggagaattcaaacattcacgtattggagaagatgacacatttcttgaatgtctttggctttgagctgaatgcactaactagaagggacttcagattgtcctccttcgggggaggtaagtatattcttcatatacaggtaagagtgaaatgatagaagaatgttcctcctctccttttcttcctggacaacagatcaaatatttctcagatcttttacagctgaattggagtcacatggacaggtatgatcttaaaatataaaaaattattttaaaattacatgctaaaattttataaaaataaatgctaaaactaacttaaacggaagcatttgattaaaaaatttatccaaaaaagtttgaattttatatgaaacaggatagaagatgaaaaagctaaagaaataaaatataaataaattatggctggggacagtggctcacacctgtaatcccagcactttgggaggctgaggtgggaggactgattgaggctaggagtttgagacctgttatttgaggcacatgggaaggaaagttttctttgagatattccacattttataatattcttcaagagatttacagagttccttgagtgaattgttggtttgttcttaatactgaatttcctattcaaatttatttagaagttcatttcttacagtgatctcatctcctattaagatattcttcaagatctggaggccatcctttaagcttcttgcaacagtctgggagcaaagagtttactcgccactgggtagtgggccatggacaccccagtctccaccagaagttcgggattgcaaaatgggactctggcagcaaatttcaaactgtatgccagacctggccctttgcaggtgtctggaaagatggctgaataggaacagctctgctctgcagctcccagcgagatcaacgcagaaggagataatttctgcatttccaactaaagtacccagctcatctcattgggactggttagacagtgggtgcagcccacagaaggcaagcagaagcagggtggggtgtcgcctcacccgggaagcgcaaggggtcagggaactccctcccctagccaagggaagctgtgagggactgtgccgtgaggaacggggcattccggcacagatactatgctttccccacggtctttgcaacccacagaccaggagattcccttgggtgcctgcaccaccagggccctgggtttcaagcaaaaaactgggcagccatttgggcagacactgagctagcagcaggagtttttttcataccctagtagcccctagaatgccagcgagacagaactgttcactcccctggaaaggggcactgaagccagggagccaagtggtctagctcagcagatcccacccccacggagcccaacaagctaagacccactgggttgaaattctcgctgccagcacagcagtctgatgtccacctggaatgcttgagcttggtgcagggaggggcgtctgccattactgaggcttgattaggcagtttccccctcacagtgtaaacaaagctgctgggaagtttgaactgggtggagcccactgcagctcggcaaagttgctgtagcaagagtgtctctctagattcctcctctctgagcagggcatctctgaaacaaaggcagcagccccagtcagggacttatagataaaactcccatctccctgggacagagcacctgggggaaggggcagctgtgggcacagcttcaggacacttaaacgttcctgcctgctggctctgaagagagcagcagatctcccagcacagtgctcaagttctgctaagggacagactgcctcctcaagtgggtccctgacccctgtgcctccggagtgggagagaccttccagcaggggtcaacagacatctggtgggtgcccgtctgagacgaagcttccagaggaaggaacaggcagcaatctgtgctgttctgtagcctgcgctggtgatacccaggtaaacagggtctggagtggatctccaacaaactccagcagacctgcagcagaggggcctgactgttataaggaaaactaacaaacagaaaggaatagcgtcaacatcaacaaaaaggacatccacacaaaaaccccatccgaaggtcaccagcatcaaagaccaaaggtagataaatccatgaagatgaggaaaaaccagtgcaaaaaggctgaaaattccaaaaaccagaacaccttttctcctgcaaaggatcacaactccttgccagcaagagaacaaaactggatggagaatgagtttgacgaatttacagaaggaggcttcagaaggtgggtaataacaaactcctctgagctaaaggagcatgttctaacccaatgcaaggaagctaaaaatgaaaaaaggctggaggaattgctaactagaataaccactttagagaagaacataaatgatctgatggagctgaaaaacacagcacgagaccttcgtgaagcatacagaagtatcaatagctgaatcgatcaagcagaagaaaggatatcagagattgaagatcaacttaatgacataaagtgtgacgtcaagattagagaaaaaaagaatgaaaaggaacgaacaaagcctccaagaaatatgggactatgtgaaaagaccaaacctatgtttaattgatgtacctgaaagtgctggggagaatagaaccaagtttgaaaacactcttaggatattatccaggagaacttccccaacctagcaagacaggccaatattcaaatcagtaaatacagagaacaccacaaagatactcctcgagaagagcaaccccaagacacataatcatcagattcaccaaggatgaaatgaagaaaaaaatgttaagggcagccagagagaaaggtcggtttactcacaaagggaagcccattaaactaatagcagatttgtctgctgaaaccctacaagccagaatagagtggggggccaatatttaacattcttaaagaaaagaattttcagcccagaatttcatatccagccaaactaagcttcattagcaaagaagaaataaaatcctgagagacaagcaaatgctgagcgattttgtcaccaccaggcctgccttacaagagctccagaaggcagcactaaacacataaaggaaaaaccagtaccagccactgcaaaaacataacaaactataaagaccaccgacactatgaagaaactgcatcaactaacaggcaaaataaccaactagcatcataatgacaggatcagattaacacataacaatattaaccttaaatgcaaacgggctaaatgccacaattaaaagacacagactggcaaattggatagagtcaaaatccatcattgtgctgtattcaggagacccatctcacgtgcaaagacacacataggctcaaaataaagggatggaggaatatttaccaagcaaatgg

SEQ ID NO: 730016 - DNA, 1416 bp, Homo sapiens
aaaaaaagaatgaaaaggaacgaacaaagcctccaagaaatatgggactatgtgaaaagaccaaacctatgtttaattgatgtacctgaaagtgctggggagaatagaaccaagtttgaaaacactcttaggatattatccaggagaacttccccaacctagcaagacaggccaatattcaaatcagtaaatacagagaacaccacaaagatactcctcgagaagagcaaccccaagacacataatcatcagattcaccaaggatgaaatgaagaaaaaaatgttaagggcagccagagagaaaggtcggtttactcacaaagggaagcccattaaactaatagcagatttgtctgctgaaaccctacaagccagaatagagtggggggccaatatttaacattcttaaagaaaagaattttcagcccagaatttcatatccagccaaactaagcttcattagcaaagaagaaataaaatcctgagagacaagcaaatgctgagcgattttgtcaccaccaggcctgccttacaagagctccagaaggcagcactaaacacataaaggaaaaaccagtaccagccactgcaaaaacataacaaactataaagaccaccgacactatgaagaaactgcatcaactaacaggcaaaataaccaactagcatcataatgacaggatcagattaacacataacaatattaaccttaaatgcaaacgggctaaatgccacaattaaaagacacagactggcaaattggatagagtcaaaatccatcattgtgctgtattcaggagacccatctcacgtgcaaagacacacataggctcaaaataaagggatggaggaatatttaccaagcaaatggaaaggaaaagaaaaaaagcaggggttgcaatcctagtctctcataaaacagactttaaaccaacaaagataaaaaaagacaaagaagggcattacataatggtaaagggatgaatgcaacaagcagagctaactattctacatatatatgcacccaatacaggagcacccagattcataaagcaagttcttagagacctacaaagagacttagactctcacacaataataatgggagactttgacactccactgtcaatattagacagaacaatgagacagaaaattaacaagaatattcaggacttaaactcagctctggaccaagcagacctacagaactcagaacttgaactcagctttggaccaagcagacatctacacaactctccacttcaaatcaacagaatatacattcttagcagcaccacatcgcacttattctaaaattgaccacataattggaagtaaaacactacacaccgaatgcaaaagaacggaaatcacaacagtctctcagaccacagtgcaatcaaattagaactc

SEQ ID NO: 730017 - DNA, 819 bp, Homo sapiens; identical to SEQ ID NO: 411856

SEQ ID NO: 730018 - DNA, 745 bp, Homo sapiens
aggatcaccatttatttcctatttagatatactgacattcatccatatgaaaatatgcaggtcattagcttactataattttactatttacttttgacttaatggggcataaataaaactttcttagtacacatgaggtggatatttgatacacagaacatttgtggtgggctttctgtgggttagatgtaaagcccacgtattttaatattcactattttaaatgagcaatgcatgaggggaatgcagtgtcagtacctggcctatttttaaactagtgtaatcaccctagtcataccattcagtatgtttgctttttaaaataagtaaccacaattaagttgttgtagcccttgcacttcaagagatttagtccttcctttcagttgtctgttaggtccattctgtttactagacggatgttaataaaaactatgtgagcctgaacgtattctcggccaaatttagtcttgtctctcatcttgattggattaattctaaagtctaaaatgattcagtccacaatagctctaggggatgaagaatttgccttactttgttgttcgctcagttcctaagactgtgagttgtcaaatccctagactgtaagctcttcaaggagcaagaagcacattttctccgtgtcatgtaatttttctaaggtgcttggcagcactctgtaccctgtggagtactcagtaccttttgtttgatgttgctgacaagacctaaaaaacaatccctt

SEQ ID NO: 730019 - DNA, 806 bp, Homo sapiens
tgttgttttacaccgtagataaccaggcaggcagaattcatctccgaggaactggttctttttccttgaaagctgattcatggccctttggttatggcaggaagggtcccagttcatctgcagagatgagctgctctgcacagaggagcgataggaattcaggagttgtcttcttgcagctaaatgatgagttgtaggggtaagattggaactgggagaagagaggatacaggagaaaagcttgagtaaaaagaaggtgaaatggtagaaagctggactctaagaaggaaagtaactggtgagaaattctgacggatggccaaggaactcgaggaatggagatgtctaatgttctattttaagttggttcctgctccttggtgctgctctattacctcgaaactttcagaaaaagtctgacagaagagacagaaactataaactataatttggtttcagttcaggtcactaaatgccatttctggcatccctgaacttgtgaatgaccaatgatcatatgatcatgtgagttactatcatctctaacctgtgtacaactgccacagcatgaattagtgaaaggatacagagtaaagtcagcaaagaagaaaggctttggagcaaagccaggagaaaccacaggcttccaagtgaaccctcccggtggagttgcatgaggactcacttcattctcccagcaacagtgtgtgacaacccatggtggtgttgccaattggaaaagctcacccaagccttgttgtccaaagctcttaatgaggagtcagtcatggagacatacaaaaaaa

SEQ ID NO: 730020 - DNA, 756 bp, Homo sapiens
aaggagtggatgcccgtcaccaagctgggccgcttggtcaaggacatgaagatcaagtccctggaggagatctatctcttctccctgcccattaaggaatcagagatcattgactttttcctgggggcctctctcaaggatgaggttttgaagattatgccagtgcagaagcagacccgtgctggccagcgcaccaggttcaaggcgtttgttgctatcggggactacaatggccacgtcggtctgggtgttaagtgctccaaggaggtggccaccgccacccgtggggccatcatcctggccaagctctccattgtccccgtgcgcagaggctactaggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgagaaaaaa

SEQ ID NO: 730021 - DNA, 1516 bp, Homo sapiens; identical to SEQ ID NO: 728442

SEQ ID NO: 730022 - DNA, 472 bp, Homo sapiens
ttacaatttgttttttgttctaaaccagggttttttaaccttaacaccattgacattttgggctgggaaattctttgttgtgggggcctgtcctgtgcattttaggaggtttaagcagctctggcccctaccagtagtatatgccctttaccccctggggttgtgacaacgaaaaatgtctctagacattgccaaatgctctcttgggggacaaaatagccaccaatcaagaaccactgttctaaaccagcagtctcaaagcatggtctccatggaccactgaggtcctaagaccctttgagggaggagtgtagatgaagtcacaactgttttcataaaaatcaaagttaactgtccattttcaccgtgtcgacatttgtacttacggtgcataggcaaagtggataaaatttgctggggccctagcaggatgcaagggcaccacactgtattcttcactcacagttaaaaa

SEQ ID NO: 730023 - DNA, 962 bp, Homo sapiens
tgagactccaagatcaccccaatgctaggctaatctccatggcgcctagatctatgcccactccattccccatgttggtccccatagtttcaggcaccaggctccaacaccaggttgggccctacagccccagtctccaggttggcaccagtggatataggctttaggtccactgactgctggtccctacagccccaggttccagtgaacccaggttccaggcctgctccaacaaacccaaggtccaggtctaccccagtagaccctggcaccagaactaccccagagggcctagcctacaggctaccacccacaaacccagcctccatgatggcctctgaagaatcaggctttaggtcttccccagcaccagactagactgctagactgatgttccacttttgtccccatggacccaggcaccaggcccatctgagaggtttcttcagttttatttttcagtaataactttcattcttctttctcagtgataactgtagtactcagtgggctttctatttctggctcccattttccatctttctttttaacactttgggaaaatatccaagttaaactctatatagtggggtaggtggacaatgaaagataagtaaatacataatatgtataatcaacggagtgaaaagacagcctgcagaatgggagaaaatatttgcaaactatatatctgacaaagggttaatatccagagtatatgaagaagtcaactcaatagccaaaaaaaaaaaaaaaaaatccaatttaaaaatgagcaaaaggcctgaatggacatttctcaaaagaaaacatgatgatgactaacaaatatatgaaaaaatgctcagccaggcacagtgactcacacctgtaatcccaaagtgctgggatcttaggcgtgagccactgcacctggccaatcagttgcatttttattcactaacaatgagctatcaaaaaaa

SEQ ID NO: 730024 - DNA, 436 bp, Homo sapiens
attcaatcaccaatggccaatgatttaatcaaccatgcctgtgtcatggaacacaggaaacctaaacaacataaaaatccttaacaacagggtttggtgagcttctggattggtgaacacattgaggtggtagaaggctagagttcaggagatgacatgggaagacatggaagctttgtgtcccttcccatataccttgctctctgcatctcttccatttggctcctcctgagtttggcgtgcctctcaacatccagcagaatgtgggaatattgctgagttgagtaaatatttccttccataaaggtaaataagcatctcaagagcaagtttctacattttgtatttccctgttttatttctgtaaaattgtgcaaccaagaattatgacctactgatattagaataaaatttgcagaagtttgactacatgaaa

SEQ ID NO: 730025 - DNA, 419 bp, Homo sapiens
attcaatcaccaatggccaatgatttaatcaaccatgcctgtgtcatggaacacaggaaacctaaacaacataaaaatccttaacaacagggtttggtgagcttctggattggtgaacacattgaggtggtagaaggctagagttcaggagatgacatgggaagacatggaagctttgtgtcccttcccatataccttgctctctgcatctcttccatttggctcctcctgagtttggcgtgcctctcaacatccagcagaatgtgggaattctctgagttcctgttttggtgctaatcttcagtgtgtgtttctgaaagtaaccatgatgacaggaagcatatttttctgtatgcctatgactggtgtctgactaccctactggtactagagattaaaagacactttcctgtaattaa

SEQ ID NO: 730026 - DNA, 490 bp, Homo sapiens
atctatgccttgataggtcttcagttactcatggtgaaacatgtaagccttgaaaaactttttgtatggagttgtgctgggaagcagttttcccaccagggacaacatcttctagtccttttacatctaagtagtaccatgagactggatcatgccaaagaaatgttttggaagtgagatgtttcactttggaaccaaggaactgaaaaaacagatagagggagcccaagccaagaagagaggtctggtatcaaagatttgctgaattcacaattgaagaggcttatgtcagtcccttagaaagaatttgaggactcctcggaaaattgctgagttgagtaaatatttccttccataaaggtaaataagcatctcaagagcaagtttctacattttgtatttccctgttttatttctgtaaaattgtgcaaccaagaattatgacctactgatattagaataaaatttgcagaagtttgactacatgaaa

SEQ ID NO: 730027 - DNA, 487 bp, Homo sapiens; identical to SEQ ID NO: 242984

SEQ ID NO: 730028 - DNA, 527 bp, Homo sapiens
agccagcacggcactggagactcccgtgagcatgttcactgctgcgatgaccccaattaacagtttaatgggggaaatgtacagaggggatctgaaaactgttgaagtcaccaaagcattacaagatgccaagagataatggtcaaaaacagcctaataacacacagtgcccatgtgcatgctccactatctcaagccactgtcaccctggatcttttgcagcactggctggaatcagtggtggatactgccgttgaggaatttttgatgcctttctcacctggggaaggtgaacactgcactgaatgaagggctttcaggtcttcctcaaagtcaagcaggaaatcttcaaggtcacgttcatctgcagcccaagaagtcctggaatgattagttctgactctcttttcaagggaccaaatcccagagtggagagtcctgggttattctggagacatgaactgtcacaaattccttgtgctctagctttcttgcaagttattataaagttgcctttggatgtttga

SEQ ID NO: 730029 - DNA, 516 bp, Homo sapiens
ggaaaaatcccatgggaccagatcctgccaaattcttccagctcactttattctcagcattcctaggacattggacattggttttctggagggttttttttccatctttgtatttttttaaatttgattcttttctttgcaatgctatctaaccagaatacataggggaactgtgggctaggcaaacaaaatagaaaaaagtgtgaaaaacagtaaagttgggagaggagcatctattttcttaaagaaataaaacacccaaaacaatataaagttgtccagaatgtatgtcaagaattttagataggcctttcagtaacacaggtgaagaaatttttaaaaatacattgattattatctaggttagacttaaagtgaatctcaaataaaagaatcaggaatacaacttaagtgatcatgaggtccttccatatttagattgggtaagcatgaatgtgtattttctacaaaagaccttgagaagagttcaataaaaaatgttagcattaaaaaaaa

SEQ ID NO: 730030 - DNA, 1291 bp, Homo sapiens; identical to SEQ ID NO: 30507

SEQ ID NO: 730031 - DNA, 1992 bp, Homo sapiens; identical to SEQ ID NO: 289229

SEQ ID NO: 730032 - DNA, 1756 bp, Homo sapiens; identical to SEQ ID NO: 245200

SEQ ID NO: 730033 - DNA, 1316 bp, Homo sapiens; identical to SEQ ID NO: 245154

SEQ ID NO: 730034 - DNA, 388 bp, Homo sapiens
cttgttttacaggttcacaggaagcacctggcacacagtaactattattaatttctgcactggaggcatcaggaaagccttcacgctatagggggcccttttaagttaagaagttggagagcaagcctcggggaaagcaaagagataacttagtagaatggagcaaccatacgggaacagtgagagtccatggatctccctgggctaagatcatgtatggatttggcaatctggggtggaagccacatgtgctgttattaagtggaaatgtctcgtgaacatgtggaaagtgatgactggaacttcagatgaaagtcaaagctggagataggagattcagaagtcaccccaccaaagaaggaatggttaaagctataagaactaatga

SEQ ID NO: 730035 - DNA, 872 bp, Homo sapiens
ttgatgatcattgtgggaaactttaatatctgtgtctcagccactgaaaaataaacaaacatcagtaagcacatagaatctttaaaggatgcatttaacacactggacctaactgagatacgtggtacactacgctcaacatgcagaatacatatccttttcaagtgcagaagcaatatttataaaaattaatcatattttcaatcattgagaagacacaaattccacagagttttagttatacaaatatttaatcacagtggaactataagtttggaaattaagcaaaacattttcagtatggtaaagggatgaataaaatcaaagtttgcttttttgaaacactaataaaattgatggcctccagcaagattgattaacaaaacagacaaaaggcacaaactctaaccggagactttataagtattaaaaagataaatgaataatagaataactttgaaattttcgataaaatgaacaaattgattcagcaaacacaggttaccaaaatgaatatttatatatatgtaattgaacctgtagttaaacaccttataaagaaaactacagtctcacatggcttaataagtgaattctttccaaatgcttaaggaagaaatagcacacatcttacataaactctgtcagaaataggagaagaaacattttccaaattgtctaaccagcatagctttaatacttcatattaaaacctcacaagtctgggcgtggtgtcatgcgcctgtattcctagctattagggaggctgaggcaggagaatcgcttgaaccatggaggcggacattgtgacagtgagccgagattgtgccactgtactccagcctggcaacagagcaagactgcgtttcaaa

SEQ ID NO: 730036 - DNA, 418 bp, Homo sapiens
gactttataagtattaaaaagataaatgaataatagaataactttgaaattttcgataaaatgaacaaattgattcagcaaacacaggttaccaaaatgaatatttatatatatgtaattgaacctgtagttaaacaccttataaagaaaactacagtctcacatggcttaataagtgaattctttccaaatgcttaaggaagaaatagcacacatcttacataaactctgtcagaaataggagaagaaacattttccaaattgtctaaccagcatagctttaatacttcatattaaaacctcacaagtctgggcgtggtggctcaagcctgtaatcccagcactttgggaggccgaggcgggtggatcacgaggtcaggagatcgagaccatcctggctaacaaggtgaaaccccgt

SEQ ID NO: 730037 - DNA, 2481 bp, Homo sapiens; identical to SEQ ID NO: 247170

SEQ ID NO: 730038 - DNA, 1228 bp, Homo sapiens; identical to SEQ ID NO: 247171

SEQ ID NO: 730039 - DNA, 2280 bp, Homo sapiens
aaccggtaaacgccgccgtttgaggagcaccggagccgcgaccgtggattgaacgcttccccagagacccagaagcagaaggagcggacccaggcagccggcaccatggagattgtgtacgtgtacgtcaagaagcgcagcgagttcgggaagcagtgcaatttctcggaccgccaggccgagctgaacatcgacatcatgcccaaccctgagctggccgagcagttcgtggagcggaacccagtggacacgggcatccagtgctcgatcagcatgtcggaacacgaggccaactcagagcggtttgagatggagacccggggagttaaccatgtcgaggggggctggcccaaggacgtgaaccccctggagctggagcagaccatccgtttccggaagaaagtggagaaagatgagaactacgttaacgccatcatgcagctcggctctatcatggagcactgcatcaagcagaacaatgccattgacatctatgaagagtatttcaatgacgaggaggccatggaagtgatggaggaggacccttcagctaaaaccatcaatgtgttcagggacccccaggaaatcaagagggctgccacacacctctcctggcaccccgatggcaacaggaagttggcagtggcatactcctgcttggattttcagcgggcacctgtgggcatgagcagcgattcatacatctgggacctggaaaaccccaacaagcctgaacttgctctgaagccatcgtctccactcgtgacgttggagttcaaccccaaagattcccacgtactcctgggtggctgctacaatggacagatagcctgctgggacacccgaaagggcagcctggtggcggagctatccaccattgagtccagccaccgagaccctgtgtatggcaccatctggctgcagtcgaagacgggcaccgagtgcttctcagcttccacggatgggcaggtcatgtggtgggacatccgaaagatgagcgagcccactgaagttgtgatcttggacatcaccaagaaggaacagttggaaaatgccttgggggccatctccctggagttcgaatctactttgcccaccaagttcatggtggggaccgagcagggcatcgtcatctcctgcaaccgcaaggccaagacgtcagctgaaaagattgtgtgcaccttcccgggccatcatggccccatctacgccctccagagaaaccccttctacccgaagaacttcctgacggttggcgactggacagcccgcatttggtctgaagacagccgggaatcgtccatcatgtggaccaagtaccacatggcttacctcactgatgctgcctggagccccgtgaggccgaccgttttctttaccaccaggatggacggaaccctggatatctgggacttcatgttcgagcagtgcgatcccaccctcagcttgaaggtgtgtgacgaggccctcttctgcctccgggtgcaggacaatgggtgtctcatcgcctgcggctcccagctggggacaaccaccctgctggaggtctcgcctgggctctctaccctccagaggaatgagaagaacgtagcctcttccatgtttgagcgtgagacccggcgagagaagatcctggaggccaggcaccgggagatgcggctgaaggagaagggtaaggcggagggcagggatgaggagcagaccgatgaggagctggccgtagacctggaggcgctggtcagcaaggccgaggaggagttcttcgacatcatcttcacagagctgaagaagaaggaggcagacgccataaagctgacgccagtgcctcagcaaccaagtccagaagaagaccaggtggtggaggagggagaggaagcagcgggggaagaaggggatgaagaagtggaagaagacttagcctagaagtcagccttcgactgcggcgctatccctgtgtgccttcctttcccacctcttgaccctcaaccagacttgcatggccatggcagggcctcgggaagaccttcaggagtggggaagggtttctcctccatgatcgaccctcctcgtccacctacaaatcaggaacagaaagtctgtccactttgaaaatacctttccaggcagctccctgaccatttggacacattgccacgacaggagcctccaagtatgtgggaggggacgggcgggacgagcttggctgttctgctgcacctgaatgctttctgttatcctaattcttgtaaaattaaatgaatcgtaacaatgccaaagtta

SEQ ID NO: 730040 - DNA, 970 bp, Homo sapiens
aaccggtaaacgccgccgtttgaggagcaccggagccgcgaccgtggattgaacgcttccccagagacccagaagcagaaggagcggacccaggcagccggcaccatggagattgtgtacgtgtacgtcaagaagcgcagcgagttcgggaagcagtgcaatttctcggaccgccaggccgagctgaacatcgacatcatgcccaaccctgagctggccgagcagttcgtggagcggaacccagtggacacgggcatccagtgctcgatcagcatgtcggaacacgaggccaactcagagcggtttgagatggagacccggggagttaaccatgtcgaggggggctggcccaaggacgtgaaccccctggagctggagcagaccatccgtttccggaagaaagtggagaaagatgagaactacgttaacgccatcatgcagctcggctctggacccccaggaaatcaagagggctgccacacacctctcctggcaccccgatggcaacaggaagttggcagtggcatactcctgcttggattttcagcgggcacctgtgggcatgagcagcgattcatacatctgggacctggaaaaccccaacaagcctgaacttgctctgaagccatcgtctccactcgtgacgttggagttcaaccccaaagattcccacgtactcctgggtggctgctacaatggacagatagcctgctgggacacccgaaagggcagcctggtggcggagctatccaccattgagtccagccaccgagaccctgtgtatggcaccatctggctgcagtcgaagacgggcaccgagtgcttctcagcttccacggatgggcaggtcatgtggtgggacatccgaaagatgagcgagcccactgaagttgtgatcttggacatcaccaagaaggaacagttggaaaatgccttgggggccatctccctggagttcgaatctactttg

SEQ ID NO: 730041 - DNA, 235 bp, Homo sapiens; identical to SEQ ID NO: 247174

SEQ ID NO: 730042 - DNA, 663 bp, Homo sapiens
attcggagcctccttccacatcacctttccccagcccagcagcacaaaaccaatcagctgacaaactcatttccacctctcaaggcctctcatattaatccctcctttccacacatatactgccctagctcagaccctctcatacttcttaaactgacacagacaacctcacttggaggctaactggtctccttatctttaatcccaaaatacacctatttaccacacagatccaaaacctcgtaactcctttctcaaaatcctgtaatgccctgtcaattgcattcagaagaaaaccaccttttcatcctttctccctttaagagcacattggtaagagtgtaaatcccagttctaccacttagtaggtttatttcatttgtaacctctatctcatttgtaaaaaaaaagaatcatagtactctcttctcaataaaactgttctaaggaaataattaatactaataaagcactgagaacaatgcctagcacatagaaaatgcccaaaaaaggttattattgttatccaaaccctatcctgcctcaccctacagactacttgtacttttataagtatttattctacagatttattgagtccttatgactaggagatgaagatacaaatatccattaaaaaatgttccgcattatctggccttc

SEQ ID NO: 730043 - DNA, 441 bp, Homo sapiens
gaaaaaggtaaaatgcattttaaatcaataataaatgtacagaatattaaaatcataagaatgcacagtgatgcatgcctctaatccaaactacttgggaggatgaggcaagaggatcacttgaggagcccagaagtttgagaccagcttgggaaacatagtaagactctaccttcataaaaaaattgtgcacacttgtgtgtatgctttagatcctgttttttgttgttgttgttgttgttgttttggtttggtttggttttttaaagcataagactgacgctttgttacaaagcattcctttgggagcatgcctgggacgttattagaattaacattcattatatgtattggtaggtaattaatgcagtaagaactcttccctctgtatttattagatgcaaagaagaatacatttattaaaatttggtatctacaagt

SEQ ID NO: 730044 - DNA, 940 bp, Homo sapiens
  misc_feature (899)..(899): n is a, c, g, or t
  misc_feature (912)..(912): n is a, c, g, or t
  misc_feature (932)..(933): n is a, c, g, or t
agcggatttttgacttcaactacaagagagatgccaagctgagaccagttaagccacagaactctttcagaaaagtcatatttttctcaaatgacctagcttttaccttcgttaactcaaacctgcacccatctgaagtgaaaccagcaaccatttaacagcaaacagtagcagcagcatgcaccaaaagagaatggaaagtgaaaagaacacaacagatcattttaaaagtagtgtgtcaattgcctggttctccactgacagctaaaattaaacaaaaaagtgaattccgttctacagtgtgaccatcttatgggaacactagaggatatccatagacagcagagaaaaaatagcaaaatagatattttgactcacagaaaatgaatgtttgcaaagattcaccaagaaataaagtcaaccaaaaaagcaaagtcatggaaaagaaatgcaaatctccacaaaaggcagcttttcagggctattcctgtctacacgccctctgaataaccatctcaaaatatgttcaagaagtatattttggaggtggcattgcagatgggatctcaaagccaagtctctacatatgatacaggcaaacagatgtttacatgacttgctcctccttgccttctgccatgattgtgaggcctctccagccacatggaatttttttcatccagtgactaccaaatggaggaattatcgtcttgaaggggaacgtatcaatcacttaaggaaactagatgggagactgaaggtggcaaaaggagaggcatagcaaatggaagaaggtgtcctagagtcactcttaaactttgagaagtttgagatattaggttggtgcaagagtaattgcaggttttaccattacttttaagagcacaaggaccaaacanatgaatatttacnctaaaaaataaactagagtnncttcaaa

SEQ ID NO: 730045 - DNA, 1276 bp, Homo sapiens; identical to SEQ ID NO: 244331

SEQ ID NO: 730046 - DNA, 524 bp, Homo sapiens
gtgtcttcagcaggctccagtccaaaagtggcctctatgggcaccacctcctgctctgctgccctgcctcgctttcctcctcggccttcccggatggatgacagatgtcattcccaggttccctaacactcaagcctagcccctcagtttctagcaagcatcaagcttcactgtgtgcctagcctctcaggagtcagacctgagaagtatagcttggtggaaattcagtggcagggaagaaagaaggaaggaaagaagaccctgagctggattcatacacatcatcgcaattcatccacaccacagtcctgtaagaaggctgcaaaacatacagcagaaaggatggcttgaaggcaattgatgtttgtaaaaaaatccacaacaggatccaagctgaagaggtgaacacgtcagcctggtgggacaattctcagcatgtgcaaacataggtaaattctagcctatgttacattaaaaacaatgtcactgcattttttcatgttaaagtttttttcaaagctaaa

SEQ ID NO: 730047 - DNA, 770 bp, Homo sapiens
gcaccggctgttggagtgccggtccagggtccaacatttagtaaccaacatcaaatgtacttgtctctcctaagctgcacagactgccaagtctctcgtcaggtcttcgccacaaatctctgtccagaggatcgtggctgaggcaccatggaatgctgctgttctactggagatgcaatttcatccaaaagaaaaagggaaaagtatccaaaagtctttctagtctccaggcatttagaaaagctttagaacaagatctgcactggcacaagaatttgagtggaaatcaccctgcccagctgtgagccccggggcgggtgagccacacacttggatctcactgcagttgtggcctctgggaagaaggctttgaatgcagattttaaacaggtactcaactcatactgagccacggctactttcaacttaacaatatgtgagaaacccatctgatcactgcagacctgctgaaatctgttacaactaatccttcaatcctcaccagaatgctggctgtcctgcctctgccgtcccgagagaagatgaaagctactgggtggccacagggcagttatgtccccttctctaggttctgtgattctggcagttagaatgggtttccagacttttacaagcagaaacccttatacatgtgattatatgctgtccgtcaacatgtaaaacaggccaagcgtggtggctcacacctgtaatctcagcgttttgggaggccaaggtgggaggaccacttgaggccaggcgtttgagac

SEQ ID NO: 730048 - DNA, 892 bp, Homo sapiens
tttttttttttgtatttagtagagacgcggcttcaccatgttggccaggctggtctcgaactcctgacctcaggtgatctacctgccttggccttccaaagtgctgggattacaggcgtgagccactgcacctggccaaagttttttttttcttcttttttttagtattaacaactttgaccaggaaaaacaaaccctgcttttcctttacagtctctcgtcaggtcttcgccacaaatctctgtccagaggatcgtggctgaggcaccatggaatgctgctgttctactggagatgcaatttcatccaaaagaaaaagggaaaagtatccaaaagtctttctagtctccaggcatttagaaaagctttagaacaagatctgcactggcacaagaatttgagtggaaatcaccctgcccagctgtgagccccggggcgggtgagccacacacttggatctcactgcagttgtggcctctgggaagaaggctttgaatgcagattttaaacaggtactcaactcatactgagccacggctactttcaacttaacaatatgtgagaaacccatctgatcactgcagacctgctgaaatctgttacaactaatccttcaatcctcaccagaatgctggctgtcctgcctctgccgtcccgagagaagatgaaagctactgggtggccacagggcagttatgtccccttctctaggttctgtgattctggcagttagaatgggtttccagacttttacaagcagaaacccttatacatgtgattatatgctgtccgtcaacatgtaaaacaggccaagcgtggtggctcacacctgtaatctcagcgttttgggaggccaaggtgggaggaccacttgaggccaggcgtttgagac

SEQ ID NO: 730049 - DNA, 796 bp, Homo sapiens
atgaactatatcttaagaattcataaagccctaaaaagtaaatatttacaaccagaaatctttctgacaaagaaacaagattactcaaagtaagtagtagtttgggctccctggaaagaacccagaacttaagtgtcaggaaatgtggatagttctgaatgtgcccctggctggttgatgactctgggcaacttatgcagtacctctaactcatggtttatttacctgaaaaataagtgggttggctatgtctgtggtttgaaaggtgctctatgatgtcccagatgtcttagcagtgtatcattggctgttttggaggctgtcaggggtccagatggctgctcccactgagcctgcttttaacagagcttttcagtttgtatttcttgtatacacaaagtaatattaaataaaaaaaatataatccagctaagaaagtttgagaatactggcttgagattcaaaataaaataaaccaaaaattttagaaattatattagtctagaaagatagtattgtgtctcttgtctttttagtacctagcacatatcaggtacttgatacatatttatcatatgaatgcaatggttgtatgaacaactgggaaggaaatgcaaagcagaaggcaccatatttgtgttgctatcctgggtgtcatttctatgttacttgtgataaccagtagtaaagaacaacatggactatgtttaatagacaacaactaattttattggatttgtgtacataatctgaaatttagtctaaggacaagccatattactataaattccaggaa

SEQ ID NO: 730050 - DNA, 520 bp, Homo sapiens
tctagaacaagcaaaaccaacctatagtgaaaaagagcagtggttgcctttgtaggggaggaggaaagtggaaactgactagaaagggtcgtgaggggactttctgaactgatgatgatatgccgcatcgtaataggattacacagttacatgcatttgtcaatgctcaggaaatagcccacttaagttgtgatttcattatatttaggttttacgtcacacacacaaaaagaattataggctggccatggtggctcacacctgtaaccccagaactttgggaggccaaggtgggtggatcactttagcccaggagttcgagaccagctgggcaacatgatgaaacgccatctctacaaaaaaaaaaaaatacaaaaattagctgggcatggttgtgcatgcctgtgatcccagatactcaggaggctgagatgggaggatcacttgatccccggaggttgagggtgcagtgagccttgattgcacaattgtattccaacctgagggaaagcctgcctca

SEQ ID NO: 730051 - DNA, 583 bp, Homo sapiens
aataaaaatctggaggattttgcatccggattgctcttttccttttccctgctcttcccagaaccccctcccaagtccatattggaaagtgggggcaatgtgctgagtggttccctaaaaaggaaaatatggaacccaagttagcagctcctggtcgaagaaaaggacagcaataggacagacccaaatggcaaaggcaaagacgggagaatgactgtgcagttgtgttttctgtaaaaacaaaaatttatgcacaaccatacatctttcagattctccgctgtaaccaacctccaggtcacagccacaggacttcccacggacttcccctgctcttaaagcaaactgcagaaccaagcgtggacttctgctcctgagggggacggaaggacagtcccctgcggtcatctctataggagatgggggccatgggtgggagagaaactccctgttgcactttgtagccctcagtatgattaaagtgtttaccatgtacataaattatgctttttaagttcacatgtcttatatacttttacgttactttttaaaattaaaagacagttaacttttaagaataaat

SEQ ID NO: 730052 - DNA, 466 bp, Homo sapiens
caccccatgcggtcaccagcagacagccgctttctgcacaagttccaagatggactcacagcagtccccgccagccatgacgctgagatgggtgtacacccagctctggaggaacccaaccgcctgtggtctctccacaacggctgcaaaatactattctccgctgtaaccaacctccaggtcacagccacaggacttcccacggacttcccctgctcttaaagcaaactgcagaaccaagcgtggacttctgctcctgagggggacggaaggacagtcccctgcggtcatctctataggagatgggggccatgggtgggagagaaactccctgttgcactttgtagccctcagtatgattaaagtgtttaccatgtacataaattatgctttttaagttcacatgtcttatatacttttacgttactttttaaaattaaaagacagttaacttttaagaataaat

SEQ ID NO: 730053 - DNA, 599 bp, Homo sapiens
aaattttggaaacaaaggctccttacagaatatttcaaactgatgctatcaaaagttttgttcgacagctcaacctttatggatttagtaaaattcaacagaattttcaaagatctgcctttctagccacctttctgtcagaagagaaagaatcgtctgtcttaagcaagatacgcttcaccaaaatgaaactttccagatcttcaacttatgaaaacaggtatttatgttgcaacttacatttaaaagatgagtcgaattactcataatccttagaagttagcttgtccgcatctgaaaattcacttttaccttgaagttcaatctgtctctgggaaagactagattggaagaataaaattcaagaatgtgatgttttagtaatggaaaagccaagagcgtcaggtggcaaaagtccttctgttactcaagaaaatgctctgaaaaattccttttctcttttttttttgtaaagattaactccacctcaccaccacaatgaggtatttttctcagcaattgacacctgtttactcagttactccctgtaactatgttatgctgtgaagtaggcaatacagttgttaaagaagaataaa

SEQ ID NO: 730054 - DNA, 560 bp, Homo sapiens
aaattttggaaacaaaggctccttacagaatatttcaaactgatgctatcaaaagttttgttcgacagctcaacctttatggatttagtaaaattcaacagaattttcaaagatctgcctttctagccacctttctgtcagaagagaaagaatcgtctgtcttaagcaaggtatttgacatatttgagttaccactttatgtaaagtatatatgtaattttactttgtacatcagtaaatatgttaatacatgcagtaagaccagcttttgaaaattatataaaatattaaggtagaaattttgttttgaaattattgtgttcagcttgagcgttaaccttttagtgttttaagaaattttgctaacaactttgaatcttaccagtgaattccaaataaatgtaccaaagccacttaatgaaatattactattaatatataacatgttttcacttgagggcttaacaacttgagtggtttttcacaataagcacattcttaaaaatagtaaacgatgtttatgagttatttgatgacattaaatttgtgtgatgaaagag

SEQ ID NO: 730055 - DNA, 716 bp, Homo sapiens
cacccccagttccaccaccagtttatcaagaataccccagtggaccagaaattacagaaatggatgatcctagtgtggaggaggagcaggctttcagggctgcacaagaagcagttctactcgcagctgagaatgaagaatctgaggaagatgaagatgaggaagatgattatgactaataaacataaaattagcctggttttatgtgacactgatacacacacaccccttatatgggactaattttacacttttctgtgttatgtgtgtatatacatacacatgtaagaaattattcaactgcaaaatctcaatcttgaaaatcaagcttgaaatttcataggtagaaatattagcatttttattgaaagatactcacaggattttccagaggctaaataacatgcaattgcataattgttctgagggttatggataatggaatatgtgtttgtacattcctgtttttaaaagggctcaggtttcacatggtccaggtgaggtaaaacaattaaaataaataaataaatggtctcaggtttaatttgtaatacgacaaacactggaagatataacccacaggaaattcttggaaacatcaatactttttaaagagtgtcaaggggtatgaagacaaaaaatattgatagtcactagagtaatgtattcttaacctttgtaagaactgatctcagcatgtattcttaaacctttgt

SEQ ID NO: 730056 - DNA, 514 bp, Homo sapiens; identical to SEQ ID NO: 728445

SEQ ID NO: 730057 - DNA, 695 bp, Homo sapiens; identical to SEQ ID NO: 252636

SEQ ID NO: 730058 - DNA, 477 bp, Homo sapiens
tagcaatgtctactaaagaaaccaactggcttcttcctgttcgcccacctttcctttgtttattgatatttccaccagaggaaggaccaggcaaaagggagaataaattcactttttaagataatgcttctgagttttagcacagcatcccacttcccgggaagctttattgccaaggcaataaggagaccatgtgagtaggagttaaatgcacagccatttgtgaagtgagactgcttgggttcagatcttgattctgccctttattctatgttgtggaatatattacattgtgctgtgcctcttttaccttatttgtaaaatagagcaagcacccaactcaagcagttgttgcaagaactgcctgctatgctgtttaatacagtatgtggcaaatagcaagtgggtagtaaatgttaataatactgtttggattctcattttacatatgagaaactgaggtttaatgaagttaaa

SEQ ID NO: 730059 - DNA, 452 bp, Homo sapiens
tagtgccacctgcctccccagtggcccaggaacctcctgactgtcctctccctctggttaccgttccctccttcacaagcaccgcttccacctccccggaccccgtgcccgagtcccccgccgtgctgtgctacttccccatctcctgccccactccggctgagacccctgtgctgtgccttcagggccccagaaggcccagtaggatttacctcatgtggtaagtcactcttgcaaggcacacagcacagcgcagtcggggagaggggacttcgggcttccggaaggcaggtggacaggagaggggccagaggccacaccaagaacaataccaggcggcgtggtgttcgggggagcaggaagatgggacagcgtggccactgcactggggctgcaccttctagcgccaaaggagcgagcgaccaataaaatcccatcctctctggaactca

SEQ ID NO: 730060 - DNA, 536 bp, Homo sapiens
agcagtgcttgggtatcgaggctctgagactccggcctcacctctccacggggtcgaagggaacctctcctgatgacagcagtcgcaaagggccgaccatgatgatgaaaccccaggcggagacgggggaagcagcacgggatcccagcctcaggcctgcacggacggtgttggttgggggtaccttgggacagagggagtgcagagcagagaaaacctacctgtgcaactgagaaggccgctcaggccacggggacagggcaggaatgctctcaggagtgtcccctgaacctgaacttgatttcacgccatcaccttccacctcttaaccagcatctcctggacagtcagccgagtgtttccatgataccagccatacctgatgccaggagactcgctacacttggaagctcttcaaggcatgcttatctttgtgaactgaatcttggagaagcaggattgaaaataagagctatctttgaggctctagcacctacaagagacaccctccctctccaccatggatcacctgtctc

SEQ ID NO: 730061 - DNA, 707 bp, Homo sapiens
agcagtgcttgggtatcgaggctctgagactccggcctcacctctccacggggtcgaagggaacctctcctgatgacagcagtcgcaaagggccgaccatgatgatgaaaccccaggcggagacgggggaagcagcacgggatcccagcctcaggcctgcacggacggtgttggttgggtcactgtcatggctaagaaagcaactccaacccacacactgcaaatatgaaggaccacgaaaggcacgcaggctctggtttgcatagtgaagatgagcgtctgtgttcctaagcatgaaggaggaccacatgagtatcctggacacctactgcatgaatgtattcgccctttcagatctagggacctgggtaccttgggacagagggagtgcagagcagagaaaacctacctgtgcaactgagaaggccgctcaggccacggggacagggcaggaatgctctcaggagtgtcccctgaacctgaacttgatttcacgccatcaccttccacctcttaaccagcatctcctggacagtcagccgagtgtttccatgataccagccatacctgatgccaggagactcgctacacttggaagctcttcaagatgtgtattgaatttgcagaaggcctcttttccaaatgatcaatgaatttcaacaccagagtcttggagtcagacaaggaaactttcagtacataggtag

SEQ ID NO: 730062 - DNA, 365 bp, Homo sapiens
ggtaccttgggacagagggagtgcagagcagagaaaacctacctgtgcaactgagaaggccgctcaggccacggggacagggcaggaatgctctcaggagtgtcccctgaacctgaacttgatttcacgccatcaccttccacctcttaaccagcatctcctggacagtcagccgagtgtttccatgataccagccatacctgatgccaggagactcgctacacttggaagctcttcaaggtgggactttctgtcttgttcagtttttcattctcagtagtcaacacaggaccttatacttaaaggaaataagtataatgtcctaacaagtgcttctggaataaatgatcatggctgaaatgaga

SEQ ID NO: 730063 - DNA, 197 bp, Homo sapiens
ccaggctctgaggctccggcctcacctttccacggggtcgaagggaacctctcctgatgacagcagtcgcaaagggccgaccatgatgatgaaaccccaggcggagacgggggaagcagcacgggatcccagcctcaggcctgcaccgacggttttggttggggtgagtctcaccaaaagtcgtgccgccgtccgtg

SEQ ID NO: 730064 - DNA, 465 bp, Homo sapiens; identical to SEQ ID NO: 208582

SEQ ID NO: 730065 - DNA, 1221 bp, Homo sapiens
aagtgaggagcgtctctgcccggccgcccatcgtctgagatgtggggagctcctctgccccgccgccctgtctgggatgtgaggagcgcctctgcccggccgcgaccccgtctgggaactgatgagtgtctctgcccgatcgccaccccatctgggagaggaaaggccatgtaaggacagagcaaacaggcaactgtctgcaaaccaggaagagaggcctcaccagatatcaaccttcatggcaccttgatcttgatctttccagactgtgagaaaattaacttctgttgttgtttaagctgccctccaactccgtctgtagtattttgttacggcagcccaaacagactaatacatcaagtaaccacacaaatgcatgtacaattaaaactgacctaactgttaagaagaggagatagggcaagagtatatttatcgagggtattctatctggtcagagatgagagagaaagatttttctgggtaaagttaacaaggtatatagggtggggtgaatatggagtggggaatggtcccagatagggccaattgcttgtgcaaaggccctggggtgagacagagcacagtttattagagaaaccaagtggcagctgtgtgattggggtgctaagagtgaagaggaaggtgatacaggtgagggtggagaagagggtgaggcctaacttcccaggaccatgcaggattttcactgctaacttgggccacttgcacaccagactggagctggaaatggtgggtatgggagacagagatcaaaataacctctagatgtccacttgcatagctggtaggtcacgggaccattcatgatagggaagcccaggagagaaccagatttcaaagagaaagtcatgaatttgcacgtgtcaagcttgttgtgcttttgagtcacttagaaagagacatttgtttgcggacctatctacaagtctagactcagacagagacctgagtcatgtcattacactgacaaggtgggagaggtgattcaggacagtcattctcagactttgagtttcaagacccctttacactcttaaaaaccatcaaggacctcaaagagcttctgtttatgtgggttatatctgtccatatttactgtattagaaatgtaaactgaaatattaatattaatttataataaacctgttttaccttaacataaaaaaaagaaataaaacatgcaaaaataaaaaacta

SEQ ID NO: 730066 - DNA, 360 bp, Homo sapiens
  misc_feature (261)..(261): n is a, c, g, or t
ttttttttttttgagagagtctctgtcgcccaggctggagtgcagtggcacaatctcggctcactgcaacctccacctctggggttcaagcagttctcctccctcagcctcccaagtagctgggattacaggtgtgcaccacccacacctggctaatttttgtatttttggtagagacggggtttcaccatgttggccaggctggcctgagactcctgacctcaggcgatccggccatctcgacctcccaaagtgctgggnttacaggcgtgagccaccacacccagcctcctcaccaacttttgatattactagtttttttcttttcagcccttctgtcgtcttctcgcccccgtatag

SEQ ID NO: 730067 - DNA, 589 bp, Homo sapiens
gttggaatgagtagaaaaaggggtgtatcatatacgatagtgtttcctttctcatggccagttaaatattatctctattatctctaccaggaatactttatggccaaccacaaattagagtaagctagtaaagaatgttgaattttattgactatattttctggggaacacaggctacagtgctagaggaagacagggaggaaagatggctgataaacaacatatttgtggactgtactgacagtaatttctatttatcagtaaaagttcccaaagtgataaagattccctttacctcttgggatctatgcttagatcctctactattgtttaaacagtctatgaattacttataggcaccctcttctttttcagagttgctttaaagctcatcttaacacaaaacacaggaaatgaagtaatagtcttcatataagactattaaaaaaaaagagagacaggcttaagaatttgtctagtttaattttctttttttctttttttttcttttttttttttgagacagggtcttgctttgttacccaggctggagtgcagtggcgagatcacagagagagaccttgatctc

SEQ ID NO: 730068 - DNA, 622 bp, Homo sapiens
ttccatgctctgcccctttcctggatgaggaaccggactcacaatttctatttccgggactacaggaagggcagagaatactgacggttaccagtattaacccttcatctgttcttgaaactggttggggaatgaggtgataagcaaggagggtgtaagtttaggggacaaagaagaaagaatgaataatacgagcagacattctctgtagaaggtaatggtctgagaatgaaaaggtgtttgatggacatgttgtgggggcaccaatgcagaacactgcactgagtcctaaaggaaggacaggagccttataggcaatgccccagactgacttgtgagtggggtttatggggaaagggagggactgagggcagagtctctgggtttcaggacagcattatgttatttccattcactattacttaagagtttgtgtgtaaacaggctcatctctgagttctcaggacccttgcccccacccccatttttttaatgaaaaaaaaacaaaaaaaacggatccaagaagaaaagagaatttatttccttctccactctctccatgccctggagaaaaaaaagtccagaagaaatcataaatatctctcatctacatggttgcttc

SEQ ID NO: 730069 - DNA, 254 bp, Homo sapiens
cgtgggcaggcaggagctctgtgccactctgcatcttcagtggtatccattttgtttacactatcaaccaaactttctatgctaagaaaagcaagatgcagaatgggtctgaaaaaagagattgaatgctgggctggaactcagaccaggattctagccccaagtgtgacatttgtgtgacttgaggcaaatcccttcatgccctgggtctggtttcttggctataaagtggggaagttggaagacaaaaaaaa

SEQ ID NO: 730070 - DNA, 594 bp, Homo sapiens
cacaaacctgcaactaccatatgacccagcattttcattcttgagtgtttatcccagagaaatgaaaacttaacgttcttgcaaaaatttgtgtatgaatgttcatggcatcttgttcatgatagtaacaacacagaagtgcccagatgtcctttaatgggtgaatggctaaacaaatggtggtgcattcataacataataccacacaggaatgaaaaacaaagctgatgcacaaaacaacctggatgaattcccagagaattatgctgaatgaaaaaagccaatctctgacgtatagttacatactatattatactatttacataatattctttttttttctttttttttttgagatggagtctcacctgtcgccaaggctggagtgcagtggcacgatctcggctcactgcatcctccacctcctgggtacaagtgattctctgcctcagcctccagagtactgggattacaggtgcccgccaccatgcccggctaatttgtgtattttcagtagagatgaggtttcactgttggcgaggctggtcttgaactcctgacctcgtgatccacccgccttggcctcccaaagtg

SEQ ID NO: 730071 - DNA, 696 bp, Homo sapiens
cacaaacctgcaactaccatatgacccagcattttcattcttgagtgtttatcccagagaaatgaaaacttaacgttcttgcaaaaatttgtgtatgaatgttcatggcatcttgttcatgatagtaacaacacagaagtgcccagatgtcctttaatgggtgaatggctaaacaaatggtggtgcattcataacataataccacacaggaatgaaaaacaaagctgatgcacaaaacaacctggatgaattcccagagaattatgctgaatgaaaaaagccaatctctgacgtatagttacatactatattatactatttacataatattctttttttttctttttttttttgagatggagtctcactccagcctgggtgacagagtaggactctctcaaaaaatgtctttgatgagcagtaaagttactagtttcattaaatatggacccttgagtacgtgtcttcttaatatggtgtgatgaaaagggaagtatgcgtgaagcagttctgcaaactgaattttaaattatcttgaggaaaatcacctgtaacattgtcagcaagctgtactgctcactttttaaaatttacaacattatacttagaagaataactaatagacaagctacagttttttacacttgggtattgaccagatatgtttttctaaataaaatgggcttatcctttcaa

SEQ ID NO: 730072 - DNA, 469 bp, Homo sapiens; identical to SEQ ID NO: 728450

SEQ ID NO: 730073 - DNA, 935 bp, Homo sapiens; identical to SEQ ID NO: 220280

SEQ ID NO: 730074 - DNA, 910 bp, Homo sapiens
gcctccgcgcgacccggcgggcccgcctccgccgccgggtgcacgcgcagcctgcgcctcgtgccggagcagagcagaggccaggatgcggagttgtgcactttgagccggccccatgaccctgagcacgttggcccgcaagaggaaggcgcccctcgcttgcacctgcagcctcggtggccccgacatgattccttacttctccgccaacgcggtcatctcgcagaacgccatcaaccagctcatcagcgagagctttctaactgtcaaaggtgctgccctttttctaccacggggaaatggctcatccacaccaagaatcagccacagacggaacaagcatgcaggcgatctccaacagcatctccaagcaatgttcattttactccgcccagaagacaacatcaggctggctgtaagactggaaagtacttaccagaatcgaacacgctatatggtagtggtttcaactaatggtagacaagacactgaagaaagcatcgtcctaggaatggatttctcctctaatgacagtagcacttgtaccatgggcttagttttgcctctctggagcgacacgctaattcatttggatggtgatggtgggttcagtgtatcgacggataacagagttcacatattcaaacctgtatctgtgcaggcaatgtgggttgacagggattcaaggaacaaacactgtgatgtactattggtggaagaatgaactggagcagcctttctggagagtgatttgccaatatgccttatcattttgcatgatctttgtcctagtaactctatttctatggatttactctaagtttgtaaacatggatgtgtgcaaagattttagctctaagaatgtttgtcagtgttctaataatagcaaaaaataaaaaacaaatgattg

SEQ ID NO: 730075 - DNA, 336 bp, Homo sapiens; identical to SEQ ID NO: 220282

SEQ ID NO: 730076 - DNA, 1177 bp, Homo sapiens
aaaaaaaaagaaaagaaaagaaaagaaaaggaaaaaaaatgaaaaagaagccattgaataccctattgaccataagaaaaagcagggcaaagctggtcaacggcaacccagacactgaaggaaaaagaacatggagaatgacaaaagcccagagggaggagtaaaaggacacaaacaccattctcagggaccaggactgggcgccgttttcagggaccaggactgggcactaatcacagaactgtaacaggcgccccatgggaatgaccaactgttagacggggcctgcagggcagcacttccctcttgcctcccaccaaagcttctaaagggaaatgtcgactgttttcacagcagtcccctcactgcggctgagtttgtgggctcagatgatagctcacaacaacctgattcagtccccactgtggctgtgtgtggggggtcagatgacaggccaccacaacctgattcagtcctcactgcagctgagtgtgtgtgggtgcagatgacaagccaccacaacctgattcaggattcagttgggctactagccagtgccataaggaaaaccattctggggctcttgagaggggcaaagcataatttgcatgtgggagaaacgttaatagtttgtggccagaggacaagctgtggtttattaaagactgctgcaggttcctactatgcttctcatcaagaggtggaatctaatcacctttcccccttgaatcatggctggtctcagtgatgagtacaactggacagtgtggcaggagagatgctctgggacttctgagggatgatcatgagagaccttacagcttctgcctgggcctcttggacacacaccctgggagaagccagacaaacctgactacctgatgctaccagactggaaggaagtccgtgctggccacaaagagagggctgggtgcctgctccgtgtccccagccactagagtccttctgggtgcctgcttcacatccccagccactagagtccttccagatgagaccagggacatcatgaagcaaccaacccacaccgctctgtccagtgtcttgacccagaaaattgtgacatgtaaaaagaataaattcctggtttaagccagtaaggttacgggtacattgttacatctcagataattaaaaccttgaaaaactcaaaaaaaaa

SEQ ID NO: 730077 - DNA, 520 bp, Homo sapiens
tgttggaacccaagcagaaaccaaagcccaggagaatgcttggatgccagccatatgaatcagccttgctaagcataggacaagatggagaaggatggagaataggtctgggtgggacaaatggatgacatccagtatacccaatctccataattcctccccagccacatgaaaggctctgactttactcctagggactcaagactggaatgggaagagcatgaaattgagctgtctatccccctggatctctcattgccacctgcccataggttggctgcacccctccaccaaagaaaggccatgactccttcctggcagccctgtcttacagctactctctggtgatctgggaaccactccctcccttaccccttgatgcctagggctagtgccagcaccttgttgttgttagcctcagaggcacttgcactgttccttgatggttttcccaaatcttgccctcatctttgtaaatactgtttgccgtttattacactgtcatcatattacccaaatt

SEQ ID NO: 730078 - DNA, 504 bp, Homo sapiens
atccatattttacagatggagaaacggaggcccagggaagggatgtgcccgaggtcatacaaagaagtttgtgggaatccaggtctgactcgcactcaatctagtgctctaataatgacttgagtgaattgtatgaatgtgctcagaggtggagcagcaatcataaaagtaataatggtaccatttatggaccatctaactactgtgttaaaacaatttacaggccatgcgcggtggctcacgcttgtaatcccagcactttgggaggccgaggcgggcagatcacgaagtcagaagatcgagaccatcctggctaacacggtgaaaccccgtctttactaaaaatacaaaaaattagccgggcttggtggcgggcgcctgtagttccagctactcgagaggctgaggcaggagaatggcgtgaacccgggaggcggagcttgcagtgagccgagatcgagccactgcactccagcctgggcaacagagcgatactctgtctga

SEQ ID NO: 730079 - DNA, 647 bp, Homo sapiens
atccatattttacagatggagaaacggaggcccagggaagggatgtgcccgaggtcatacaaagaagtttgtgggaatccaggtctgactcgcactcaatctagtgctctaataatgacttgagtgaattgtatgaatgtgctcagaggtggagcagcaatcataaaagtaataatggtaccatttatggaccatctaactactgtgttaaaacaatttacaggccatgcgcggtggctcacgcttgtaatcccagcactttgggaggccgaggcgggcagatcacgaagtcagaagatcgagaccatcctggctaacacgggactcaagactggaatgggaagagcatgaaattgagctgtctatccccctggatctctcattgccacctgcccataggttggctgcacccctccaccaaagaaaggccatgactccttcctggcagccctgtcttacagctactctctggtgatctgggaaccactccctcccttaccccttgatgcctagggctagtgccagcaccttgttgttgttagcctcagaggcacttgcactgttccttgatggttttcccaaatcttgccctcatctttgtaaatactgtttgccgtttattacactgtcatcatattacccaaatt

SEQ ID NO: 730080 - DNA, 890 bp, Homo sapiens; identical to SEQ ID NO: 227860

SEQ ID NO: 730081 - DNA, 490 bp, Homo sapiens; identical to SEQ ID NO: 227116

SEQ ID NO: 730082 - DNA, 493 bp, Homo sapiens; identical to SEQ ID NO: 232367

SEQ ID NO: 730083 - DNA, 2847 bp, Homo sapiens
acagaggagcacagagagactgcgaagagagatgacctgcctagggcccacaatcaccttcgtccctgctgactctgactttcaaggcatcctctccccaaaggccatgggcctgctggagaatgggcttgctgccgagatgaagagccccagtccccagccgccctatgtaaggctgtgggaggaagccgcctatgaccagagcctgcctgacttcagccacatccagatgaaagtcatgagctacagtgaggaccaccgctccttgctggcccctgagatggggcagccgaagctgggaaccagtgatggaggagaaggtggccctggcgacgttcaggcctggatggaggctgccgtggtcatccacaagggctcagacgagagtgaaggggaaagacgcctaactcagagctggcccggccccctggcctgtccccagggccctgcccccttggcttccttccaagatgacctggacatggactccagtgaaggcagcagccccaatgcatctccacatgacagggaggaagcttgttccccacaacaggaacctcagggctgcaggtgcccgctggaccgcttccaagactttgccctgattgatgccccaacgttggaggatgagccccaagaggggcagcagtgggaaatagccctgcccaacaactggcagcggtacccaaggacaaaggtggaggagaaggaggcttcggacacaggtggggaggaacctgagaaggaagaggaagacctgtactatgggctgccagatggagccggggacctcctcccggacaaggagctgggttttgagcctgacacccaaggctgagatgtttgtgctccgtagcttctagtctggaactgctgctgacccctgtgtgacatcacagggcctcagtttccctatctgcaaaatgggatgatatggaggttcaatgagatggtggcattttgagaatggtaaagaaatacacagggaggggatgatgactattagtggactcttgtttttccaatagttagtggtctttggccaacctttgaaggcaaaatatgatttgttgaggtttgcagcagctgaagccctcaaaagcattttccaccttcccccaaagctgacctctgagaggaaccttccttggtgctccctctgggcccctgatcctttgtgaaggccagtcagactatacttacagaaggcagtttatcatagcgttgatgatggtagatgaaatgtggaaagaatctcaatgttcagcaacaggagactggctaagacatcatgccacagctatgcaagggacagatacacggccattcaaaacagtgaccctcctgattgaatcaaatcccctatcaccactctcacagcaccacagatctctctcctttgtagcatttattaccatcataattttacatttctttgtgaatttctttgatgaatttctatctccttcattggacgctaagctctgtgaaggcaaggactctattacgttcattattgtgccctcagtgcttagttaagttcctggaacacagtatcctctcaataaattgttgttaaatgagtgagtgagtctatatattttgatgtggacagattttgtaatgtataattaagagaaagagagcagattataaaacagcatgcatgctgtaacagacattgttaattccctccttccttgattttgtttgtgagtgaggaccacatccccactttcagtcaatgaattgtgattggtccaaagccaatcatgacaatccttttctctgctgctggaggtggtcctgagatcgagttctggccagtaagacctaaagagaaatctgttgggggtcactttctgaagtttttgcttttataataaaaatgcagaagtgactgcctttgcaggcattgaaaacagatgtagtggctggagctgcagcagctgtcttgcagtcatgagggaaattccaagagattcacagagatgctggacctaacattgttgaaccagtgaaccacggccagccaccataggtagtctagctaggaagaaaaatgaatctctggttgttaaataattatacatgcagattaatgccctctcaatagatacagagtatgatcccatatatatatatatatgtatatccatatatgcgaatatgaatagaaaattaaagtgattatatctgggtgggtttgcctccttcactatgggcaaccttccaccctccattcctccttcttctcctttagcctgtgtccttaagaacttaaaacctcttcaactcacacctgacctaaaacctaaatgccttattttcttctgcaacaccacttggccccaatacaaacttgacaatggccctaaatggccagaaaacggcacttttgatttctgcatcctacaagacctaaataatttttgtcgaaaaatgggcaaatggtctgagatcttctcggcttagcggctgaagactgacactgcccgatcgcctcggaagcccccagaccatcacggacgccgagctttgggtaactctcacagtggaaggcttctaaacctcttaaaactccccaactctggtgccaacttagacaatactcttttaagcactcctttttagttatccccacctgcccagttcccttattaggctgagacactttaaattatctgcttccctgactattcctggactacagctatatctcattgccgcccttcttcccaatccaaagcctcctttgtgtcctcctcttgtaccccccaccttaacccacaagtataagatacctctactccctccttggtggccaatcatgcaccccttaccatc

SEQ ID NO: 730084 - DNA, 729 bp, Homo sapiens
gcctccctgcctaggttacatgcagtggtcatcccggtcgctcccacacccgtgtgggctctgggatcccctcttccagccagcccaggggacatctggctgtctcaggacccagccatctgtaaaaattaggcaggtcccttcagtatgctcctggtcaacaaagaaaaacttcaattttgagaatggcatctgtattccgaagtgttctctcagatgtttgagttccactaagtaggggaagaagatgctgcatacaggatggaatatccaggggaagacgtctaaggagagatgcccagctgggagtcctatgcaaggggaagaagatgctgcatacaggatgggatatccaggggaagatttctaagaagagatgcccagctgggagtcctatgcaaggggaagaagatgctgcatacaggatgggatatccaggggaagatttctaaggagagacacccggctggaagtcaagatatgtcagttgtttccattataataaaaccactcatgttagatgagctgaactttcccttttccccagttcttacgatcaaaaagtggctgtcctaaatttcatcactcaatatccttgctagagtcttcctttgtcagccaggctggagtgcaatgtgcaatggcacaatcttggctcactgcaacctctgtctcctgggctcaagcaattcttctgcctcagcctcctgagtagctgggattacaggt

SEQ ID NO: 730085 - DNA, 551 bp, Homo sapiens; identical to SEQ ID NO: 343907

SEQ ID NO: 730086 - DNA, 760 bp, Homo sapiens; identical to SEQ ID NO: 4494
  misc_feature (16)..(16): n is a, c, g, or t

SEQ ID NO: 730087 - DNA, 426 bp, Homo sapiens
ttcatcaccccacctggctaactttttcgtttttattttttatagagacaagttctccctaagttgcctaggtgagtcttgaactcttaggctgtagtcatcctctggccttgggctcccaaagtgctgagattacaggtgtgagccactgcacctggcagttgaagattatatgcggatcacctaggtcaggagttggagaccagcctgaccaacatggtgaaaccccaggggctctactaaaaatacaaaaaaaaaaaatagctgggcgtggtggtgggcacctgtaatccccccttctcgggggtctgaggcaggagaatcacttgaaccagggaggcagaggttgcagtgagccaagatcacaccactgcactccagcctgggcgacaagagcgagactccgtctcaaaaacaaaacaaaac

SEQ ID NO: 730088 - DNA, 455 bp, Homo sapiens; identical to SEQ ID NO: 415460

SEQ ID NO: 730089 - DNA, 615 bp, Homo sapiens
ctctgaggaccctgccctttcccaaaaggggtatcttaagaaggaaaatatggctgctctttgcggacagcagagtcccagaaccccatgcaggtgtttcagggctttatgtcattcaaggatgtggctgtgaacttcactaggaagaatggagagaactggaccttgctcagagagtcttgtacagggatgtaatgctggagaactataggaacctggtctccttggtaggatttccattttccaaacctggtatcatctcctagttggaagaagtggtaagcccacgaacacaaatgcaggagggagaggtgccaagaagcagcggtacacgagaaagacagggctggagaccagtttgctgatagtgaccccaaaccagaaagttcattgggcctgcacctccagtagaactggacctgaggcagctaggaataggatgcatgtttctgaccctggccaggatcagaaagaaggaaacctctcctgagggtcttcagcagtggaagagggcagtcaggacagggacagtgaggaaacgttacatcgctaaaaagggctacttatgcgtattctatgcgtggttgaaaataaacagcactgtgtctggaatga

SEQ ID NO: 730090 - DNA, 1009 bp, Homo sapiens; identical to SEQ ID NO: 240715

SEQ ID NO: 730091 - DNA, 1460 bp, Homo sapiens; identical to SEQ ID NO: 240714

SEQ ID NO: 730092 - DNA, 521 bp, Homo sapiens
ttttgaaaggtaaaggccattagcttggaggcagaagacagacctccctgactgctgaattcctgccggcctgaaattggagcattccaagctcctcagatgagtcataagccaccaagattgtgagcctctgggtctaaagtccaccaggtcagggagcaggcctgtctcgtcttctagtcttctactgtatctcaatacaatgcctgggacaggagaaacacccaatacgtatgggcagaataaataaatgacacagttctggggtggcagcagatcaatttcctggtctgtgtctcttcaatggacaagtcgatacatctctgctgctccacgtgtagtccatggaccaggccccttctcatcacctgggagctcatgagcaacgcagcatctcagtatcccaccccagacatctgcatggactgaatccagttcaccacttgcttgagggtaattgcacataagtctccaagtctcagtttcctcagctgaaaaataaaaggtaataaagcccatta

SEQ ID NO: 730093 - DNA, 2290 bp, Homo sapiens; identical to SEQ ID NO: 680766

SEQ ID NO: 730094 - DNA, 1226 bp, Homo sapiens
caataatataagattcctacatcagtttgcagtcctgactttacagtttgaaataagtagcaaaagaaaattatgataatcaagtaatttattattttgtaaaatagtataaaggaataaggaaattttaagtattgtttaggggccaaatttgaactcagctaatatgatttaagcgctctattaattgccctgatttttaaagaggtgcatgtaattttgaaatagcacacattttcatttgtaatcactctggataaatttgtatttttcagtgttcattgaacaggcttattgactctggtaaacttattttattgatgttttcatatggaaaataataagtggaatatgatacaattgttattttcagaacatatttctttagggctatttaatataacctttttaacgagcaaaaactttccatttgagagaaaaaattcttcctgctctgtgggaaaatatttgctgagattttgtatagaataagagacatgtatgtaacatatatgtatattcagcacaagtctactgcaattatgtacacattttggcaggaagaggggattttgtttagtctttgtttatgagttctagagtttcctgtatctagtgttaagttgtaaggaaaaactaaacatgccatttaaaggtaaacttggtaactatttatagagcatacaccaatgattatttctcacagttttcatgatcatttgtttattatttacttggattagactcattaaaaggtataatgctggtcacaattagaatgctaatatttggggaaactatgcagaaaatattttaaaatattaaaagagtgctggcttctattgttgatttatttttggatttaaaaacaaattagggctgggcccattagctcacacctgtaatcccagcactttgggaggctgagatgtgagaattgcttgagcccaggagtttgagaccagcctgggcaatatggtgagactccatctccatacaaaattaaaaaaaaaataattagccagatgtggtggtgtgcacttgtagtcctagctacttgggaggctaaggtgggaggatcgctggagcccaggacatcaaggttgcaaggagctatgttcattccactgcactccagcctgggctacagagtgagacctgtctaaaataaataaataaataaacaaactagctcatttacaatgtaaagcacttaatatcaaatg

SEQ ID NO: 730095 - DNA, 1052 bp, Homo sapiens
tagagctgtttttttttaaaaaaatcaatttgtgaatagagttcaaacaaaaatgccttttttaatttcagcagatgctcgaggatttcttaccttgaagtcaaggttgccaatagcaacaaacttccgcaataaatatggcaaaatgcaacgcacatctttattctaatgccttgtacttttatacagtctttcatccatagattttcttatttgacagttaatatttaatatttaaaatacccgtaaaaggcacacatgtcttatcaccccctctttttgccattgagagatcctagaactcagaggttccaacacctcaagatacttgggcatagagctaaacttggaatctagaatcctgaactcattgggactcatctgtgaagaataatgaaacaagatttgtaaaaactggctgggtagtgtactaagcatttactctatatcaggaatacagttaagtgccttgtttacatttgttcatttagttgattaattttacaaataagaaaattcaagttcacagaggtggtcacttgctcaaagccatattccaagaaaatggtagagctaagacttgagctcaggcccatctaactccaaaactcaggctcagaaccatctaagctgtaagttgtaagagctactgagaatcaaggagcttggctctgggagaagtttgtgattctttggtgctctcttcacgtcactctactacctcactttagccagtaaaagacacatcacagattggcacaataagaggcatattagtgggcagctgaaaactggaaaaagagaaaacaggcctgcgtttacaacccttaagagtgagagactgagaccacaagcaaaacaccaagaattatttggtcacacaaaaacccggctgagtcactggagacaaaagcttaattcccttattggttttgtgtgcttgccttaattccatactatcctttaaatattctacaaataagagcacggcatattctatcgctatttacaacagggctttgctgaagattttatccagggcaaggtcatca

SEQ ID NO: 730096 - DNA, 496 bp, Homo sapiens
tttgttcttcatgaaaaatgtctgggaccttttatatggacggggaataccaacgtagagatggtcaagaaaatttgcgctccgacctaaaccaagcacgttgtatggtagttggagagctaaatgtgggaggagccaagatggccgaataggaaaagctccggtctacagctcccagcgtgagcaacgcagaagacgggtgatttctgcatttccatctgagggtgtactccatctacttttaaaaacaaaaagttcactgtaaaacagcctcaggtaggccgttcagtaggtattccagaagaaggtattgtcatcataggagatggacagctccaagggtgtttattgcccctgaagactttctagtggaacaagatgtggaggtggaagacactgatgttggtgatcctgactcagtgcaggcctaagctaatgtgggtgtttgtgtcttagtttttaactaaaggtttaaaaagtaaaaataaaacattaa

SEQ ID NO: 730097 - DNA, 368 bp, Homo sapiens
cctcgccctccccaccgacatcatgctccagttcctggtgagtggagctgccgaagagcggggcccgctgcctggggcgtgcctcggaccccatttcccccttgaggattgccgaccccgccgacccggcctgggcgtgggtccagcggtcccttcgtcccccgcgcctggtcgtcgcctcgcagggcggccgttttcttcctgcctccccagaaaatccctttgccaatatttttctgcagccatccaagtccctaaaactttgaggtgtcagagagtgtgcgtttccagagcttcttattgtgtgccgcgccccgcgctcattgtgcaatctttgtattaaagcttgtgtggtccttgatgaaaaa

SEQ ID NO: 730098 - DNA, 2317 bp, Homo sapiens; identical to SEQ ID NO: 251197

SEQ ID NO: 730099 - DNA, 2139 bp, Homo sapiens; identical to SEQ ID NO: 223829
  misc_feature (1542)..(1542): n is a, c, g, or t
  misc_feature (1578)..(1578): n is a, c, g, or t
  misc_feature (1588)..(1588): n is a, c, g, or t
  misc_feature (1590)..(1590): n is a, c, g, or t
  misc_feature (1632)..(1632): n is a, c, g, or t
  misc_feature (1651)..(1651): n is a, c, g, or t

SEQ ID NO: 730100 - DNA, 347 bp, Homo sapiens; identical to SEQ ID NO: 728457

SEQ ID NO: 730101 - DNA, 836 bp, Homo sapiens
  misc_feature (773)..(774): n is a, c, g, or t
tgtcggagatgagatcagctaataacagactcaattcctgaccttcctagttttctgagactgcatccactttgatagtttctactgagtccaaattagaacatcccagctggtgggctgtctcccaggaagccctcggagaggagcggtgcatagggggcacctggacacagcccacctcccccgagtagcgtcaggtaggcttgtctatctacatcctttcgccctttctcaggaaactatcagatgatgtgctcccccagatgaagaagtagtgccaggaaaaaggagacacgggatacagggatcctgaagccggcggaggacaagggagctcctgggaggacagctgtgctccggcctagcaatagcgagcagctggtccagactcccgccgtgactcagaagatagacatgcggagggttatgatcacagagcaacgatggtccttgtacatgaagataaaaatgctcaggtgtgcccaggttgaagaagatgaaaggccctgcctcccagagcgcccggggacactggtgatctcttccaggtctgtttccacccactgcagctgtgatggagtcttgctctgttgcccaggctggaatgcagtggcgtgatcttggctcaccaaaaattctgcctcctgggttcaagtgcctccacacccagctaattttgtatttttagtagagacgagatttcaccacgttggccaggctagtcttgaactcctgacattgtgatccacccacctcagcctcccaaagtgctnngattacaggtgtgagccaccatgcccggcctacctggagcattattaaaaccttaaaccttt

SEQ ID NO: 730102 - DNA, 354 bp, Homo sapiens
  misc_feature (28)..(28): n is a, c, g, or t
agcttttaaaagattttttttttttctntcaaccccatgattcctttaacaacatgtttccagcattcccaggtaggccaaggtgtcctacaaaaaaaccttgggttaaacctacagggggtttggctggtgttaacaaaagggagggcaaaactggtgcggctggccatgaaaaaaacttacttgggtggtgtggtacaaaaaaaccagcttgtttacatgcttattccatgactgcttgccctaagcaaaaagtgcctttcaggatttatttttgggggtttattacgtatgtttggttttcaattcccccagtttaatgaagatttaaataaaatggtaggttttccctta

SEQ ID NO: 730103 - DNA, 566 bp, Homo sapiens
gggatctcaaagagatatttgtacacccatgttcatagcagcattattcacaatagccaagaggttctggaagcatcccaaatgtccatcaacagatgaatagataaaggaaatgtggtatatacagtcaatggaatattattcagcctttaaaaagaaggaaatcctgtcaaatgtacaatgtggatgaaccttgaaggcattatgccaagtgaaataagccagccaacaaaagaacaaatgctatatgattcctccatgtgaagtatgcaaagtagtcaaaatcatacaatagaaagtagaaaggtggttgccaagcaacgattgggggaaggggagagggtgaatttgtatttagtgggtacagagcttgtgttgcaagaattctagagatctgttgcaaaacaagtgtgattgtacttaacactactgaactgtatacgtataagtttgagaaatatctcttttaaaaagggggaaatgtgaaggcttttgcatgtatgccctaggaaatgcatagaattcttagaaaggtaaacatggtaaaaaaagaagtctttgttaaa

SEQ ID NO: 730104 - DNA, 709 bp, Homo sapiens
  misc_feature (53)..(53): n is a, c, g, or t
  misc_feature (56)..(56): n is a, c, g, or t
  misc_feature (65)..(65): n is a, c, g, or t
  misc_feature (69)..(69): n is a, c, g, or t
  misc_feature (72)..(72): n is a, c, g, or t
  misc_feature (75)..(75): n is a, c, g, or t
  misc_feature (78)..(78): n is a, c, g, or t
  misc_feature (80)..(80): n is a, c, g, or t
  misc_feature (108)..(108): n is a, c, g, or t
  misc_feature (115)..(115): n is a, c, g, or t
  misc_feature (124)..(124): n is a, c, g, or t
  misc_feature (132)..(133): n is a, c, g, or t
gttttcagaacttttcttgtcaccccagggcgaatacagagtggcaggtggtnatnttggggggnattnatnttntananaactgaaaatctgaactgggtgcctgtncccgtcnagggttacnggcagatnnccgtggacagcatcaccatgaacggagaggccatcgcctgcgctgagggctgccaggccattgttgacaccggcaccttctttgctgacgggcccaaccagccccattgccaacatccaagagggacatcggagccagcgagaactcagatggcgacatggtggtcagctgctcagccatcagcagcctgcccgacattgttttcaccatcaatggagtccagtaccccgtgccacccagtgcctacatcctgcagagcgaggggagctgcatcagtggctttcagggcatgaacctcccccccgaatttggagagctttggattctgggtgatgttttcatccgccagtactttaccgtttttgacagggcaaacaaccaggtcggcctggcccccgtgggttaagcctaagttttttcagccccctcccaggaagatttggcctttgtcctgggccccctttaaatggatttaattttcctgactgtttttcccaggggagtgtggaggttttggccctgttccctgtcctaccaataacgtagaataaaaacataaccccctgaaaaaaaaaa

SEQ ID NO: 730105 - DNA, 767 bp, Homo sapiens
  misc_feature (53)..(53): n is a, c, g, or t
  misc_feature (56)..(56): n is a, c, g, or t
  misc_feature (65)..(65): n is a, c, g, or t
  misc_feature (69)..(69): n is a, c, g, or t
  misc_feature (72)..(72): n is a, c, g, or t
  misc_feature (75)..(75): n is a, c, g, or t
  misc_feature (78)..(78): n is a, c, g, or t
  misc_feature (80)..(80): n is a, c, g, or t
  misc_feature (108)..(108): n is a, c, g, or t
  misc_feature (115)..(115): n is a, c, g, or t
  misc_feature (124)..(124): n is a, c, g, or t
  misc_feature (132)..(133): n is a, c, g, or t
gttttcagaacttttcttgtcaccccagggcgaatacagagtggcaggtggtnatnttggggggnattnatnttntananaactgaaaatctgaactgggtgcctgtncccgtcnagggttacnggcagatnnccgtggacagcatcaccatgaacggagaggccatcgcctgcgctgagggctgccaggccattgttgacaccggcaccttctttgctgacgggcccaaccagccccattgccaacatccaagagggacatcggagccagcgagaactcagatggcgacatggtggtcagctgctcagccatcagcagcctgcccgacattgttttcaccatcaatggagtccagtaccccgtgccacccagtgcctacatcctgcagagcgaggggagctgcatcagtggctttcagggcatgaacctcccccccgaaagtacttcccccagtgggatgctcccacactggcagatgacacagcccctggagataccacctggatatgagagtaattcgccaccatcggcatcgcaactcctacccaggattgtgcaccgtgcgtccttagacacccggctccgcccacctcgctagggtgccctcagtctacggctcctatcttgcctgcaccagccacgtccgcgtcaaccccgaggattcttccacgtaccagtccaccgtcgagacagtctccatcaccatacggcaccggcagcatgacacagcatcctcggatacgactctgtccagattggagccatg

SEQ ID NO: 730106 - DNA, 1531 bp, Homo sapiens
tttgatatgattctatttattataagtcaaatagatataattcattatgagaatgaaatgaattattgttaatagttatgagattaacataaacaatcatcgtcgtgtattgccagaaaagttattaagatggtagcagttgttctcgtgtctctagcacatcccccttcagagaaactttcaaatagaaaatgaaactgggcatctctgctatgcaaatattggtggctgttgtcatattcctgcaacagcccttgacagtgggctgggctgggtgctgttctcactttaaatccggggagctgaggcttggaggaataaagggaacagccccaggacttgaacagagcccttgggtcacccatgtctctactgtagcttctaggccgtttcccctggggatccaatgtgtttcctgttgtccccaatcttttaaatttttttccattattagagttagtaccagcagccagggtggaactgcaattcgtgaagattgcatggcttgctttaaaagaatggtatctgtacgggtcccttaaccattcgaggggcaccatcgggcttgtgggtcatgctgggaagtggcccggctgcctgtgacagtttctcagccaggcagggactcttttccacacgatgacactggaactgaatgccacactccttctccttggaagaaaaaattgtgtgtaggacaaggactcaggacatgggtgtggaagaatctctgtggtacgagcccagcctggaagaactcttaggctgcgtggacgctgcccggccacggtgacggagctgttccaatgcctgcttcccgagacaggcccatgaaatcatgcaggcttgagcccggcttctagaaggagcacgcctctggccagggtggctggtggaaaccagtcctggccaagggagccccggcaggctgccaggtaggcagcaggcggcagggggttaatgtggggagcgggcaggggtggggtgggaagccagctggggaaatgggggctgcagggcccagccgacaggcacagacacaggggctctgtctgcttgcccgctgcctggcactgtgactaaccgccccactatgtgagtctgaagtcagcccttgtgtcgtcccctggcgtctgggagcacagccgaagaaccctttccagcagcccccctcattctggaacctgcagccccaacatccattctttcagctctcagggttgctgggggctgatgagccagtggaagtatccctttccctggccaggaagggccaccagcaaaaaagaagcagaaaaccagtctcccctactctgggtggggaagtggggggcacaggagcctactaaacctacgtgaccgccgtggtagctgctccacacgcagcaaaggagccattgaaatggggagaggccaaatcgaatatggaaaaaatggcaaaatatcccgttcacagtttcatacgagcaacacactgaaataggattttggaaatttatattagattaaaatgaattttagtactaaagtg

SEQ ID NO: 730107 - DNA, 387 bp, Homo sapiens
ccaggctggagtgcagtggcacgatctcggctcaccgcaacctctgcctcccgggttcaagcgattctcctgcctcaacctcctgagtagctggaattaactggtgcccgccaccatgcccagctaattttttgtatttattagagaccaggtttcaccatgttggtcgggttggtcttgaactcctgacctcaggtgatccacctgcctcggcctcccaaaatgctgggattacagccgtgagccaccacgcccagtctgcagcttgcttttttaagttactatgccctgggctcccttccatctgggtacacaggtatctactgcttccttatttagagtctacatagcacttcatggttatgaacacccttctgtcgtcttctc

SEQ ID NO: 730108 - DNA, 709 bp, Homo sapiens; identical to SEQ ID NO: 400486

SEQ ID NO: 730109 - DNA, 1248 bp, Homo sapiens; identical to SEQ ID NO: 400484

SEQ ID NO: 730110 - DNA, 390 bp, Homo sapiens
aataatgaagcaggcgaggacggagccttgctcaggacgacagaaggcttgcagcctgcctcaaacgcaactctaatttcagccacttcacttcttccccccgcgctcagacttgcctcaaaggaagctccatctgcccgaagctgcgaggctgccagggaatgtaggcaagtcgggggagccccacaaagctggcgaggtcgggaatcaccccagggattcgtaaggctaggtgttattaagggttgacaccattctcgaagaaggcagccaaaaaaaaagacaaaaaagttagtggaatctatcaggattcaaatcaacttttgcaagcaatatgcccatcatccttcctgagacactaaataaatataatggattcatccaaggaat

SEQ ID NO: 730111 - DNA, 577 bp, Homo sapiens
gccgggcgcggtggctcacgcctgtaatctcggcactctgggaggccgaggcgggcagatagcttgaggtcaggagttcgagaccagcctggccaacatggcgaaaccctgtctctactaaaaatgcaaaaattagccaggctgtcttaaaaaaaaaaaagagtccaaaccccaccccctacccccgctaatccccactcttccatcccatttgggtctgaacaggtcatcgccgcctcatttcctcggcggccaattgggggcgccagagagcagcggacgcccctccaccgactttccagcgcttgggaggcggagtgagacgccctgtaatcccagccctgcctttcgctggttgtgagctcttggccatgttactgacctctcagagcctcagcgctgggttaaaatagaactggtgtcctgataatgggtcgacgtgatcagtgagctttctccgcccgtgttctcctgagtgtcctgagagcagcccgtttctgcccctcttgcgattacaaagtcaagcccagagcctgacccacagtagtgctcaataaaggcttagaaaaagctcgga

SEQ ID NO: 730112 - DNA, 800 bp, Homo sapiens
gccgggcgcggtggctcacgcctgtaatctcggcactctgggaggccgaggcgggcagatagcttgaggtcaggagttcgagaccagcctggccaacatggcgaaaccctgtctctactaaaaatgcaaaaattagccaggctgtcttaaaaaaaaaaaagagtccaaaccccaccccctacccccgctaatccccactcttccatcccatttgggtctgaacaggtcatcgccgcctcatttcctcggcggccaattgggggcgccagagagcagcggacgcccctccaccgactttccagcgcttgggaggcggagtgagacgccctgtaatcccagccctgcctttcgctggttgtgagctcttggccatgttactgacctctcagagcctcagcgctgggttaaaatagaactggtgtcctgataatgggtgaggccccagtggaataacgcacgtgaaatacacatactgggcgtccacttaattaaggccctatcctcattgcctgccaagttcccaaaagagggatgggtttgggtgggaggttgagaggggaggttcccggcctttccagcagtgccccctctgccgtctgggcctggcagatgcgtgttgatcccagcgttttctccagcgtgcgctcgcttgctaggtcgacgtgatcagtgagctttctccgcccgtgttctcctgagtgtcctgagagcagcccgtttctgcccctcttgcgattacaaagtcaagcccagagcctgacccacagtagtgctcaataaaggcttagaaaaagctcgga

SEQ ID NO: 730113 - DNA, 715 bp, Homo sapiens
tcttccgatggcactggggtggctgaaggaacagacatctttgggtttcgtcagcctcctccaagactgctgcagtgcctacactttagacttcagaaggagactaaagacttctagaatttagaaggagatctgaagtctcctttctggagttacaacccaaaggatgttagcatttctcaggtcatcccactgcaaagcccagaaggcttggggctcccaggctgctctgaagccccactgtctgaccgcctcagggcttgctacgagggactggggcacggccaagctgactaggaacagctctcgtgctcctgagggacctggaggatgggcctgcctcccagccattgagctggattctgggataattcttaactcgaaataaggggaagcatccatcagggaatgctggcctttctagagccacgtagaaaacaattttctggttcttcaaacctcaaagagtccttggtccaaaaaacagaatgttttggcttcgggtgtcaaaaaaaaaattttcacgatgtcagaaatagtatgtttttaacaatagtaatagctttgtaaaaaaataaaaagctttaacagcgaggccataaacaatgaaatgaataaaaacggtggtcattcagtcaacggaacttatttgttttggaacacactgtttttcaactctgctgagtgttttgaaaaaatgaactattgtttttcc

SEQ ID NO: 730114 - DNA, 634 bp, Homo sapiens
tcttccgatggcactggggtggctgaaggaacagacatctttgggtttcgtcagcctcctccaagactgctgcagtgcctacactttagacttcagaaggagactaaagacttctagaatttagaaggagatctgaagtctcctttctggagttacaacccaaaggatgttagcatttctcaggtcatcccactgcaaagcccagaaggcttggggctcccaggctgctctgaagccccactgtctgaccgcctcagggcttgctacgagggactggggcacggccaagctgactaggaacagctctcgtgctcctgagggacctggaggatgggcctgcctcccagccattgagctggattctgggataattcttaactcgaaataaggggaagcatccatcagggaatgctggcctttctagagccacgtagaaaacaattttctggttcttcaaacctcaaagagtccttggtccaaaaaacagaatgttttggcttcgggtgtcaaaaaaaaaattttcacgatgtcagaaatagtatgtttttaacaatagtaatagctttgtaaaaaaataaaaagctttaacagcgaggccataaacaatgaaatgaataaaaacggtggtcattca

SEQ ID NO: 730115 - DNA, 535 bp, Homo sapiens
gctttcagacgagttcgggcgcgttcgaggtggtatggccgtagatcatacccctaagcgttcaatacaatcttttacttacttacacagtctccaacaagtctgcattaaaagaaaacctacccaaagtgtaactggactttaatcaatataaaacagtgattgtcgtttctcgttaaacgtaaaaagcaaaatggagttgtaaagagtttctttcccatttcaactccgacagccacgcgcgctttcagcggccggctacactgcgcggtcgcggggcccggcccaaagcccccgccctgcccggcgctgctgggagaggaagctccggggaccgagggcgggcaggcgggcagcctgggctccaccaggcccggccgggcgggggaaggggcacaggagactaccgggcgcgcttccggggactgcgcgggcggggtcgccgcttggggcgcggggcccgggctgggagtcaggtcaagggtcaggggccaggggcggctcggccacgagcagccggtggggcgcggccgca

SEQ ID NO: 730116 - DNA, 492 bp, Homo sapiens
ccaccttgacaggagcaaactcgagggggagggaggggagggcactgaagcacccacagtcctgaccctgctctgggagaatagagaccgtgcttagctcctgcttagaccttgttaaatgcccacattaaggttagccactacagaaatagaaacaggaagagagaaaatgcaggcaacagcacagagactgcaggcaaggagaagatgaggaccctgtgttgaaatgtatcagtaatgagaacacaagtaagtggattagaaacagtgaaacattcataggcgaacatctaaagcatcaagaaacaacgattagaactggaggcttttcacacgtgggtcagccaggcccgagaagctggtgtggggatatgaatatcaaacaacatgggtttttggtcaaaagccactgtcaaagatagttattttcctaagatgcaaaatgcataagccataaagaataaaatagaaaagttgctatattaaaatctt

SEQ ID NO: 730117 - DNA, 1021 bp, Homo sapiens
ggtaggcccagagcgaggacgggcccggactgggtagtggggatgtaccagggccgggtgcggcgggagacggcccgggaggcggaaggtcgcggacctgcccgacagaagagtagatgaggggagaccgaggacgcccgggtccggggagcttacgaggaggccaggatcgcggggtcttaagatatgaagacaatgggataactgaggctgattttgctgtgtggccattagacctagaaatattggtgtgattctggagttgattgctccacacgtttatttatttattttcctttttttccctcctcttcctcctcctctattctttaaaaacgtatggaaatgtatccggcaatgtttactgtaaaaaataatgtatggaaatgactacaatttgctaaaataaaaatcattgagcacttatgtgtgtcagacactatgctaggtagaggcagctctaatggcttccatttggccttcccgcttaatagccctcaccctaccagtgaggcagccaatgtgggagttctgccagctcctaagtatatctatgccaatgatgcattctggcactggggaaatgaccacaggatgagtccaggggcccactggacccactacaaaggtggaaaggctgatggcagcatgggtcgaggagaggatgctgctactactggggatggggaagctgttccttctggcaaaaaacgttcatcagagtttacaaactcagtgtccccgacttcatcagggtcctcccacaaatccacattccaagtttcagggtcccagtcttttcccatgaatgccctcactttaacagtagacacctggcaaagctgtacatgtatctttcattggggagaagattgctagcttgtcgtgctccttggagacattttgtagcataagctcttatatttaggtctatgatgcatatcaaattaattttcacatatggtgtgagtagttctgcttactggttatagtattttctgtatattctataggattttct

SEQ ID NO: 730118 - DNA, 647 bp, Homo sapiens
cctgttatttgcaggaccctgtcacccttggctaggccaggtatgttctgcaccgaaaatggccctgccctctgcattggatggctagctcttaggttggtttattttagcaaataagcgttacagggtaggcgaactggctgcatcagaaccacaattacccctgtgtctctgggtgggataaatggcggatggcattctggcagctcagccccacttatctcagaggttatagatctgaggtggtttagatccacccccaaatcacgaacattttacataagccgtgctagagttagcataaaagtctcacagaaaaatttggaaactgagaaatcctaacctattcccacaatcctgtgttcccatttttaggtcttaagatatgaagacaatgggataactgaggctgattttgctgtgtggccattagacctagaaatattggtgtgattctggagttgattgctccacacgtttatttatttattttcctttttttccctcctcttcctcctcctctattctttaaaaacgtatggaaatgtatccggcaatgtttactgtaaaaaataatgtatggaaatgactacaatttgctaaaataaaaatcattgagcacttatgtgtgtcagacactatgctag

SEQ ID NO: 730119 - DNA, 277 bp, Homo sapiens
aacacttaaagacataaatcacaggtgcaaagccatacctgggctcaaaaacctccaagagaacgcagcctcagacccacccaggggccaggggccaggctgtttgcgagaccagcccaggcgggacccaggcttgcacgggcaggtacacgacattcttgggcatacgcagcccgcctggccggagctgtgggagtcctcagccccaagacccagcaggcgtctgaggcctgcccactaaggaggaggagtcattgctgccatcattatcaccccc

SEQ ID NO: 730120 - DNA, 487 bp, Homo sapiens; identical to SEQ ID NO: 238435

SEQ ID NO: 730121 - DNA, 1464 bp, Homo sapiens
  misc_feature (131)..(131): n is a, c, g, or t
  misc_feature (322)..(322): n is a, c, g, or t
  misc_feature (373)..(373): n is a, c, g, or t
  misc_feature (471)..(471): n is a, c, g, or t
  misc_feature (1152)..(1152): n is a, c, g, or t
  misc_feature (1222)..(1222): n is a, c, g, or t
  misc_feature (1383)..(1383): n is a, c, g, or t
ccctgccaggcccggaagtaccaccagcttctcctgtggggtcttgcccttgaagtgccacttcccccagccccacctctggtcccttccagagggcacccttagccttgtaggtccctgggaagctggcncagcatcaaccagaagtgatgcctcagccaggccaccagtcgctccccgcctgggagctcagctttcctcagaaccaccccccctgtctgaagctctgtcctgggtcccaccagacttctgcccaccaggcctacctacagcatccacatggggcctcaggaagggccccgggggcccaggatgggcaggngcagggtttccaagcgcctggggctccattctcctctgtccacccagccanaccccttggcctcagcctgccctgtacccaagcttccctccccctctcctggggatcttaacggccttgttctctctccctggcacccacccccaggncgggtgatgccgccaagagagagggaggccgttgctaggtgatggcgccgccatacacacaccctttgtgctggggagtgacacccacccgtttctcagcagaacctgttgccacggtgactgaagcccccagctctgtctgtagaaacttcagatgggtgggggagcaggttggagaggggaccaaaggcaggcctgtcgtgctgaagctcttggggaccgtttcctcggcatttccccaactccttctccacccccctgccaggcccggaagtaccaccagcttcctaagggatgcaggaaggggccgggtgaactgaggtgaagtccagggcaggggagtcagacccctcaacatcctgtttaggggtcctcctccacaaagggtgccctccacctctccctcctgctggttggccggctcagagatgaagggggagagatggtggctccaaggctctgccaccgccacctcccaagcctgccaacgtgaatggcttgcagaatcagtcagcaggccagcggccttgggaaagagccactgtcctcgcagcctgggccagctgggggaacaatgtagggtttgttgcttaggggtcccaggcttgcgggggggttggcacatggtgggcagtggacttgagctgggatggtctgagggggcactgacacgctcacccnagggcagacttcagaccagccctcagatcctgatgccaggttacagggctgaggggagcctgaaatccantgggtctccctgctccacttgggagtcaccttctcatcacctatcctggaactgaatgcaattacttaaactcagtctcagcttcctcatctgtaaaatgggaataatctgtccttcacagaggattatggtcatttaatgagacaagatcttaagcattngctggtgcccgacaaaacacaaaagggcgcggccaaaatatcccaagggccagtaagctaccaaatctgtaaagggcctaa

SEQ ID NO: 730122 - DNA, 905 bp, Homo sapiens
  misc_feature (351)..(351): n is a, c, g, or t
  misc_feature (421)..(421): n is a, c, g, or t
cccacgcgtccggagaggtggagggcaccctttgtggaggaggacccctaaacagggtgccctccacctctccctcctgctggttggccggctcagagatgaagggggagagatggtggctccaaggctctgccaccgccacctcccaagcctgccaacgtgaatggcttgcagaatcagtcagcaggccagcggccttgggaaagagccactgtcctcgcagcctgggccagctgggggaacaatgtagggtttgttgcttaggggtcccaggcttgcgggggggttggcacatggtgggcagtggacttgagctgggatggtctgagggggcactgacacgctcacccnagggcagacttcagaccagccctcagatcctgatgccaggttacagggctgaggggagcctgaaatccantgggtctccctgctccacttgggagtcaccttctcatcacctatcctggaactgaatgcaattacttaaactcagtctcagcttcctcatctgtaaaatgggaataatctgtccttcacagaggattatggtcatttaatgagacaagatacataaagcactttgcatggtgaaaaaaaaaaaaaaaaaaaaaaaaaaaaaaataaaaaaaacagaggggggagcagacaagagagaaatcccacgagggccacacatataacagacaccaagattactgaagccaagggcgccatagagagagcacaaaaaagagagaagaggccgcgatacaccagcacgcgcacggcgacaccgcgaccacgggacctggccgagcacaaacctgcggctacaatctggaccacccaccagaactacagccccggacaacacaaacgggaaggggcacacaggcatcgggcaaaaggcagacaaaggaaag

SEQ ID NO: 730123 - DNA, 265 bp, Homo sapiens
ttccccagccaggccccgcagctggaccccggctccgtccagcctgggaaaggactccacggtttatgctgaagtggtggtggggtgggtgaacgctgcgcaatggaagggcatggccctgtgctaattgccccggggtgtggggctgtggaggcactgcgggggggatgtgctgtgtcagttgggcaatggcggccaactgtggcgtgcaggccttggagctgcccctccatggagctttaataaaggcactagccctgcaaaa

SEQ ID NO: 730124 - DNA, 1661 bp, Homo sapiens
ctgcactcggagcagccggccggccctgccggacccgggcaatgaggggcttagcacccgggccagcggctgtggagggtgtactgggtcccccagcagtgccagcccaccggcgctgcgctcgatttctcgccgggcctcagctgccttcccgtggggcagggctcgggacctgcagcccgccatgcctgagcctcccactccctcagtgggctcctgtgcggcccgagcctcctcgaggagcgccatcccctgctccacggcgcccagtcccatcaaccacccaagggctgaggagtgcgggcgcacggcgcgggactggcaggcagctccatctgcagccccgctgcgggatccactgggtgaagccaactgggctcctgagtctggtggggacgtggagaacctttatgtctagcccggggattgtaaatacaccaatcggcactcagtatctagctcaaggtttctcagggattataaacgcaccaatcagcgccctgtcaaaacagaccactaggctctaccaatcagcaggatgtgggtgggggccagataagaaaataaaagcaggctgcctgagacagcagtggcaacccgctccggtgtccttccatgctgtggaggctctgttgtttcgctctttctactgcttactcttcgggtccacactgcttttatgagctgtaacactcaccctgaaggtttgcaacttgactcctgaagccagcaagaccacgagccccagggaggaacgaacaactccagacgcgctgccttaagagctgtaacactcaccgagaaggtctgcagcttcactcctgagccagcgaggccacgaacccaccagaaggaagaaactctgaacacatccgaacatcagaaggaacaaactccagacgtgccaccttaagagctgttaacactcaccgcgagggtccgcggcttcatttttgaagtcagtgagaccaagaaccaaccaattcgggacacaataccaactctttcatgccaggagaagcctccttaaaaaatttcggtgattaacagcagcacatgggtcaaaatctcctgaaagttgagcaggggagctgtagaagaattcctccttttctcgcagatgaaatcttatgatatagcaggggttacctggccaagaaggaacacagaggagaacaaagaaaattcaaggaactaaattccttctccacctcaaccaccagcattgatactccatcacttatgtactgcatcaagccgtcctcagaggtgaggaaggtgctgtcaagactagaagctgtgtccctctctccattgcaagatgggacatagagaggagaaaagtggcagacagaagtcttaggtatgtctttatcagcagcatgaaaatggactaatacagggaccaatgattgcatctacctcatggactttttatgagaattgactgatttaataaatgtaaaagacttagaacactgcctcatctattgtaaacagtcaataaatattagtatcaattttcattgaatcctaatcagtataactataatgttacattcatgaataagacaaaggctgggacaaaataaatgagacacttcactcagacctcttcattgttttcccagttgtcatcctttgcacctagttctgtaatt

SEQ ID NO: 730125 - DNA, 889 bp, Homo sapiens
aggccgcctctcggaagcttggcctcgcaggagcggctctctatcctgtggggagcttcggccagtgggcctcgtgagctggggtcccgcctggggaatccgcatggcaccggtggtctgggggagaggctgggcctggcgcgggacgaggcgaagcgccggtggccgacggcttctgaggaattatcttttacttggcgccacacggggcggggcctcctgctatgctgtggagcgcagtgtcttccatcgttgcctcacagacccgctgctccgggaagtcgccacacattctcagggaacacccacatctgtcgcctgcgccctccgccgctcagctgtttgcttttgtttacgcattccggagacctgacccaccggagcactgggctgagcacaggagaaggggctttggagcgctctttgtactcaactccaagagcgagtgggaaactcaggactgggttgggtggatccctgcgtctctccctagccttcgtcctcttcccccgtttttccactttatgaaagtattgcctagagatgagggctgtccaactcaacacttccaacttcaagttcctacttcacctctaactccctagagttagaaaacaacgtacagcttagaggttcctttccctttttttcttgagaaactttattcagctttatctcaagacatcaccgcttccctctcctgtcaaccttaaatagtgaggttctggaaatatgattaaggatagagtttattccagcgtaaggcttgagggtagccacccaggagacaccagctccaaatggggttagcattccaaagtgaagaagttagggtttcgcctaggtggccagagacaaattttaacaggatttcatttcccctaagaga

SEQ ID NO: 730126 - DNA, 5035 bp, Homo sapiens; identical to SEQ ID NO: 211647

SEQ ID NO: 730127 - DNA, 1352 bp, Homo sapiens; identical to SEQ ID NO: 211648

SEQ ID NO: 730128 - DNA, 533 bp, Homo sapiens; identical to SEQ ID NO: 243231

SEQ ID NO: 730129 - DNA, 783 bp, Homo sapiens; identical to SEQ ID NO: 140790

SEQ ID NO: 730130 - DNA, 619 bp, Homo sapiens
tccaaccagccgcaaccatgcccaggaagaaggcggcggtggcggcctgggaggagctgagctcgggcaacggcactgcccacgccagggcccaggaaacgtggcggccccgcagccggaagcgcgagcctcccgagcgctgcagtagcagcagtggtggcagcagcagcagcggcgacgaggacggcctggagctcgacggggcccccggcaggggcaagcgcgcggcgcagcctgtggcagcaggcaaggtgggcggtgcggctgtggtggtcgccgaacccgagcacaccaagaacacgtctctgcgacacagggttggggtagggttacagattaacagcatctcaaggcagaagaatttttcttagtacagaacaaaatagagtctcttatgtctacttctttctacatagacacagtaacagcctgatctctttcgtttccccacaaatccatatagtatttgagtgtgataatgtaaaaatcagtattcatttctaaatctaagtactgctttgagaattttgttggtaattccagttgctgctgcttcagcagaaggaagcttctccaaattaaaataaattaaaaacttgctaaaaactatgttgactca

SEQ ID NO: 730131 - DNA, 460 bp, Homo sapiens
aactgtcattgtccctgtgtaagcatttccagaaggtgctccctggtgaggctgtgtgggcagagaagcagggaggcctggctccccagaagcaggtcagctgtcaggcaggtggccaggactcagccagaagcttctgcagcaaactggataccgcctcagaggccaggtcctccacggcaaagtactccagctcagggccagggcctccacagcagagtactgccggcaaggggctcggacagcgcgtctactccctcgcggtcccggaggctggagtccaagatctcggtgccacagggctggtttatcccgagacctctctcctgcctggcagacgccagcttctcgctgtgtctgtgtcttcatctcttcttcatataaggacaccagtccatgggaccagggcccaccctaatggtctccatttaaataaatacctctttaaggaccccatctc

SEQ ID NO: 730132 - DNA, 791 bp, Homo sapiens
ttccctttcggccgtgggggagggggctcgtgtcccccccaacccagcccggaggccgcgtccgcccgcgcccgctctggcccccgcggagccgcgcaacttcccgggagcccgggccaaagtgagcgcaaagtgctgcccaagttgccgggatggagctgcagagccggcccgaggcgctcgccgtggaactcgcgcgccaccagaacggcgacctcaagaagcagctccacgaaaggcagccgcggatcgccgcgctcagcgacaaacaaatcgcgggcagaacctctcatctgtgcacaagggacccagcacggggctttgggaacgatcactgcagtgcctgtcacgggtcctcaggtcagctccttgcagaggttggccgggcaaggagcggcagtgctacctcaggttaggccaaagactctgattccagacagcctccccagtgccccgggccgggaccggccacccaagcagcccccaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaaggtgagtgcccaccagcaggctccggaaag

SEQ ID NO: 730133 - DNA, 745 bp, Homo sapiens
ttccctttcggccgtgggggagggggctcgtgtcccccccaacccagcccggaggccgcgtccgcccgcgcccgctctggcccccgcggagccgcgcaacttcccgggagcccgggccaaagtgagcgcaaagtgctgcccaagttgccgggatggagctgcagagccggcccgaggcgctcgccgtggaactcgcgcgccaccagaacggcgacctcaagaagcagctccacgaaaggcagccgcggatcgccgcgctcagcgacaaacaagctttgggaacgatcactgcagtgcctgtcacgggtcctcaggtcagctccttgcagaggttggccgggcaaggagcggcagtgctacctcaggttaggccaaagactctgattccagacagcctccccagtgccccgggccgggaccggccacccaagcagcccccaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaaggtgagtgcccaccagcaggctccggaaag

SEQ ID NO: 730134 - DNA, 1150 bp, Homo sapiens; identical to SEQ ID NO: 443687

SEQ ID NO: 730135 - DNA, 920 bp, Homo sapiens
gctcttggctttcggcttggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggaaaaaaaaaaaaaaaaaaaaaaaaaaaaaaaaaaaacaacccgcagcggaaaaagctgccggcgccaccacaaatgactgataacatcggcccacggcgcaacagagtcgacggcaccccactttgtttacaagggagcaacgcgccggccccaaagagagcgagaaaaatcgaaaccggaacctgaaagaccaaggccacagcagagaccgaacgtagcccaacagccgttgcagcgaacaacacaggaaaaccacgcaaagcacagacagaacaacgaacacgacagc

SEQ ID NO: 730136 - DNA, 1869 bp, Homo sapiens
ggacccgcagcgactccacagggactgcgctcccttgcccctagcgctcccgcgctgctgctccagccgcccggcagctctgaggatggagaggagggcgcggagctcctccagggagtcccgcgggcgaggcggcaggactccgcacaaggagaacaagagggcaaaggccgagaggagcggcgggggccgcgggcgccaggaggctgggcccgagccgtcgggctccggacgggcggggaccccgggggagccccgagcgcccgccgccacggtggtggacgtggatgaggtccgaggctccggcgaggagggcaccgaggtggtggcgctgttggagagcgagcggcccgaggaaggtaccaaatcctccggcttaggggcctgtgagtggcttcttgtcctcatttccctgctcttcatcatcatgaccttccctttttccatctggttctgcgtaaaggttgtacaagagtatgaaagagtaattatattccgactgggacatctgcttcctggaagagccaaaggccctggtcttttcttttttttgccctgcctggatacctaccacaaggttgaccttcgtctccaaactctggagataccttttcatgagatcgtgaccaaagacatgtttataatggagatagatgccatttgctactaccgaatggaaaatgcctctcttctcctaagcagtcttgctcatgtatctaaagctgtgcaattccttgtgcaaaccactatgaagcgtctcctagcacatcgatccctcactgaaattcttctagagaggaagagcatcgcccaagatgcaaaggttgccttggattcagtgacctgtatttggggaatcaaagtggagagaatagaaattaaagatgtgaggttgccagctgggcttcagcactcactggctgtggaggctgaagcgcaaagacaagccaaagtgcggatgattgctgcagaagcggaaaaggctgcttctgagtccctgaggatggcagctgagattctgtcaggcacccctgctgctgttcagcttcgatacctccacacccttcagtctctgtccacagagaagccttccactgtggttttacctttgccatttgacctactgaattgcctgtcttctcccagcaacagaactcagggaagcctccccttcccaagtccttccaaacctgttgagccactaaatcctaaaaagaaagactctcccatgttataggaaggatggggcataatgtgactgtaaaggggcctgccatagaaaagtcacatccctgagggagacactctgtcctcattccctgcccttcctttggttgccatatggaatggccatggaatgcacgaagtcacaatgcaccatccatgagaagacagtgaaatgatgtaatgacagagaaggcagacaacatgtttccgtgactcatctagtcagagcaattatgggaaacagctttggtcaacattctactttggaaagaattttgagtctagatgtggttaaattttgacttctgggaacttggttcagatgtccctttcactgtatgtcctctgacccctttggcaaggttgccacagctcccacagcccttcctacaagcacctatcattgggcttgtcacactctattgctcttctgtcccgaagatgcagtcttctctccaatgatactaccaagtcttagttttcctcaaccacactcaatctttttgctccaccctgaattcctcacacctaaccctgatagttacctaaagtgacacttaaatgtttcagagtgaatgcaaaaaagagagatgtacttggagtcggatatacaatttatccctaattaaagcatttaaaagg

SEQ ID NO: 730137 - DNA, 603 bp, Homo sapiens
ggacccgcagcgactccacagggactgcgctcccttgcccctagcgctcccgcgctgctgctccagccgcccggcagctctgaggatggagaggagggcgcggagctcctccagggagtcccgcgggcgaggcggcaggactccgcacaaggagaacaagagggcaaaggccgagaggagcggcgggggccgcgggcgccaggaggctgggcccgagccgtcgggctccggacgggcggggaccccgggggagccccgagcgcccgccgccacggtggtggacgtggatgaggtccgaggctccggcgaggagggcaccgaggtggtggcgctgttggagagcgagcggcccgaggaaggtaccaaatcctccggcttaggggcctgtgagtggcttcttgtcctcatttccctgctcttcatcatcatgaccttccctttttccatctggttctgcgtaaaggttgtacaagagtatgaaagagtaattatattccgactgggacatctgcttcctggaagagccaaaggccctggctggcctcgaactcctgacttcaagtgatccacccgccttggcctcccaaagtgctgggattacag

SEQ ID NO: 730138 - DNA, 1926 bp, Homo sapiens
ggacccgcagcgactccacagggactgcgctcccttgcccctagcgctcccgcgctgctgctccagccgcccggcagctctgaggatggagaggagggcgcggagctcctccagggagtcccgcgggcgaggcggcaggactccgcacaaggagaacaagagggcaaaggccgagaggagcggcgggggccgcgggcgccaggaggctgggcccgagccgtcgggctccggacgggcggggaccccgggggagccccgagcgcccgccgccacggtggtggacgtggatgaggtccgaggctccggcgaggagggcaccgaggtggtggcgctgttggagagcgagcggcccgaggaaggtaccaaatcctccggcttaggggcctgtgagtggcttcttgtcctcatttccctgctcttcatcatcatgaccttccctttttccatctggttctgcgtaaaggttgtacaagagtatgaaagagtaattatattccgactgggacatctgcttcctggaagagccaaaggccctggtcttttcttttttttgccctgcctggatacctaccacaaggttgaccttcgtctccaaactctggagataccttttcatgagatcgtgaccaaagacatgtttataatggagatagatgccatttgctactaccgaatggaaaatgcctctcttctcctaagcagtcttgctcatgtatctaaagctgtgcaattccttgtgcaaaccactatgaagcgtctcctagcacatcgatccctcactgaaattcttctagagaggaagagcatcgcccaagatgcaaaggttgccttggattcagtgacctgtatttggggaatcaaagtggagagaatagaaattaaagatgtgaggttgccagctgggcttcagcactcactggctgtggaggctgaagcgcaaagacaagccaaagtgcggatgattgctgcagaagcggaaaaggctgcttctgagtccctgaggatggcagctgagattctgtcaggcacccctgctgctgttcagcttcgatacctccacacccttcagtctctgtccacagagaagccttccactgtggttttacctttgccatttgacctactgaattgcctgtcttctcccagcaacagaactcagggaagcctccccttcccaagtccttccaaacctgttgagccactaaatcctaaaaagaaagactctcccatgttataggaaggatggggcataatgtgactgtaaaggggcctgccatagaaaagtcacatccctgagggagacactctgtcctcattccctgcccttcctttggttgccatatggaatggccatggaatgcacgaagtcacaatgcaccatccatgagaagacagtgaaatgatgtaatgacagagaaggcagacaacatgtttccgtgactcatctagtcagagcaattatgggaaacagctttggtcaacattctactttggaaagaattttgagtctagatgtggttaaattttgacttctgggaacttggttcagatgtccctttcactgtatgtcctctgacccctttggcaaggttgccacagctcccacagcccttcctacaagcacctatcattgggcttgtcacactctattgctcttctgtcccgaagatgcagtcttctctccaatgatactaccaagtcttagttttcctcaaccacactcaatctttttgctccaccctgaattcctcacacctaaccctgatagttacctaaagtgacacttaaatgtttcagagtgaatgcaaaaaagagagatgtacttggagtcggatatacaatttatccctaattaaagcatttaaaaggaattctttttgtggagattccttttttaaataaagaaataaataaaaggacaaaaac

SEQ ID NO: 730139 - DNA, 659 bp, Homo sapiens
cagtgaagaaatatatatgagatactccagccaaaaatgcacacaagtcaaatcaaaatgaaaagactcagaaccatcatcaacaccaagatcaaaagggcaagaatccttcaagaaacaggaaaaaactgctaaaacaccgaaaggacctagttctgtagaagatgttagagcagaaatgcaagcaaatatagaaaaaggtgattcttttcccagagaggaagcaaagttcatcaattatgtgaagaattgcttctggatgactgaccaggaggctattcccgatctctggcagtggaggaagtctctttaagaaaatcatttaaacaatttgttaaaaattttccatcttatttcattcctgtaacaggtgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagtagcacggtttctattgacttaaaaaaaaa

SEQ ID NO: 730140 - DNA, 262 bp, Homo sapiens
gaatcaaggttttctaattatttttctgtcatacataagtagcataggagacaaaagcccagagttaacttcctccaggtgcatttgatagatgtttgaatatctgatcattgctatcctaatttttaaaaatgcacataagtgttgcaaatactaatttcgtgtagttaaaatgtaacccttctcctacacgcatatcttaatgtgcctaaagtgaatttttaaactctaattattaaactcagggcatcttctggaattg

SEQ ID NO: 730141 - DNA, 627 bp, Homo sapiens
cctgtctgggagcacttatagggctcacagctggcgttctgcggctggtagagtttgtgcacctctagtgcctcacagactttgataagcaggaactacgtggagagctagtgaaaatgcagattctgattcagaagttctggagtggggcctgagactcagcatttctagacagctccagggagacgctgatgctactgatccaagacacactgtgagtagccagaaagtaatgaggggttttctgctctggaattcctgcttatttgagttgccactgctccccaggaacttctgcttgtctttgtaccccacagtgcctagattcctcaactctaaccaaagcttttggtttttgtttttttttttttggcagagtgttagctctggcctcctcctcttcctgcgagcctcaggccttttccccaggtccgccagcgctgcctccgctgttgcctccgctccccgcagcctcggcgcccccaggccccggcgcctcccggcgcacaggccgctactcagtcgtcgcctcctccccggaggccgccccgcgtctggtcgactggctccccggttgcccttcgaccatctctcccagcacacgcggggatgacaaggagcggccgc

SEQ ID NO: 730142 - DNA, 899 bp, Homo sapiens
gcggccgccggcaactcgtccgtcttgataaccatggtggcgggagcgggcgtccgcctcggctgtccgcgccgcccgccgcgccactaacccaagtgccctgcgcgccgcggctgctgagggaaggacggagtcaccggcccacgtggtgcgcgccgtggcctttgaccccgccgccgtttccctgccccaccctcgcgcccggcccagcccacggcggcccgcgagggacaaaacgcgccgcgcctggttccccgcccacggacgcggtgactttccagaacgtcttaaaggcaacgcactctgactcaaggcccagggaggctgggcgccctcgcggggcggggcctcggggagactccctgctgctcgctgcccgtcgggcgggcactgtgaccttgggtggagactggtctggttctgccatggctaatcctcccctctccaaggatcccctgttttctcttgcagatttgctaaatgaccgcgcagtctgtcatctgcggtgttcgcgtgaccctcagcgccctccccacccggcaggccctttcccgccgaatgggtgcggctggattattgagggagtggagggtcgcttagggcacgggcacgagaggcgagggcgagacgtggctaatggggatcaagagtcagaatggacccgccaaactttgccccgagccagaacgggctccctacccgcgtcctcgacccatgggtcctcacctccaggctggtgtcctcattttacagtggaggaggccgagaccaaggggcttggcggggacggaacggtgaggtcagagaatgctgcagaggggacattgggaccaggtcttgcagtgagttgaagtgctccaggcagagagcgccggtgggtctttcctggccaggccgca

SEQ ID NO: 730143 - DNA, 492 bp, Homo sapiens
agcacgaaaagcgggccaacgccgcctctggggacgccatccgggcgagggtgggatgccgcgccaccgcccgagcgtgcccgggggctcccagcgccatcaccacgcaggtgcccgggggcccctccgcggagccggctgccgcccggctgcaatactcagcctccgagggactgggcgctcctgaggagcgggaggacgacggagcagcgcccggtcctggagcacaacaggaatcccaggaccaaacccatgtgacgcggccacgccccaacgcccggcgggggccctctgctgcccaatccccggatccctggttctcatggcaaccctgaagaaccccttgttccctccactgcctcctctcctcccccacagcccccccgcctgatgggcaaggacgcgcacactggccactctgacgatgccgaaagccctccatgtctacccgctacgccgcattcgcagacaggcgggggacatcgcggccgc

SEQ ID NO: 730144 - DNA, 1016 bp, Homo sapiens
gctttcataagcccttcaggcgatactgatgtaaactaaagcttaaaaaccaccgttttactgtgacttcatgaagaatataattgcaatatcacctaaatttttatcctggctgggatggggcagattcttactatggacaatttctggaacttacagtatgaagagcagatgaggagtttgagacaaagaaaaaattgtacagggagtttagtgaattttccatcaggttggccattactttctttctctaaagtctcaggatgtctggaagcaaggaaagacaaaagacttgaagcaccgggtgcatgctgtgtgtcacaagtgaggtggagagttggctgtggaaggtacagcaattcctctggaattaaatgaccgaccaacacagtaccaagaggatgaagagaagatgttttgcgttgctacgtgaatcagtggatgactcatatttcacttgcatatgaaatataaggcagttaacatcttgtttgtggcttaagcaaggacattaatcctactagatgaaggggaagttggttctgttgtcttaagggatgcccccttgtgattttggtcaactgaatgaaaaagaaaagatagccttggacttttttttcatgggaggtttggaggtcaagcatgtagaaggaaaaggctgtagtcatgaatatagaactgtctgctctccaccttttcctcactctacatttagtcatcacactgaacaggatgtggcctgctgacagtgagtagctgaagtgcctgtttggtaagtaggttagcattcatcatgaactctgaaagccatttcagagtttggctgctgctctgaccctgctgtggtacaaaaaacatggatttttttttttttaactggagtaataccaaattccctttagaagcttgaagtttgatactattgctttccccattataaggattatacagtattaattaattataaggcccaaagtttgttttggcaaataaagtattattctctatcatcatct

SEQ ID NO: 730145 - DNA, 2174 bp, Homo sapiens
  misc_feature (512)..(512): n is a, c, g, or t
  misc_feature (656)..(656): n is a, c, g, or t
gccgaccagttccgcccgggcgcgaggaccggccgcaggaagcttgctgcaacaactttatttggaggggttgcatgccctgtcgccaccccgacgctgcctgggtgcctgaagtgctgctgcctgctgtagtgtgtccccctgtgtgcctgatgatgggtgtgccctggagtggaagatgcgctggtgtggtggctgcccctggcccctgatgccctgtggtgctatgtgccatgtgttgacctgtgctgtgcgttgtgtgtgctgtgcccctgtgctgtgctgacactgacactgtgctgtgtgacaatggctggtgctgtgcgtaccctgctgctgctggcctgagggacgactcggcctcgccccccggtgccgccagcgacgccgagcctgggctgacgaggagcggcctggggcttgcaggtgtgacttgcgtggtgttgcggggacaagtcgagctggcaagcattactggtgtcttcacctgcgatgggctgcaagagcttttncaagcgaagcatccgccgcaacctcagctacacctgccggtccaaccgtgactgccagatcgaccagcaccaccggaaccagtgccagtactgccgtctcaagaagtgcttccgggtgggcatgaggaaggaggcggtgcagcngcggccgcatcccgcactcgctgcctggtgcctgtggccgcctcctcgggcagaccccctgggctcggcagctggcggcatgtggcagagctggctggagacctcttccctggtggcagccgtgtgtccgaacttgatcgcggcagcgtgctgcgcgctgagccctaccctgcggcgtgccggacgctatcgcggcgcagggggcgggacgcgcgcagtggacgcgggatgacttgtggcacttcggagcaaccgatgtagccgaggactagagcagagagacagggattgcatcgtttcaggcacacccatgggaagttggagacagacagcacaacgacagacaccctttacttttccccccagagaccttggcccggtgtttgggacgacgaaagcgcaaagaggttgagactgcccttgtacattgcacagaccacattgtaaggacttttgaggaaaggacaggaaggacattcatataccagatggccattggaaaacacagaccgaggagagaccgagtaggctggtagctgactattggagacccccacatttgagcaaaacacgccgaaggagtggacccaggtcattaacatatgaggaccccaggacacagagacactggggatacattatccccaaacaggaccagcgggaagtggcaggcagttaaatgtagagagcaccaggcagcaggacaggacaagtacacggccgctggatggaggactgtttttgtccaagattgggggcgaaccacaagagggggagttgacggagcaagggccaccattagtccacccaagaggggacacgacacgacagcggattaggggaacacacaagcggtcacatttggtgggggcaccagggccgccatatggccaacggagggtcacgaaccattgcagtagtagcacggaaaggcttacgttagcggaattggccacatcgaacaggtggcaccaaaatccggcaaggcagattcattatgcaaacaggacccgcccgggaaacaggagcccaaagatgtggggccgccgttccggttcaaaggaagacccacgagggcgcaccaagcagagaattttagaaaggcaaagcaccattgacacaggacggaagcgagaacagggcagggcgaagagggagttggagaagcccaataacagaccacaggacagagattaatactgtatagcaagtagagagacatgcaaacaggaatcaccacactggagtcacaccaaaagaagccgacccgacagacgggcaaataaaccagaagtagctaggacacgtaggcggatagcaatggcaagagagaatagtacaccacaggtgacacaccatgtaagcgaacagcacagagagatatacacacagtatgaagcaattacaccaattagcagaatacatataccacgcacagcgaaggtgagaacaaataagaagacaggagcggagccataggcaattggagagaggacaatcgaacagggcacaccaaaa

SEQ ID NO: 730146 - DNA, 1270 bp, Homo sapiens; identical to SEQ ID NO: 722412

SEQ ID NO: 730147 - DNA, 518 bp, Homo sapiens; identical to SEQ ID NO: 202322

SEQ ID NO: 730148 - DNA, 922 bp, Homo sapiens
gcacgagctgacaattcccttttgaatgtcaactccctgataacagctatcttgtttgtcttgttctgattgtatccgtcataccttagcatctggcatattgtaagctctcatatattcagtgaataattaaaccatgccctgatatgatcaggctctggccttgctatcctctcaacttcccctctaaatcctataaactagtgttactcaaagtgtggcccatgggcctgtagcatcagcagcacctagaagcttgttagaagtaggttcttgggccccatactagacttcctgaatcagagtttctggatgtatggcctaggaacatggatttaagcaacctgtattggccattcttatgtatgctgaggtccgaggaccactgccatgatcatggaaatctcatccacatcaatttttgccttctaaaaaagcctgatctttgttgcagtgtggagtttgctacacatgcttggctgcatggggccctggattatccacaggaacttgattctagaaataccaaagcactgttgtttcacagcagcccgacgagtaggccctgcatggaatgaggcttttgctatgtcttcctgcatggtcacctctagtcatttgagagcttccattgcatgcagatcacacatagtaggagatgccatcaatttatcaattatttcaagcacactttaaattcatcttccttctgtctacctgagaattgctaatgttatattattcactgaccacaaggaaaatgagaaaattggttgctatcatttcactatctatagaagacaaagcactgtctttatttttacagtagaagtgctctaaagaatttctgtgtcaacttgagatacttttcacaaagacaagaagcattttacttttctgagagaaaagagaataatttaaa

SEQ ID NO: 730149 - DNA, 975 bp, Homo sapiens
gcacgagctgacaattcccttttgaatgtcaactccctgataacagctatcttgtttgtcttgttctgattgtatccgtcataccttagcatctggcatattgtaagctctcatatattcagtgaataattaaaccatgccctgatatgatcaggctctggccttgctatcctctcaacttcccctctaaatcctataaactagtgttactcaaagtgtggcccatgggcctgtagcatcagcagcacctagaagcttgttagaagtaggttcttgggccccatactagacttcctgaatcagagtttctggatgtatggcctaggaacatggatttaagcaacctgtattggccattcttatgtatgctgaggtccgaggaccactgccatgatcatggaaatctcatccacatcaatttttgccttctaaaaaagcgtgtacgtttatgggacaagaatgtcatgtcatctgtgtagctccccctgaacctgatctttgttgcagtgtggagtttgctacacatgcttggctgcatggggccctggattatccacaggaacttgattctagaaataccaaagcactgttgtttcacagcagcccgacgagtaggccctgcatggaatgaggcttttgctatgtcttcctgcatggtcacctctagtcatttgagagcttccattgcatgcagatcacacatagtaggagatgccatcaatttatcaattatttcaagcacactttaaattcatcttccttctgtctacctgagaattgctaatgttatattattcactgaccacaaggaaaatgagaaaattggttgctatcatttcactatctatagaagacaaagcactgtctttatttttacagtagaagtgctctaaagaatttctgtgtcaacttgagatacttttcacaaagacaagaagcattttacttttctgagagaaaagagaataatttaaa

SEQ ID NO: 730150 - DNA, 924 bp, Homo sapiens
gcacgagctgacaattcccttttgaatgtcaactccctgataacagctatcttgtttgtcttgttctgattgtatccgtcataccatgccctgatatgatcaggctctggccttgctatcctctcaacttcccctctaaatcctataaactagtgttactcaaagtgtggcccatgggcctgtagcatcagcagcacctagaagcttgttagaagtaggttcttgggccccatactagacttcctgaatcagagtttctggatgtatggcctaggaacatggatttaagcaacctgtattggccattcttatgtatgctgaggtccgaggaccactgccatgatcatggaaatctcatccacatcaatttttgccttctaaaaaagcgtgtacgtttatgggacaagaatgtcatgtcatctgtgtagctccccctgaacctgatctttgttgcagtgtggagtttgctacacatgcttggctgcatggggccctggattatccacaggaacttgattctagaaataccaaagcactgttgtttcacagcagcccgacgagtaggccctgcatggaatgaggcttttgctatgtcttcctgcatggtcacctctagtcatttgagagcttccattgcatgcagatcacacatagtaggagatgccatcaatttatcaattatttcaagcacactttaaattcatcttccttctgtctacctgagaattgctaatgttatattattcactgaccacaaggaaaatgagaaaattggttgctatcatttcactatctatagaagacaaagcactgtctttatttttacagtagaagtgctctaaagaatttctgtgtcaacttgagatacttttcacaaagacaagaagcattttacttttctgagagaaaagagaataatttaaa

SEQ ID NO: 730151 - DNA, 501 bp, Homo sapiens
tggcacctgcagttaaaaccctaacaatatacattgtcattttacaaaataaaattaatagcttcacttctacttcattttaaaataagatcatctgcactctgaggcagcattcgtctgcccttgcaacgtgtaactgtcagagtggggtactacagaggactacctgcattatattccctcaaaaacggttttccactcaggaaagttattttcaattgggaaatctgttctgcccattcaaaaagtcttacagccactgatccatggccacagactgcactggaataacctcagaaataataatattagcagcttctatctattgtctactatgtgccaagaaataaacagatagtaaacaactgaattcttaacagcaatccttaaaagtaagtgatattatttctgtcatttctctcaggggtctacaaattatggcgtggacctaatctgaccagcctcctgatttataaataaagctttattggaacagtaaaa

SEQ ID NO: 730152 - DNA, 1010 bp, Homo sapiens
gggcgggatgagaaaggtgctggagctgttggagggacgccaggaggtggcaactaccaggggtgtgaggggctgacctgggatggaatcctgccacccggactcaggaagaaaatcctgaggtggcgacctgcagactgggctgggagatggagagcccgctcacgcccacccgaccgcctaccaccagtgttcccggatgcatgggctccagcgcctgccctttcgccatttcctcccaactggcattaaatcctggtgtggtagatatcagtgattaagagtctaggcagccacgtgttctattgccgccagtccgcaggaaacgcaagtgatcgttttgctgcgttaactctatgggcgcccaaatcttaggaatccattccacgccaccccgaaaacagcgcttgacccttctggactgccacgcaggaggcgatcaatgtttttctttctttatttttttaagagacaaggtctcgccctgtcacctaggctggagcacaatgaggctcactacagcctggaactcccggacgcaagtgatcctcctcagcctccggagtagctgagaacctcaggcgtgcgccaccatgcctggcatcaatcaatgtctttcaaaataaaggctgttaaacgtagtataggaaagaagctttttaatggtaggttctaccagacgtgtttgtttgatttttaggtttggttaatgcattgtttcccgtacaatctcaacccgcggaaaccccgaaactctagaattcgtgccggtctctttcgcttccaggtcatccccggggcaacggccgccgctctaattcttgtcagaacctccaggccagtttcagcaacgtgcaggcagaagctggcccctcggtgggatgcgagggcgtgtggagcgcggggaggagagccccacaggcctttcctgggcacccgcggtggatgggaaggctccttcgggcgcctttcagggaagttgtttggctgagggaaggtggtccgtcacg

SEQ ID NO: 730153 - DNA, 537 bp, Homo sapiens
gtcatttttagaatgttcctagtccatccaagaaaggctaaaaaatgttctgtgtgattctggacttaagaagtctttttcactgaattctggccctagatgctcactcaactagtaaccataatgccctgtttttcccaaatgctgaaatggaacatttactgcattggcaatgttttctagtgggattggttacagaaactgtcattcattcttactgtgcaatattacacagccataattaatgatgtagttaaaaacatttgatggcatataatatatatatacattgaatacattgtaagtaagaaaatatacaggttagaaaactgtaggtatagcatattgtaaaaagaaaatatatatacacgcatagcgaaaaatgtcaggaagaatataccaaaatgttaacgattatctttaagtagtatcatcttttttacttcttgtctttctgtttctcctaaaacttctaaaataaaaaggtattatttttcatgtaaaagtttaataaacttatgtgtccatttaaaaata

SEQ ID NO: 730154 - DNA, 1160 bp, Homo sapiens
  misc_feature (151)..(151): n is a, c, g, or t
  misc_feature (153)..(153): n is a, c, g, or t
  misc_feature (155)..(155): n is a, c, g, or t
  misc_feature (157)..(157): n is a, c, g, or t
  misc_feature (159)..(159): n is a, c, g, or t
  misc_feature (161)..(161): n is a, c, g, or t
  misc_feature (164)..(165): n is a, c, g, or t
  misc_feature (258)..(258): n is a, c, g, or t
  misc_feature (535)..(537): n is a, c, g, or t
  misc_feature (540)..(540): n is a, c, g, or t
  misc_feature (542)..(542): n is a, c, g, or t
cccactcgaatgggtaaaatattggcaaggatgttgatagtaagaaaaataaatgtaaacatgccccgatttacggttttccttgtcaaacatacccatattttcatggctttgtggactttggtctctatcatttaagaatgtcatagantnanantntntgnnataggaagggatattagagttcatctataataatgtttctcaaactgcttccttccagttttgttacctcaaagacttattttttctctctgncctctttcattatgtgtaaatgagtaaaatgggtatgatgccaaaagtttagtattgttacaggtattatatctggaaataaatgttttataaaactgtaaaaactctagtagttgggagctgtggcttatacctgtaatcccagagctttgagaggccaaggcaggaggattgcttgaggccaggactgagagatcagcctgggcaacatagtgagacccccatctctacaaaaaatttagaaaattagccagtcttagtggcatgggccaatagnnntancnactccataggccgaggcaggaggatcctttaagctcaagggtaagcagctgtagtgagctttgattgtgccactggcactccagcctgagcagaccgtgagacttcatctcttttttttttttaaaaaggttctggtaattacctatgacctcccagggtgatatttcaacccgtttgccttcacccttattccagaaatactaaactttagaatgatttggagggcaattcatctggatttcctctcctacaggtaaatatttttaagttgtaaaggtgggagctttatattatgaatatttcgcagggttttttccactcgcgctcctttaatggccaaccaatggaagtggtagtatctcctcttcctgtaataagggaggggattaggccatgattattttacctaggatttctctaattaggacctgggggtgactctaggccattgctaccaaatgagtttctttaccattattaatttgttgagaggcggggaaagcataagaattgaaaggaaacattaccaaggctcaaaatgaacttgcattggcttgaaaagggaccacaagaagattgggagcggcaaaattcggttacagccaaaattgaccgca

SEQ ID NO: 730155 - DNA, 565 bp, Homo sapiens
gggttgggcaggcagccgcaggccccatcctcagcggcccctgaggcgctggcggttgcagccccgggggtccgttccgaacctcgactcctagtggtgccggcgcccaggccgcctctcagcggcggcagcgtgaagcccggcggcgagggcggaggtggcggccctgcgggcggcgagctggcggccaacatgttccccatggtcgctggcggtggcacctgctcccggcctggtctccgctcccacccggtgcgccacgcgcaaccgaactcgctgccgccgccgccacccccgtcgccagcatggtgtatcttttggacatgtccattttggaagaaacttttgtgttaaaataaactaatatattatgggctagaacataaaattcaccaagaatttcaagataaaaatactaatgttttgcttgtttgggttatttcaaacaataactttgtctataattttttcaccaccgaccctctacctccttgcatgctcattctcctgtgtggctagatgcatttcgggtgttttgaatattatttcagagcgtatcattccg

SEQ ID NO: 730156 - DNA, 782 bp, Homo sapiens
cacaaaaaccctgactatcacctgatagattgcttgtgctgcctgataattactcgcacttttcccaggctagtgcaaatcttcaggggccgtccaggactacagagctgtttcaccctaccttggcttcaatctcttcccccatgctcgaaggtgcggagctgtacttcaacgtggaccatggctacctggagggcctggttcgaggatgcaaggccagcctcctgacccagcaagactatatcaacctggtccagtgtgagaccctagaagacctgaaaattcatctccagactactgattatggtaactttttggctaatcacacaaatcctcttactgtttccaaaattgacactgagatgaggaaaagactatgtggagaatttgagtatttccggaatcattccctggagcccctcagcacatttctcacctatatgacgtgcagttatatgatagacaatgtgattctgctgatgaatggtgcattgcagaaaaaatctgtgaaagaaattctggggaagtgccaccccttgggccgtttcacagaaatggaagctgtcaacattgcagagacaccttcagatctctttaatgccattctgatcgaaacgccattagctccattcttccaagactgcatgtctgaaaatgctctagatgaactgaatattgaattgctacgcaataaactatacaagtcttaccttgaggcattctataaattctgtaagaatcatggtgatgtcacagcagaagttatgtgtcccattcttgag

SEQ ID NO: 730157 - DNA, 934 bp, Homo sapiens
tgaatgtgggaaattttttagccaaagctcaagcctcatgcaacatcgaaaagttcacactggagaaaaaccttttaagtgcaatgaatgtgggagattctttagtgagaattccagccttgttaaacatcagagggttcacactggagcaaagccttatgagtgcagggaatgtgggaaattttttcgccacagctccagtcttgttaaacatcgaaggattcacactggagaaatacaatgattgtgagaaatcctttagctggtgtttcaacctcattcaacaccagaaagttcacggtgtaaaaaagtcttgaaggttactaatggaaatccattagctatacctccaaactcattcaacactggacagttcacagagtggacaatgtagtgaatatggtaaaaggcctcagccaaaggcctaaccgtattcaacaccagaaagtttagactggagaaaggccttagactgtcgctgaatcaatatgacctgacttaaagcagaaacagccaggcgtggtggctgacacctgttattctcaccactttgggaggctgaagcgggcggatcacaaggtcaggacatcgaaaccatcctggttaacacaatgaaaccacatctctactaaaaatacaaaaatttactgggcatggtggtgggcgcctgtagtcccagctactcaggaggctgaggcagaagaatggcatgaacctaggaggcagagtttgcggtgagctgagatcacgccactgcactccagactgggtgacagagtgagactctgtctaaaaaaaaaaaaaaaaaaaattagcccggcgtggtggcaggcaactgtagtcccagctacttggggggctgaggcaggagatttgcttgaacccgggaggcggaggttgcattgagccgagatcacgccactgcactccagct

SEQ ID NO: 730158 - DNA, 539 bp, Homo sapiens
ccagtgttactaactgtaattctatcctgttcttcactggggaaaagcttttccagtgtgctgagacagttttggttatgtaactgttaaaatgatgacagtcgtgtggcctgcggatagcactatgattttctcacagtgagttgaacctggcaggtgttgccactcacatctgaccacatttataacactttctgtactcgtatcttgtgccagtagtctgctagtccagattcatgttcctttttctcttttgaaattaaactcatagcctccaaaaatttgcatttgccctgttttgaggggggagaagtggagactattcatgatgctcaatatatcatagtattaaaatatacattgcaaattcctttgtatttatgcccttttgaaataaaaatgaatgttcttagcaaactcaaagttcttgaactctgtagtttacacatccttagaacagcactaccttgtatgtgatattcaagagactgactttctaaagagtcttagagccaagcttttacacatctaaaaaaata

SEQ ID NO: 730159 - DNA, 412 bp, Homo sapiens; identical to SEQ ID NO: 601597

SEQ ID NO: 730160 - DNA, 486 bp, Homo sapiens; identical to SEQ ID NO: 601598

SEQ ID NO: 730161 - DNA, 689 bp, Homo sapiens
cttctggccttgtttttgtttttctgttttgttttgttttgttttagcacaaccctttttcttcttcttcacttcccttcttggtgctcagcctgttccagccaccgtgtcaacatgccttggtccatagctctggaaggcacacaccaagcaggaccagtgaacagaagatgagaagggtacattttgacaccaaactgcctgggttggaaacccagctctgtgacctaggaccagtcacttaacttctgtgcctcggtttccccatctgtcgactggggatgatgagagtatctctcactgggttgttgtgaggaatggatgaggaagtacaaatgccgtgcctaaagcagcgcctggtgcacactgatatgataagttttattattatcatcatccaattatcatgatttctggcaagtgggcacttccgttcagaaatctcggtgaggagacagggccatccaccgtataagaatgcaggctcagcgtttggccacttccattgagaatcaacggtgacttatttgcaagtccccatcccctcaattgtctcccatcgaaatgggctcacggcttggtctgtgtgtccgtgggccccatgcttagcctagaaatgatgcacgaaatagcacctcttaggctcacatcaattgcgtattttggggttccccctttggggtgggggg

SEQ ID NO: 730162 - DNA, 574 bp, Homo sapiens; identical to SEQ ID NO: 601605

SEQ ID NO: 730163 - DNA, 645 bp, Homo sapiens
gcattaaactgagaagaaccactgaggaaagcatgccacagtctttcccaaaatccctgtgtcttaaggaacaaccaagaaagttaactggtcagggaaaagatttcttttggaacacagagaatgatgggagttgtgatccatacctccgtgtgcataatggttgtacctgctccaggaaggcgctggatcctcccaactccatgggaagagattaggacacaaacaacagacagaaggtgaccacaggaggacacagtgagaagctggccatctgcaagccaaggagagagacctcaggagaaaccaaacctgccagcaccttaatcttagacttctagccctcagaacgaaatgttcctcaccccccaagaaggaaaccctgtacgcatcaagcagtcattcctcattctcctctcccccagcccctggagacctttcatctgctttctgtctctatagatttgcctgtactagacatttcatatgactggaagcatataatatgtggtcttttgtgtttgacttgttttacttagtctaatgttttcaaggttcgccatgttgtaacatgtacactttacacaattttaagcctaatattctttaagccatatattcaaaataaacagcttacaaaaatga

SEQ ID NO: 730164 - DNA, 767 bp, Homo sapiens
tttcccaagttgtatagtgtaatcggcagctggtcagctgacatgatgtcaataacgacagcataacagatgaacacagatgcacacaccactgtcagtctcagcacataagaggtcaatttttgagatggagtcttgctctgtcaccaggctggagtgcagtggtacgatctcagctcactgcaacctccgcctcccgggttcaaggattctcctgtctcagcctcccgatgtagctgggattacaggcctgacccaccatccctgacccaactattgtttcttaaaaaaaactctttttaaccttgcctttttgttagggtagaaggatagctcagagcttcaaagagcaggactagcctaagaactgtctgtgatatttgaccagaggtgcagcctagctgccattcttcctcaccctgtggaagacattaaagggagaatgaaagtagctgtagaattacctttgggggaagaagccacttggtgaacttggcaaacacccgtgtttgaggggaaaagaccctgggtgtcatgagctgggccggaggggatggattgattacttgtcttgtttgcttgtttctgttgtaagtcagggcccctcagcagaaggcagaacagaaccgagttcctttagaatgctggtttttgtgtggagtgaggaaggaccgtgagtgtggtcagtttccaacctgacaggacctgctcccgttggccaggactgcagcttgttactttgaccctgggaagaaggtaagtgttcc

SEQ ID NO: 730165 - DNA, 430 bp, Homo sapiens
ggatccccttacaaccccacgatcacctttccaagatacaggtcttccccaccccgagtttttgagatggagtcttgctctgtcaccaggctggagtgcagtggtacgatctcagctcactgcaacctccgcctcccgggttcaaggattctcctgtctcagcctcccgatgtagctgggattacaggtgtgtgccaccacacctggctaatttttgtatttctagtagagatgggattttgccatcttggccaggctggtcttgaactcctggcctcaaggaatctgcctgccttggcctcccaaagtgctgggattacaggcctgacccaccatccctgacccaactattgtttcttaaaaaaaactctttttaaccttgccttttgagcatgcctgtgttgggttgacagtgagggtgtcgtgggta

SEQ ID NO: 730166 - DNA, 783 bp, Homo sapiens
tttttgagatggagtcttgctctgtcaccaggctggagtgcagtggtacgatctcagctcactgcaacctccgcctcccgggttcaaggattctcctgtctcagcctcccgatgtagctgggattacaggtgtgtgccaccacacctggctaatttttgtatttctagtagagatgggattttgccatcttggccaggctggtcttgaactcctggcctcaaggaatctgcctgccttggcctcccaaagtgctgggattacaggcctgacccaccatccctgacccaactattgtttcttaaaaaaaactctttttaaccttgcctttttgttagggtagaaggatagctcagagcttcaaagagcaggactagcctaagaactgtctgtgatatttgaccagaggtgcagcctagctgccattcttcctcaccctgtggaagacattaaagggagaatgaaagtagctgtagaattacctttgggggaagaagccacttggtgaacttggcaaacacccgtgtttgaggggaaaagaccctgggtgtcatgagctgggccggaggggatggattgattacttgtcttgtttgcttgtttctgttgtaagtcagggcccctcagcagaaggcagaacagaaccgagttcctttagaatgctggtttttgtgtggagtgaggaaggaccgtgagtgtggtcagtttccaacctgacaggacctgctcccgttggccaggactgcagcttgttactttgaccctgggaagaaggtaagtgttcc

SEQ ID NO: 730167 - DNA, 967 bp, Homo sapiens
  misc_feature (24)..(24): n is a, c, g, or t
  misc_feature (39)..(39): n is a, c, g, or t
  misc_feature (42)..(42): n is a, c, g, or t
  misc_feature (46)..(46): n is a, c, g, or t
  misc_feature (48)..(49): n is a, c, g, or t
  misc_feature (53)..(54): n is a, c, g, or t
  misc_feature (74)..(75): n is a, c, g, or t
  misc_feature (88)..(88): n is a, c, g, or t
  misc_feature (93)..(93): n is a, c, g, or t
  misc_feature (102)..(102): n is a, c, g, or t
  misc_feature (104)..(104): n is a, c, g, or t
  misc_feature (108)..(108): n is a, c, g, or t
  misc_feature (123)..(123): n is a, c, g, or t
  misc_feature (144)..(144): n is a, c, g, or t
  misc_feature (153)..(153): n is a, c, g, or t
  misc_feature (159)..(159): n is a, c, g, or t
  misc_feature (168)..(168): n is a, c, g, or t
  misc_feature (181)..(182): n is a, c, g, or t
  misc_feature (185)..(185): n is a, c, g, or t
  misc_feature (188)..(188): n is a, c, g, or t
  misc_feature (198)..(198): n is a, c, g, or t
  misc_feature (200)..(200): n is a, c, g, or t
gccaggcggagacccggaggaccnaagcttccggacgangangaancnnccannatggcctcggagagtgggannctttggggtggcnggttngtgggtgcngnggancccatcatgaaagtncaacgcgtccattgctacgancggcacctntgggangtggatgtnaaggcagtaaagnntanagnaggggcctgnanaaggcagggctcctaaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagggggaagcagcctgatgccccagaagaaaaaccccgacagtttggagctgatccggagcaaggctgggcgtgtgtttgggcggg

SEQ ID NO: 730168 - DNA, 529 bp, Homo sapiens; identical to SEQ ID NO: 232065

SEQ ID NO: 730169 - DNA, 578 bp, Homo sapiens
agagcaagcattttaaaagttgaagtgcacgtcgggggtgaaagaaacccacgtactcgaatactgtcctcctggagttagaaattacgcgttttccttttctaaggctgtaaagaaactatagttttctgtcgtatttttttctgatgtgtctaaatcactcagggtattgaaatcccagttatatcgttcaaaattgggacctctaattgaataactgagaggactactgtagagcgtcccctactacctgttttcattagctccacgggctcttgggccaggctccctccccagatctgaggaagacttccatggtttcatcctatgttccttcaactcgttggaagcccaggattcctagagcttttccaagagaactctgacgtgcagttctcgatcttccagatgcgaaccttgattgagagtgataatcaactttgttttgattgaactgacatttttttctgtggttttatcactttttattttttatgggtgtatagtaggtgtatatatttatgggttacatgagatattttgatagcgtacattaaaatgtataattaacattttta

SEQ ID NO: 730170 - DNA, 800 bp, Homo sapiens
gtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccatggaattcttcgggaaatcctccaaggactcttgtcagctgtgttggaagccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctga

SEQ ID NO: 730171 - DNA, 1251 bp, Homo sapiens
agccaagtccttctggctgcagttaaaagggctcaccggcctctccctgaagtcttggcccgggagcctgtgtcctccaggtagctgtgctgtggggagctggagaggactgaagagctgaggaggcgaaatgcagaaatgataatgcctcacaagctggttgtacagattgaataacaatgtgaacagagcaccgagtataatccctgaaacagcaaaccagaggtcccgtctggctggcatgaatggaagggcaaacgctccgaccaaattgctctgggaatgtcattctaattattggatcctgacccagcggcatgctgataagctctgggttggagacgccctatctcagaggagctccaaacctgctcaaggccttttcttgccctctgcaactttcctgccaagcaattagcctccagggaagaagaggaaattggaacacggacacgcacagaggaaagaccaagtgaagatacagtgagaagatggccaacgacaagccgaggaacagggtctcagaggaccccaaccctgctgacaccttgatctcgggctttcagcttccagcactgtggcaaaattcatttctactgtttaggcctcccggtctgtgacatgttgtcacggtggccactgaagactcagacagcttccttctagctctggttcttctacgggtgtgctttcaggtgctccggagggcccggtggcagggaaagccaggtctccaggctcctggcccagggcgtgtttaggaggcagggccttctctgacacaagtatgaggagcagagaggtttctcttcttcagtctccactaggtcctggcctccatggcttctataggcagggacctggccagggcattcaccagagactttgacagggagtccaggcccagaccccataggcagagccaggagccctgtgccagcttcccagggagcaccggggcccaacgtagagtcaagagctggcatcagcacaggtgcaaggtggggttgggaagggcatggcagcttgggggtctgcagtgcacaggtggcctggcatgaggtaggtgggccggcttgaaggtctagaagatggatagacaccagagacttgtagtctatgtctccttcttgctgtcccctggatgtcacctcccctctgcccccagtgctgaactaacccccttcatcttttacttgggactccatcagtgactcatcattgcttttggtgtgacttaccagcggccgc

SEQ ID NO: 730172 - DNA, 1580 bp, Homo sapiens
  misc_feature (496)..(496): n is a, c, g, or t
  misc_feature (563)..(563): n is a, c, g, or t
  misc_feature (573)..(573): n is a, c, g, or t
  misc_feature (653)..(653): n is a, c, g, or t
  misc_feature (692)..(692): n is a, c, g, or t
  misc_feature (1113)..(1113): n is a, c, g, or t
  misc_feature (1162)..(1162): n is a, c, g, or t
  misc_feature (1173)..(1173): n is a, c, g, or t
  misc_feature (1176)..(1176): n is a, c, g, or t
  misc_feature (1302)..(1304): n is a, c, g, or t
  misc_feature (1308)..(1311): n is a, c, g, or t
  misc_feature (1313)..(1313): n is a, c, g, or t
  misc_feature (1317)..(1317): n is a, c, g, or t
  misc_feature (1319)..(1320): n is a, c, g, or t
  misc_feature (1322)..(1322): n is a, c, g, or t
  misc_feature (1326)..(1327): n is a, c, g, or t
  misc_feature (1342)..(1345): n is a, c, g, or t
  misc_feature (1347)..(1348): n is a, c, g, or t
  misc_feature (1351)..(1354): n is a, c, g, or t
  misc_feature (1361)..(1362): n is a, c, g, or t
  misc_feature (1379)..(1379): n is a, c, g, or t
  misc_feature (1381)..(1381): n is a, c, g, or t
  misc_feature (1416)..(1416): n is a, c, g, or t
attcccattgctgtgcctacaccttcgccacccactatggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccacaccaccagtggattatgaagatgaggaggctgcagtagttcagtataatgatccatatgcagatggggatcctgcttgggcccccaagaattatattgagaaagtngttgcaatatatgattatacaaaagacaaggatgatgagctgtcatttatggagggtgcaatcattnatgttataangaagaatgatgatggctggtatgaaggagtctgcaatcgagtgactggtctgttccctgggaactatgttgaatcaatcntgcactatactgattaattttttttttcttttgaagtanattcttattactcagtcatactgtgggactattatggttacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagacttttttgttagattctctcatttaaaaaaaatactgttngtttaaagcatgcataaaaatttatgtattgaaatatacttaaaaatcnagtgcttcccnttngtgtaatatttacctggaggactcgtacttaggtgtcttaacgtgaattgagtctccaaggtctccatgtgaaacaagcaaaaagagaattatctgtaatgttgtaatttgtacctaagttttttnnnagtnnnntntgcntnntnaacnntttccattcataaannnntnngtnnnncaaaggnntttgtcctttccttcantnatttgctttaaaaaaaataaaagataatgatttantgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttcg

SEQ ID NO: 730173 - DNA, 1493 bp, Homo sapiens
  misc_feature (409)..(409): n is a, c, g, or t
  misc_feature (476)..(476): n is a, c, g, or t
  misc_feature (486)..(486): n is a, c, g, or t
  misc_feature (566)..(566): n is a, c, g, or t
  misc_feature (605)..(605): n is a, c, g, or t
  misc_feature (1026)..(1026): n is a, c, g, or t
  misc_feature (1075)..(1075): n is a, c, g, or t
  misc_feature (1086)..(1086): n is a, c, g, or t
  misc_feature (1089)..(1089): n is a, c, g, or t
  misc_feature (1215)..(1217): n is a, c, g, or t
  misc_feature (1221)..(1224): n is a, c, g, or t
  misc_feature (1226)..(1226): n is a, c, g, or t
  misc_feature (1230)..(1230): n is a, c, g, or t
  misc_feature (1232)..(1233): n is a, c, g, or t
  misc_feature (1235)..(1235): n is a, c, g, or t
  misc_feature (1239)..(1240): n is a, c, g, or t
  misc_feature (1255)..(1258): n is a, c, g, or t
  misc_feature (1260)..(1261): n is a, c, g, or t
  misc_feature (1264)..(1267): n is a, c, g, or t
  misc_feature (1274)..(1275): n is a, c, g, or t
  misc_feature (1292)..(1292): n is a, c, g, or t
  misc_feature (1294)..(1294): n is a, c, g, or t
  misc_feature (1329)..(1329): n is a, c, g, or t
attcccattgctgtgcctacaccttcgccacccactatggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaattgctgatagtccaactccaccgccaccacctccaccagatgacattcccatgtttgatgactctccacctcccccaccacaccaccagtggattatgaagatgaggaggctgcagtagttcagtataatgatccatatgcagatggggatcctgcttgggcccccaagaattatattgagaaagtngttgcaatatatgattatacaaaagacaaggatgatgagctgtcatttatggagggtgcaatcattnatgttataangaagaatgatgatggctggtatgaaggagtctgcaatcgagtgactggtctgttccctgggaactatgttgaatcaatcntgcactatactgattaattttttttttcttttgaagtanattcttattactcagtcatactgtgggactattatggttacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagacttttttgttagattctctcatttaaaaaaaatactgttngtttaaagcatgcataaaaatttatgtattgaaatatacttaaaaatcnagtgcttcccnttngtgtaatatttacctggaggactcgtacttaggtgtcttaacgtgaattgagtctccaaggtctccatgtgaaacaagcaaaaagagaattatctgtaatgttgtaatttgtacctaagttttttnnnagtnnnntntgcntnntnaacnntttccattcataaannnntnngtnnnncaaaggnntttgtcctttccttcantnatttgctttaaaaaaaataaaagataatgatttantgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttcg

SEQ ID NO: 730174 - DNA, 796 bp, Homo sapiens
cccattctgccagggaggacccaccagagttggctcccaaggcttccggcctggtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcactgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagccagc

SEQ ID NO: 730175 - DNA, 687 bp, Homo sapiens
gtgcatgtccgttccgaggaatgggatttaatgacctttgatgccaacccatatgacagcgtgaaacttttgctgggctccaagatcttaaagccacggagaagcctctcatcttatggcactgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagccagc

SEQ ID NO: 730176 - DNA, 916 bp, Homo sapiens; identical to SEQ ID NO: 728469

SEQ ID NO: 730177 - DNA, 962 bp, Homo sapiens
ctacaggcatgcgccccacaccctagcttcctagcttttctttctttctttctttcttttctttgtttcttcctttctttctttctttctttcttttctttctttcctttctttttctttctctctctttcttttctttctttctttctttctctttctttctttctttccttccttccttccttcctttctctttcttcttcttctttttcttttttttttttttttgcagagaccgggtctcactatgttgcccaggctagtctcgaactcctggtttcaagcgatccttgcaacttggcttccctaagcactgggattacaggtgtgagccacacactgcctggccacatagcctggttttgtttatacacacatgtccccaaatgattaggaaaccctggcacataacccatagtaggtatccaataaagagtttccattttgttctatttttctatgcatgtgtcttttttttttaattaatgaatcttagagagattacatgcttcctgaacctgagagaactgaccccatgtattctggagatttgcccgtcaaagactggtcccactgaacaacccaagattatctttccaaagaagttttcaaataataagtaacatccctggtttgatggtttgaactgacctcaggactctatgttgatcctatggacaataagccagataacaacagtacccgagtgtaacctgaagagcctcttcttagggaaggggtgtacctgggtgatggccatactgcgtgccgccatagctcaagccatgtgcctgaggctgtgcatgagggagagaaagaatgtccactcccaaaagaactgattcaggcatgaacagaaccattgcacatcctcaggaggttctagcaaacctgcacatccatgtctgcacttagacaacataaacagagtgagaatgccttcccagagcacagcagaagtt

SEQ ID NO: 730178 - DNA, 565 bp, Homo sapiens
agctcggtaccctgattaagctcattctgcaaagtctagtcaccaccctggtagaatccatgtctcattaccacccttgcccatgctgtactctcttccaactctatcagagcaactgtaacattgcattgcccttatttataaactctttctgctagtgaataagcacctcgaaggcagcttagcacatagcaagtgctcaatacacactcaaaaatcaaactagtagagtaagtggagtgtgcgaagtacagaagagacagggaaaaggagcttcaaggttatgggttaattgcagaatgggaataaagaacagaaagagcaagggagaccaaagcaagtcaggccggccaaacacagtggctcacgcctcgtattccatcctttactgggaaggctgaggtggggcatatcacttgaggtccgagagttaaccaccagcctccgtctctactaaaaatacaaaaaaaattagctgggcatggtggtgcacacctgtaatcccagctacttgggaggctgaggcacaagaatcacttgaacctgagggttggatgttgattgg

SEQ ID NO: 730179 - DNA, 563 bp, Homo sapiens
gcaaatcagctcggacccatctattgtgaaagtctagtcaccaccctggtagaatccatgtctcattaccacccttgcccatgctgtactctcttccaactctatcagagcaactgtaacattgcattgcccttatttataaactctttctgctagtgaataagcacctcgaaggcagcttagcacatagcaagtgctcaatacacactcaaaaatcaaactagtagagtaagtggagtgtgcgaagtacagaagagacagggaaaaggagcttcaaggttatgggttaattgcagaatgggaataaagaacagaaagagcaagggagaccaaagcaagtcaggccggccaaacacagtggctcacgcctcgtattccatcctttactgggaaggctgaggtggggcatatcacttgaggtccgagagttaaccaccagcctccgtctctactaaaaatacaaaaaaaattagctgggcatggtggtgcacacctgtaatcccagctacttgggaggctgaggcacaagaatcacttgaacctgagggttggatgttgattgg

SEQ ID NO: 730180 - DNA, 217 bp, Homo sapiens
caacgcctagtcagtcatcaaaaccattcaattgtcacctcctctacaaagtctagtcaccaccctggtagaatccatgtctcattaccacccttgcccatgctgtactctcttccaactctatcagagcaactgtaacattgcattgcccttatttataaactctttctgctagtgaataagcacctcgaaggcagcttagcacatagcaagtgct

SEQ ID NO: 730181 - DNA, 239 bp, Homo sapiens
  misc_feature (6)..(6): n is a, c, g, or t
  misc_feature (20)..(21): n is a, c, g, or t
tttaanccgtttgaaaaccnnctcggatcctgtattggtggtgctctcatataccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcagagagcaccaccaataca

SEQ ID NO: 730182 - DNA, 283 bp, Homo sapiens
tgtattggtggtgctctctgattggtggtgctttggtaatgtaggcgggctttggcgataaaacctttgttgtttgtattggtggtgctctcatataccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcagagagcaccaccaataca

SEQ ID NO: 730183 - DNA, 889 bp, Homo sapiens
tgctgaggggccgggcgggctaggggccggctagccgccgttcgcccctgctttgcatattcatgaagtctagcgaggccggtcgcccaggctagccgtggacgggtcatgaattattcatgaggaaacctctggtcccgcccagaaaggcctcgttgactattcatgagccgaggagcgggtttgggccggaaaaggccgttgacccccggtgggagggaagcgtcgacgagctgaggttggacttgttgaaataatcctgatacattcctacaatggccactgctcagctttctcactgcatcacaatacacaaggcttctaaggaaacagttttcccatcccaaatcactaatgagcatgagtcattgaaaatggtgaagaaactttttgctacttccatctcatgtataacatacctaaggggcctgtttccagagagctcttatggagaacgccatttggatgacctcagtttaaaaatcctccgagaagataaaaaatgtcccgggtcactgcatattatcagatggattcaaggttgttttgatgctttggaaaagagatacgtaagaatgtttttacacttacatttacacagatcccatgggatctgagaaggtgactgagatgtaccagttcaaattcaaatacacgaaagaaggagccactatggattttgacagtcatagcagcagtacaagctttgaaagtggaacaaacaatgaagatattaagaaagccagtgttctactgatccgtaaattgtatatactgatgcaggaccttgagccacttcctaataatgttgtacttactatgaaactccactactataatgcagtgaccccacatgattaccaacccctcggttttaaagaaggggtaa

SEQ ID NO: 730184 - DNA, 714 bp, Homo sapiens; identical to SEQ ID NO: 346123

SEQ ID NO: 730185 - DNA, 658 bp, Homo sapiens; identical to SEQ ID NO: 218394

SEQ ID NO: 730186 - DNA, 1142 bp, Homo sapiens
gtattgctgtctctaagccagacctgatcacctgtctagagcaaaggaatgagccctggaatgtgaagaaacatgagacagtagccagacacccaggaacaccttctgtcccatgctctgaaattcttttacggctctactttcccttcagtgatctttcttcaagatgacagtgacagccaaaggctttttcatagcttggaacagaccgtatgatctgattgttcttccattgctttggggacacaggaatatctgtgtatttttgagaaactgtttgttaagctattttttaagttccctttttgcattatgtctaaggcgtgtaagagcagtgggatttggctcagaatcccaggaacaccagaacagatgttacatgttttctgctttgtgatttcccattctatagaggttttaaatgtcattctatagaaatttatactcagtaattttataagaacactagacatctccctaaatgtaagaaactgttattttttattaaacatttattgttttagtataaacagagactggtaatttaaactctgccccaaattctcaactgtagtgtggtttagtgtatctgttcacttctgtattagtcagttttcacactgctaacaaagacgtacctgagactgggaagaaaaagaggtttaactggacttaactatttccacatggctggggaggcctcagcagcaagagaaaatgaggaagaagcaacagcagaaacccttgagaaagccatcagatcccatgagacttatttactatcatgagaatagcacgggaaagactggcccccatgattcaattacctccctctgggtccctcccacagcacgtgggaattctgggagatgcaatttaagttgagatttgggtgggggcacagccaaaccgtatcagcttcctagatttcttaaatatgctgtgtatttgggtagcttagagcagtgctcagcatatgtttaacttccacttgctaccttagtttataataactgtaattttataattttgtttggaatgaccggaactgttattcatatatatgttggtgtgtatacatttgtgtatatatgtacatgtgtgtaacatggattttttcacaaataaaaagtgtgtaagta

SEQ ID NO: 730187 - DNA, 1273 bp, Homo sapiens
ccttgcatgcacaataaataataattaggataataatggataatcccgggcgaaggcggcgtggtgccggaggggtctgagcggcggctgcagcggggcggccgaagggaggggaaagaggagaaaagagttgtaagttatatttaccttgctcgcgaggagtgtgctggctgaatctcttccctctctgagtcacccagagtacagaaacagagggagagaggactagattatgaatatgacttcattgatgacagccgtcccctcctcttcctaaactcgggctccgcccagcgtcccaccctcgcctcctccgcgggcgccggaagacgcgccgcagttggccccgcgcgccgctcctccctgcccgtccgggcgcgggttggcgggacgcgcctgtcactcgctcagctcagcgactccgggagcgcggggggaggagggggcggtgtgcaagaatgtggatctagacagctctactgtatgcgtggatccgtgtgtgactgcaaggcgccggctctcgggccgcgtttgtgcctggagcagagaaactgcgcgggatgcagaaagccccaagccctgctggagctgggcgcccgctgtcccttccctggcagtcctcttcctcgggcgccgcggggctcctccagggagactgcggaaggggaggaggcgaagcgaaaacggagggcagccgtagtaatagcgcgtagtagttcgggggtatgtggagaaggtgctggaatttaactgtgcctccgcctgccagtgcgagcctgcagagagagagggaggggacgggggacgggctccgagtggcaccaaagctgtttgtggcacagtgtggactgtggaaaaaacgggcattgtcgtgccggctgaaactttttctcccccttccctaaggctgtcattataaatctgccccctattccaggtaaaaaaataaaaaatagaaaagggaggcgggcacaaagaacgttcctgccaaatctgtctcttccctgaaggactgcaagcttccaaatgccaacgagggagaaacagctgagaggctgaacgccttataaataagtaaacccaccctaacctctctgtttacttcgtggactaggtacagcactataaccttccctcacctgccatcttcgctaaaatatatacaaaaatatggaaaaacaaaccctgggggcggggctggcgggttagggggcggctgaagcatggaatctggttttgatttaaaaaggggaataaatctcttattttctac

SEQ ID NO: 730188 - DNA, 436 bp, Homo sapiens
acggcagttgctggggctaacagaactggctgttgggagagagaggcgaggcaacgccgcccggccctgccattccattttactgcttaactcaacctggagtgtcaggacctattctcctgcattctcgctgcactatacgggggagccaagtcactctgtactcactggacagccaggctgggtggaatagggttctagagtggagcaggggctctgccctttatggcgactttctaaaagattagcatcagtgtcttttgacagtatagcatctggggtgggacgcggagaggaggctttgcttgctaaacggcttctttctccgccggtgatctggatttgtttcctcggccccctccccccgctcctttctttctcccctcccgcctttagcaaagtgacacaggcgacacctgctcgcttgtgttcgatg

SEQ ID NO: 730189 - DNA, 374 bp, Homo sapiens
ggcctgttattcagctctccgctccgctgggacccgcacagcgccagtggctcgggggtcggcgctcgcctcctccccggcccgggcctagagccacccctaaccagaggccggagacagctggagcggctgccgcatcccggcccagcctcccctaccatccctcccccttccactggacatctggaccctaggcccccgcaccgacagggttccggaaaccctccccgcccagcccggcggccgggccccgcgcctctctctctctagagcccccagccctcctcaagactagacttccgcctacccctggacacctcctcccggtcccctccctccccccctcccacagcctggaccggggtaggagggag

SEQ ID NO: 730190 - DNA, 997 bp, Homo sapiens
ccctgcggcggccccgaggacgtggccctggcgccctgcaccgccgccgccgcctgcgaacgggcccctccccggtctacgtcaaggtcaagagcgcggagccggctgactgcgccgaggggccggtgcagtgcaagaacggcctcttggtgagaacagatgcaaaaactattgctcaaggaaaataaagtgaaaacgaggaaaagcaaaagaagatctggagagggctctcacctgaccacaagcatcctggagcaatgagtttcaggcaggaagactcatcctgagctgagctgcttttcttgaagttgtgcaagaacgtcctgttggctggggcaaattcagtatttcttttcctggccactgtgctggagcgtgaggaaagactctccaccctcactcccagatcctgcaggaggcgtgagagcggatggagatggtgaggatgtctattaatatggtgtttcctgcaaaacggtgcccatctcaaccatgggttgtcaaccatcctcggtgtctacaactgcaatttacctttgagggcccatgaactctgattacctgaaagtccttaggccagaaagagaaacccctgtcccccacctctcactttcacctatttctagaccttttcttacagcaatgccttggccctcaggaagcatcagatctcaaactgcagggtctggggctgaagctgatgctggcatgggtgactcagagttcctctattagttcaaatatgtaatatcttttagagcctaggactcaggctggaggcaattccttggtgccagttggttaatactttatgaatagtggtgggggagggaatgccttggactattaatgtccccatggatctggatcctggagaacttccagtgtcctggatggaatgttctgcttggctcatcttgcccagagaagagccaggatatgagaagatgggagagggaagggggaggtgtgaaacgtgctggtgcttcctgtcctc

SEQ ID NO: 730191 - DNA, 1263 bp, Homo sapiens
ccctgcggcggccccgaggacgtggccctggcgccctgcaccgccgccgccgcctgcgaacgggcccctccccggtctacgtcaaggtcaagagcgcggagccggctgactgcgccgaggggccggtgcagtgcaagaacggcctcttggtctccagcccacactgtgaagagccttgtgcccacagctgtgcacatcctgggcttcctccacaccttgtccataaactgcccctcagctaccttcagacccaggatacagacgcagcctccagaagaataaatgctccattagcagctggctggagctggctgaggctctggctggtgactctggcctctggtgtagacttccctcaggtgagtgcatggatgagagctctaccttctcctgactgcccaggcctcaggacaacaggagaacagatgcaaaaactattgctcaaggaaaataaagtgaaaacgaggaaaagcaaaagaagatctggagagggctctcacctgaccacaagcatcctggagcaatgagtttcaggcaggaagactcatcctgagctgagctgcttttcttgaagttgtgcaagaacgtcctgttggctggggcaaattcagtatttcttttcctggccactgtgctggagcgtgaggaaagactctccaccctcactcccagatcctgcaggaggcgtgagagcggatggagatggtgaggatgtctattaatatggtgtttcctgcaaaacggtgcccatctcaaccatgggttgtcaaccatcctcggtgtctacaactgcaatttacctttgagggcccatgaactctgattacctgaaagtccttaggccagaaagagaaacccctgtcccccacctctcactttcacctatttctagaccttttcttacagcaatgccttggccctcaggaagcatcagatctcaaactgcagggtctggggctgaagctgatgctggcatgggtgactcagagttcctctattagttcaaatatgtaatatcttttagagcctaggactcaggctggaggcaattccttggtgccagttggttaatactttatgaatagtggtgggggagggaatgccttggactattaatgtccccatggatctggatcctggagaacttccagtgtcctggatggaatgttctgcttggctcatcttgcccagagaagagccaggatatgagaagatgggagagggaagggggaggtgtgaaacgtgctggtgcttcctgtcctc

SEQ ID NO: 730192 - DNA, 1107 bp, Homo sapiens
ccctgcggcggccccgaggacgtggccctggcgccctgcaccgccgccgccgcctgcgaacgggcccctccccggtctacgtcaaggtcaagagcgcggagccggctgactgcgccgaggggccggtgcagtgcaagaacggcctcttggtctccagcccacactgtgaagagccttgtgcccacagctgtgcacatcctgggcttcctccacaccttgtccataaactgcccctcagctaccttcagacccaggatacaggagaacagatgcaaaaactattgctcaaggaaaataaagtgaaaacgaggaaaagcaaaagaagatctggagagggctctcacctgaccacaagcatcctggagcaatgagtttcaggcaggaagactcatcctgagctgagctgcttttcttgaagttgtgcaagaacgtcctgttggctggggcaaattcagtatttcttttcctggccactgtgctggagcgtgaggaaagactctccaccctcactcccagatcctgcaggaggcgtgagagcggatggagatggtgaggatgtctattaatatggtgtttcctgcaaaacggtgcccatctcaaccatgggttgtcaaccatcctcggtgtctacaactgcaatttacctttgagggcccatgaactctgattacctgaaagtccttaggccagaaagagaaacccctgtcccccacctctcactttcacctatttctagaccttttcttacagcaatgccttggccctcaggaagcatcagatctcaaactgcagggtctggggctgaagctgatgctggcatgggtgactcagagttcctctattagttcaaatatgtaatatcttttagagcctaggactcaggctggaggcaattccttggtgccagttggttaatactttatgaatagtggtgggggagggaatgccttggactattaatgtccccatggatctggatcctggagaacttccagtgtcctggatggaatgttctgcttggctcatcttgcccagagaagagccaggatatgagaagatgggagagggaagggggaggtgtgaaacgtgctggtgcttcctgtcctc

SEQ ID NO: 730193 - DNA, 495 bp, Homo sapiens
tgctgctatttgtgaaataggaaatttagaagaatttgtgagattatgatgtaacaaagataacagattccattttagatgtttagggtgcttttagataatcccggtggaaattttcagtaagtttttggatgtactggactggccttcaggagaaataggcaagcaagagagagacagactgagattatcagtgtgcaggtagaagttgaagctcaggagtagctgagattagttagggcacgtgtagagtgaaaggggagattggtggttagaagcttaagaaacaacaggctgggagtggtggttcacacctgcaatcccaacactttgggaggcccaggtgggaggatcacttgagcccagaagttgaagaccagcctgggcaacatatggaaaccctgtctcaaatatatatgtgtgtgtgtatatatatatacacacacacacacacacacacatacacatttgaaaaagaaaaagaaacaacaaata

SEQ ID NO: 730194 - DNA, 1109 bp, Homo sapiens
tgagatggaatctctctctgttgcccaggctggagtgtagtggtgcgatctcagctcactgcaacctccgcctcccaggttcaagcgattctcctgcctcagcctcctgagtagctgggattacaggcgcacgccaccacgcctggctaatttttgtatttttagtacagagggggtttcaccatgtttgtcaggctggtctcgaactcctgacctcgtgatccgcctgcctcgacttcccagagtgctgggattacaggcgtgagccaccacaccctcccgagatctttaaagtttaccaaaataaaggaaaccacctttgtagtctgtcagtgtctcttataaattgctactgttttcttaaagttaacttcagggtccaccttatgttgcacacatatcacatcgtttaaattgcatactatggtttgacttgctttggaattttcaagtcaaagtcccaaccctttgcctctccccctttaatttgccttttctcttttgatttaatgtttttttattccagcattttatactaatgtaaaatgtttttatgtttgtttacttaacattttcataaaatagtaggtagtctcaccaacttccaatatatacaacaacattataagtaaaatttgatttgtgagtgcctatcagtggccagatgaactaatggcttgtcagaagggggcctgtgacctcctgcttgctgcatgcaggcttataatcatcaattgctgctgttgtttttttaagaatggcagaaatcacagatacaactataaaatctttgtatttctgttaaccattttttttaaagcttaaatgtatcataagccagcaaaaaccctttgtagaccagatttacttaccagtttgcaatttgtgatatagaatcttgttttattataagagggtggtatttaacaaattcaaaattagtcatcactttttaactgtgaaacattgtaactaattctttgaacaggtatacttaaagtatggtatacccttctgttataaagatgaagcaggtctcttatgactgttcctgccaacgagttatggaggtaaatgactgtgacctggagtggagaacaaaaagatgg

SEQ ID NO: 730195 - DNA, 566 bp, Homo sapiens; identical to SEQ ID NO: 224732

SEQ ID NO: 730196 - DNA, 480 bp, Homo sapiens
gactgcaaaagaaacatctgagaaatttgcatggccagcaaaagaaagacctaggaagatcacatgggaggaaaaagaaacatctgtaaagactgaatgcgtggcaggagtaatacctaataaaactgaagttttggaaaaaggaacatctgagatgctcacgtgtcctacaaaagaaacatctacaaaagcaagtacaaatgataagatgcccacatcagagtcaggacaaaaagaagatacgaaatcaccttcagtttctgaggtcacagctatggatgtggaagagataggaaaggcctcaccacttaagatagaagcagcagctgcatagtggtaacagcaatgagtggatgtcaaaagacagattcaactagcctatcaatattcttgggtgcagttccttctcatgaaagagcaagggaacttaaaaaatatcactgtgaacaacttacagcaaaaataaaacaaatgaaaaat

SEQ ID NO: 730197 - DNA, 426 bp, Homo sapiens; identical to SEQ ID NO: 231254

SEQ ID NO: 730198 - DNA, 694 bp, Homo sapiens
agtactagtacttcatgattaccaaaagatgctggcaacataatacaagaaaaggaataaaataaaggagcacccagagccttctgcctggagagattatcagttattttttgtctgtcttagaaaaccttctgcctgggcattccaatctttttagcaaatctggtattcattatccacacttgttggtattctctcatacaattctaaggttgccctggggccacccctctgaaaacagatttgccctgtgatgtacaatcccaagcaactggccatatctttcattggtaatgggtgaggagaaaggagcagagctcctgcaagtgaagcagggaactgtacaacataaacatttcaggatcactgacatccacatcatggctaacgtgcctatgtactgcaagatgagactgtcagcagatcattttcaaattttaacagactacttggtcatgtttgattcctaaatacgcctttggcttatttattatctgtagtataattttatagtcatagagtttataaagtaaaaagtactaatccaaaagctagaagaagacaagaaataactaagatcagagaagaattgaaggagacagagacaagaaaaactctccaaaaaaatcaatgaatccagaagctggttttttgaaaaaattaaaatagaccactagctagacttataaagacg

SEQ ID NO: 730199 - DNA, 2778 bp, Homo sapiens; identical to SEQ ID NO: 236595
  misc_feature (2504)..(2504): n is a, c, g, or t

SEQ ID NO: 730200 - DNA, 978 bp, Homo sapiens; identical to SEQ ID NO: 236593
  misc_feature (569)..(569): n is a, c, g, or t
  misc_feature (688)..(688): n is a, c, g, or t
  misc_feature (697)..(697): n is a, c, g, or t
  misc_feature (700)..(700): n is a, c, g, or t
  misc_feature (710)..(710): n is a, c, g, or t
  misc_feature (731)..(731): n is a, c, g, or t
  misc_feature (752)..(752): n is a, c, g, or t
  misc_feature (755)..(755): n is a, c, g, or t
  misc_feature (772)..(772): n is a, c, g, or t
  misc_feature (781)..(781): n is a, c, g, or t
  misc_feature (785)..(785): n is a, c, g, or t
  misc_feature (814)..(814): n is a, c, g, or t
  misc_feature (831)..(832): n is a, c, g, or t
  misc_feature (844)..(844): n is a, c, g, or t

SEQ ID NO: 730201 - DNA, 2005 bp, Homo sapiens; identical to SEQ ID NO: 501798

SEQ ID NO: 730202 - DNA, 1406 bp, Homo sapiens; identical to SEQ ID NO: 485369

SEQ ID NO: 730203 - DNA, 1636 bp, Homo sapiens; identical to SEQ ID NO: 235753

SEQ ID NO: 730204 - DNA, 2134 bp, Homo sapiens; identical to SEQ ID NO: 526668

SEQ ID NO: 730205 - DNA, 1776 bp, Homo sapiens
ctttctccatttgccagcccatggcattgctgccaccctgatggagcgccctctcatctggcaccttcctggcctctttcccaggccccagttctgtccatgcagctgtgggtgcttcctgcattgcgggtctcacggggaggagacgagagtgcccctggttgagtcaggaaagaattctatcttcacgtcgctgccagcaaatgaccacagcagcttcacgacctctgcaggaacctatcttggtaaagaaacggggcctatgtggtggccgagcctcaggtgtggccgagcttcaggtgtggcccttatgcacagcacagcccaagcctgtgggcaccactcgccctgggctgcctggcacctggactccttcccatccttggccgaggtctgcgtggcccttcagggccgaatctgacactgtcttcctcctgagtctgccccccgggcttcctgcccacccccaggctgtttcatggcctctgcagggagcttcgtagaggtgaggctggtgccatctgtctgcttcagaccacctcaggctctgcgtgccctcacagtcccctctgcacttctctgtggggcagggaagcccttcccatcaggtctgctccagcctggctaccttgttcctgctgtcccctccccttcaggcccccggacaagacttcagtgtacttgctggtgccgggcagaatgggggaccttgcctctcacacacacctgctagtatctccgcaacctccaggcatcatctcagctgacagtgacgccatcctggggaagctcccctgactcctggctctcctggaagcctgtggtgctccttcacaatggcccgtggcccttcataggtcccgtaagccagtgtcacagggattcggcttttctcttctgtgtttgcctgctgcgggactgtgagcagcttcagggccaagacagtgcctttccatccgtgaatctcctgatccatcagaatactcgaaagagaaataccgactgagtgtattcattaaagaattaatgttccttacaggatcattgttgttgaactgacctgacatgtgtatagtaatctcatgaacaagaaagaatgtgttcacacgtttgcttaaattgaatttagcaatcgcattaggatactgatatttccacaatgtatatacactatccttttaaatttaacttatttgctttttagacggaagctcctcagtcttagagagttctgaaggtggatttctcagccacgttcaacctgatgagttcactgcttcttccccaaacattgcagagctgcaggaaatttgggctgtgaacttacgtgtgatgtttactattatgcaaatgctcagacgacacacacgacctaccctgatggtttggaagttgtgcagtttcttaacaagcagacagatcagaccctctagttgcaggaaaaaaagctcagggcggtcgagtgcagtggctcgcgcctgtaatcccagcactttgggaggccaaggtgggcagatcacgaggtgaggagttcgagaccaacctggtaaacatagggaaaccctatctcttctaaaaaaaaaaaaatacaaaaaattagttgggcgtggtggatggcacctgtagtcttagctactcaggaggctgaggcaggagaatcgtttgaacctgggaggtggaggttgcagtgagccaagatcatgccattgcactccagcccgggttacagtgtgaggctttctaaaaacaaaaacaaaacaacaacaacaacaaaac

SEQ ID NO: 730206 - DNA, 1921 bp, Homo sapiens; identical to SEQ ID NO: 284227

SEQ ID NO: 730207 - DNA, 4434 bp, Homo sapiens
  misc_feature (1357)..(1357): n is a, c, g, or t
  misc_feature (2241)..(2241): n is a, c, g, or t
  misc_feature (2245)..(2245): n is a, c, g, or t
  misc_feature (2576)..(2576): n is a, c, g, or t
  misc_feature (2913)..(2913): n is a, c, g, or t
  misc_feature (2990)..(2990): n is a, c, g, or t
  misc_feature (3701)..(3701): n is a, c, g, or t
  misc_feature (3780)..(3780): n is a, c, g, or t
  misc_feature (3883)..(3883): n is a, c, g, or t
  misc_feature (4215)..(4215): n is a, c, g, or t
agcaatgcacacgagcagacagagaagcaacatctttaaggtactgagggcaggagaagttaatgtagaatactatgccagaaaaaataaattcccaaaagtggaagtgaaataaggacatttagagatgtacaaaagctgaccgaattcactaccagtcaacccacactacaagaaacatcaaatgagtcctccaagcagaaggaatccaataccagatgaaaatccagatctccacgaggaaatgaagaacaccagaaatggatcggccctttcttcaaataagagcagttggaataacaaagctgttcagttgtacccttggaatccactgaaatcctgggtagggaagctccagtaccaccaactggaaagactgggaatgcctaatagctggtactggccattgtcgtaggctttgtccactctgacaaactgaagatggggactcgactcaccttcgccagccacaggaggacctccagacgaggttaggtcgacttcccgataactttagatcctgaaacctcacgggatttttcttctcttccctttgatctctcttccgcttgctcaacaggacaggactcgctgcctttctttcccgtcagaaagggatcccttgcggacaggacctaagtgagtagctggtttcccctacttgtccttccgggcctgggtgtctcgggggctcaggctgacgggagacctaactaccggcgagtgagaccagcaggagcctggaggggcgcgcaccagggtggaggtttggtgccgggggttgagaacaacagtcaaaccctcttcttcccctggcaccacgcacctgccccccgggatgccgaacgaagtggtccctaaagctcctctgcaggcccaaccgaaacaggcctgaagctccaggatgggcgagaggatcctctttgagcgaaaccagccttctgcctggctggccctggtcaacaccctgggaagaggccgatttggcggacagaacggaagaaaagacctaaaggtagaatctcatgatgtcgagatgttaaaacactcaaattttaaggttcgactgtgagggggagatagggggtctcgagctggatcgacccctgagccttcatctgcagagtcctgtgcaccagctcagaggacaggactatgtgcaccaatggttctcatcaggcggcaacttcaccctcacatgcctcccccatccctgctggtacacaagaccacgactaggggaagcccggagggagaatgttaacccctggcatctatctagtcagcagaggtgagggatgctgctaaacaccttacaatccaccggaggacacccgcccccaccgaccccgaagtngccattccctggaggtggggaaactcgcctgtagatcaatgcccacgcacttggcggacaggaaatcacgaattggccactaactggatcttggatctgaggaaaaaattccagcgtcagagggaactctcggagatttgcccagagcataaggaacgtactccttccctcagtgatggatcctcacatctgggggaaatcatagacaatttcttttgtagggcgaactctgctatacagtttatgatgtcagagtgaatactttctttgagttgcagtcagaaactgtagatttttaaaaatttaaaattcattattctctgtcagtattccaaagtgtatacagaaagctattgcactgttcaggagatggcgcttaacattttggaaattcaaggtgatgaatgtccagataagactatctctcctggtacaaagtttgacaatgctgaacatttttaaaggttctttttgatatacaaagtgcaccaatgagtgctttttaattcttacaataattctgggtgaggtaggtatttttccaattcccattttatgcttcggtagccctttgtatttatacttcaaaacacttggctctcttgtaattatttaagaaattagttgtgattatttgtttaatgtgcaggagttacaaaaggcaagctttagaacaagacagacctggttatgattcctggctctgaaagctgtacaccctgtgaccctagacaggtgttttaatgcctcgctgcctctgtttcttgctctgtaaaatgtgaacaataacagtattggcctcatgctttttttgggttttaaaagtaataatgtggacaaagatcagtggagtgcctggcatgctgaacccattccatgactgntagntatagttgttatgatttgtatcaatccattttcacactgctataaggaactacctgagactgggtaatctatgaagaaaagaggtttaattgactcacagttctgcatggctgggagtcctcaggaacttacaatcatggcagaaggggaagcaagacatttcttatatggcagcaggacagaaagagagagagtgaagggggaagtgccacacacttccaaacaaccatatcttgtggttaattaaaaagtactcattggtgtgccttgtatagaaaaaaatatacactcactatcatgagaacagcaaggagggagtctgcccccaagnttcaatcacctcccagtagacccctcccctgacatgtggggattacaattcaagatgagatttgggtggggaaacagagtcaaaccatatcgtgattgttctataataaagagatgcccacatgtgtttcatcagggacagtgctcattaaccagttgtcctgccgtaattattaatagtatcccctttgctttcaaaagtgtcctagtttacaaaaagtatagaaatggaggacagaatagtggttgcccaagattggaaaagggtaagggtaaagggtgcagaggtggatgtggttataaaaggcaacatgggagatcctcgtagtgaaggaacngtttagtatctccactgtggtggtagatacccgaacctaaacatgtgaaaaattgcatgaaactaaacacacacacnaacaagtacaagttaagttaggaaaatccaaataagatttctacattgtatcaataggtatatcttgattatgatattgcaagatggtactattcaaggaaactgggtagaggctacatgagactcccctgtattatttcctataactccatgtgaatctacaaggatctcaggattaaggaagatatcctagtttggaagataaaaaatatatcccagtagtaatatccactgtcccaccagggcctgactaccttctataaaaagaagtgcctttgttcccctcaagttcctttatttggttttattcttcttcacagtacctacctccacttggcagattacatttattttttcatctttcaacagctatttactgaatgcctactagatgccaggcttgagatctagcaatgaacaagatctctgtgaaacttacattccaggaggagaaataaataataaaccaaaaatataatcagtaaattatttaatatgctgggaaacaatatgtgtaatggaagaaatatgtaaagtgatggattagggttctccagagaaacagaaccaacaattgactcatgtgattatggaggctgagaagtctcaagatcacagttggcaagcttgagacacaggagagcccatggtgtgtttctgatttgagtccaaaggcctgagaaccaggagagatgatggtgtgattacagntcaaaagctggcaggcttgaggcccaggaagagccagtgttgcagttcaattccaaaggcaggaaaaggctgatatctnagctgaagcaatcaggcagaaggagctctctcttactcatgggcaggtcagacttttggttctattcaggcctttaagtgattggatgaggatcatctactgnggaaagaaataagctttattcagtgtactgattcaaatgttaatctcatccaaaaccatgctcacagacacacccagcataatgtttgaccaagtatctgggcacctgtggttcagtcaaattaacacatattaactaccttagcaagatgaaaagcagtgaatgcaggatggtggttgaaattttaaatacgttggttatatagtctcattgaaaaaggaacatttgagtgaagacttgaaggggtggtggaataaaccatttatttgcttattgcctgtctccctctatcagaatgaaagcttcatgaagcgagagacttaatttttatntgttatatccctagtgcctggtgcagggtaagtactcaaaaatatttgttgagtgaataagtaatgattgaggatggggactggtttgtatctggttatatctcttgtccttagcacagtacctggcacatcctaagccatccaaaagagttggttatatgattgtctttgaattctatgactgtttataatatacagtaaacttcactgaagacactg

SEQ ID NO: 730208 - DNA, 4168 bp, Homo sapiens
  misc_feature (1091)..(1091): n is a, c, g, or t
  misc_feature (1975)..(1975): n is a, c, g, or t
  misc_feature (1979)..(1979): n is a, c, g, or t
  misc_feature (2310)..(2310): n is a, c, g, or t
  misc_feature (2647)..(2647): n is a, c, g, or t
  misc_feature (2724)..(2724): n is a, c, g, or t
  misc_feature (3435)..(3435): n is a, c, g, or t
  misc_feature (3514)..(3514): n is a, c, g, or t
  misc_feature (3617)..(3617): n is a, c, g, or t
  misc_feature (3949)..(3949): n is a, c, g, or t
agcaatgcacacgagcagacagagaagcaacatctttaaggtactgagggcaggagaagttaatgtagaatactatgccagaaaaaataaattcccaaaagtggaagtgaaataaggacatttagagatgtacaaaagctgaccgaattcactaccagtcaacccacactacaagaaacatcaaatgagtcctccaagcagaaggaatccaataccagatgaaaatccagatctccacgaggaaatgaagaacaccagaaatggatcggccctttcttcaaataagagcagttggaataacaaagctgttcagttgtacccttggaatccactgaaatcctgggtagggaagctccagtaccaccaactggaaagactgggaatgcctaatagctggtactggccattgtcgtaggctttgtccactctgacaaactgaagatggggactcgactcaccttcgccagccacaggaggacctccagacgaggacaggactcgctgcctttctttcccgtcagaaagggatcccttgcggacaggacctaagcaccacgcacctgccccccgggatgccgaacgaagtggtccctaaagctcctctgcaggcccaaccgaaacaggcctgaagctccaggatgggcgagaggatcctctttgagcgaaaccagccttctgcctggctggccctggtcaacaccctgggaagaggccgatttggcggacagaacggaagaaaagacctaaaggtagaatctcatgatgtcgagatgttaaaacactcaaattttaaggttcgactgtgagggggagatagggggtctcgagctggatcgacccctgagccttcatctgcagagtcctgtgcaccagctcagaggacaggactatgtgcaccaatggttctcatcaggcggcaacttcaccctcacatgcctcccccatccctgctggtacacaagaccacgactaggggaagcccggagggagaatgttaacccctggcatctatctagtcagcagaggtgagggatgctgctaaacaccttacaatccaccggaggacacccgcccccaccgaccccgaagtngccattccctggaggtggggaaactcgcctgtagatcaatgcccacgcacttggcggacaggaaatcacgaattggccactaactggatcttggatctgaggaaaaaattccagcgtcagagggaactctcggagatttgcccagagcataaggaacgtactccttccctcagtgatggatcctcacatctgggggaaatcatagacaatttcttttgtagggcgaactctgctatacagtttatgatgtcagagtgaatactttctttgagttgcagtcagaaactgtagatttttaaaaatttaaaattcattattctctgtcagtattccaaagtgtatacagaaagctattgcactgttcaggagatggcgcttaacattttggaaattcaaggtgatgaatgtccagataagactatctctcctggtacaaagtttgacaatgctgaacatttttaaaggttctttttgatatacaaagtgcaccaatgagtgctttttaattcttacaataattctgggtgaggtaggtatttttccaattcccattttatgcttcggtagccctttgtatttatacttcaaaacacttggctctcttgtaattatttaagaaattagttgtgattatttgtttaatgtgcaggagttacaaaaggcaagctttagaacaagacagacctggttatgattcctggctctgaaagctgtacaccctgtgaccctagacaggtgttttaatgcctcgctgcctctgtttcttgctctgtaaaatgtgaacaataacagtattggcctcatgctttttttgggttttaaaagtaataatgtggacaaagatcagtggagtgcctggcatgctgaacccattccatgactgntagntatagttgttatgatttgtatcaatccattttcacactgctataaggaactacctgagactgggtaatctatgaagaaaagaggtttaattgactcacagttctgcatggctgggagtcctcaggaacttacaatcatggcagaaggggaagcaagacatttcttatatggcagcaggacagaaagagagagagtgaagggggaagtgccacacacttccaaacaaccatatcttgtggttaattaaaaagtactcattggtgtgccttgtatagaaaaaaatatacactcactatcatgagaacagcaaggagggagtctgcccccaagnttcaatcacctcccagtagacccctcccctgacatgtggggattacaattcaagatgagatttgggtggggaaacagagtcaaaccatatcgtgattgttctataataaagagatgcccacatgtgtttcatcagggacagtgctcattaaccagttgtcctgccgtaattattaatagtatcccctttgctttcaaaagtgtcctagtttacaaaaagtatagaaatggaggacagaatagtggttgcccaagattggaaaagggtaagggtaaagggtgcagaggtggatgtggttataaaaggcaacatgggagatcctcgtagtgaaggaacngtttagtatctccactgtggtggtagatacccgaacctaaacatgtgaaaaattgcatgaaactaaacacacacacnaacaagtacaagttaagttaggaaaatccaaataagatttctacattgtatcaataggtatatcttgattatgatattgcaagatggtactattcaaggaaactgggtagaggctacatgagactcccctgtattatttcctataactccatgtgaatctacaaggatctcaggattaaggaagatatcctagtttggaagataaaaaatatatcccagtagtaatatccactgtcccaccagggcctgactaccttctataaaaagaagtgcctttgttcccctcaagttcctttatttggttttattcttcttcacagtacctacctccacttggcagattacatttattttttcatctttcaacagctatttactgaatgcctactagatgccaggcttgagatctagcaatgaacaagatctctgtgaaacttacattccaggaggagaaataaataataaaccaaaaatataatcagtaaattatttaatatgctgggaaacaatatgtgtaatggaagaaatatgtaaagtgatggattagggttctccagagaaacagaaccaacaattgactcatgtgattatggaggctgagaagtctcaagatcacagttggcaagcttgagacacaggagagcccatggtgtgtttctgatttgagtccaaaggcctgagaaccaggagagatgatggtgtgattacagntcaaaagctggcaggcttgaggcccaggaagagccagtgttgcagttcaattccaaaggcaggaaaaggctgatatctnagctgaagcaatcaggcagaaggagctctctcttactcatgggcaggtcagacttttggttctattcaggcctttaagtgattggatgaggatcatctactgnggaaagaaataagctttattcagtgtactgattcaaatgttaatctcatccaaaaccatgctcacagacacacccagcataatgtttgaccaagtatctgggcacctgtggttcagtcaaattaacacatattaactaccttagcaagatgaaaagcagtgaatgcaggatggtggttgaaattttaaatacgttggttatatagtctcattgaaaaaggaacatttgagtgaagacttgaaggggtggtggaataaaccatttatttgcttattgcctgtctccctctatcagaatgaaagcttcatgaagcgagagacttaatttttatntgttatatccctagtgcctggtgcagggtaagtactcaaaaatatttgttgagtgaataagtaatgattgaggatggggactggtttgtatctggttatatctcttgtccttagcacagtacctggcacatcctaagccatccaaaagagttggttatatgattgtctttgaattctatgactgtttataatatacagtaaacttcactgaagacactg

SEQ ID NO: 730209 - DNA, 1562 bp, Homo sapiens; identical to SEQ ID NO: 237170

SEQ ID NO: 730210 - DNA, 2601 bp, Homo sapiens; identical to SEQ ID NO: 234632

SEQ ID NO: 730211 - DNA, 2294 bp, Homo sapiens; identical to SEQ ID NO: 238080

SEQ ID NO: 730212 - DNA, 2274 bp, Homo sapiens; identical to SEQ ID NO: 231862

SEQ ID NO: 730213 - DNA, 1832 bp, Homo sapiens; identical to SEQ ID NO: 400049

SEQ ID NO: 730214 - DNA, 1799 bp, Homo sapiens; identical to SEQ ID NO: 237299

SEQ ID NO: 730215 - DNA, 1910 bp, Homo sapiens
  misc_feature (837)..(837): n is a, c, g, or t
  misc_feature (991)..(991): n is a, c, g, or t
agaaactatgtagtgaaattacatagtgatttttcattctcgcagtaaaaatttcctgggatttttttctttttaatgggtgggaaactacctggaaatagtggatgccagagtcttaaacagaaggaatgaaataataaagatcagagcagaaataaatgaaatagaggccaggaatacaacagaaaagttcaacaaaacagagttggtttttgaaaaggtaaacaaaattgacagacctttagttggactaaccaagagaaaaaaaagtcaaaatacatgaaggagacattacaactgataccatagaaataataagatcataaaagactactctgagtaaatatatgccaaaaaattgaacaaactagaagaaatggataaattcctaaaacatacaacctatcaggaccacatcatgaaggaacagaaagtctgaacagacctataatgagtgaggagattgaatcactaagtcaaaacctcccaacaaatagaagcccaagagcagacagcttcacgggcaaattcctctgaacatctaaagacgaattaccaccaacccttctcaaacttccaaaaaaactgagcaggagagaacacttcccagattcattttatgaggccagcattacccttaaccaaagccagataaggacattgtaagaaaataaagttacaggccaatatccttgatgaacagttgcaaaaatcctcaacaaaatactagcaaactgaattgaatagcacattaaaaggagcgtacaccatgatcaagtgagatttttcctctgaatgtaaaaatggttcaacatatgcaaatcattaactgagctncaccaaattaacagaatgaaaaataaaaaccataagatcatcttaaaagatgcaaaaaaggcatttgacaaaatgtaacatcctttcacaatgaaaattctcaacaagtaaggtatagaacagtatgccacaacataataaaggctatgtgtgncaggcccacagctgacatcatacttaatggtgaaaagctgaaagcttttcctctgaggtcaggaagaagacccttgctacttccattaaatatggtaagttctagccagaacagttaggccaagaaaaagaaataaaggcagccaggagtggtggctcatggctctgattcccagcactttgggaggctgaggtgggcggatcacttgaggtcaagagttggagaccagcctggccaacatgaaaccctgtctctactaaaaaatacaaaaattcaccaggcatggtgatgcatgcctgtaatcccagcttgctcgggaggctgaggcaggagaatcacttgagcccaagaggtggaggtcgcagtgagctgagattgcaccattgcactccagcctgggcaacagggcaagactgtctcaaaaaaaaaaaaaaaagtaaaagacacctaaatcataaaggaagaaataaaattatctttatttgcagtggcataatcttgtatgtagaaaaacccaagacttcatcaagaaatctgttcacttagtcaagttctgggatacaaaaatcaacatacaaaaatcagttttctgtctatacactaacaacaaactattcaaaaaagagattaagaggtcaggtatggtggttaacacctgtaatcccagaactttgggaggccgaagcgggcggatcacctgaggtcaggagtttgagaccagcctggccaacatggtgaaaccctgtctctacaaaaaatacaaaaaaaacaactgggtgtggtggtgcaggctgtaatcccagctacttggaaagctgaggcaggagaattgcttgagcctgggagagacggaggctgcagtgagccgagatcacatcactgcactccagcctgggtgacaagagcgaaactccatctc

SEQ ID NO: 730216 - DNA, 977 bp, Homo sapiens
gatttccttaattaagatgatcagaggagacttccaagtggagatggtatttgacatgagcagaattttgaaatcaggaaagggctatcatcaaggtgatttttttaaaaaacttgctttaaatatttattgtaaaaagcaaagctgtaaaaactatttaagctgatacttctgcctcttaatttgttttcatgtgaataatttttaagtaattaaatggcattttagtcgggaaaaatagaaaatatgaaacatttataattcttaatattctgaaaactcttcaagttttcagcatggtagaagtagattattttagctatttatttaaactcaattttcttcttgttttaaaaaaccatagcctttcgttgttgtttctcttctttttgacaactattgccaaataagttttatggaatacttgggtttttcttccccatgtaatgctgggcagttagcaatagttctgaattcaggtcacttctctgttgataagtgtaaaatgcatatctataggtcagtgctaacaaggggtctagttagcttcttagctatctgcagaatatattttcttttcatcacaaaacaagtaagactagatttggcatccttcattatcccaaaatgaagcaaaactacttgagtcatttggattatgcccaggaaaacatattgactcagaaagataaacaaggctgggcgcagtggctcacgcctgtaatcccagcactctgggacgccaaggcggacagctcacctgaggtcaggagttcgagacccgcctagccaacagggcgaaacctcgtctccagtaaaaatacaaaaattagccgggcgtggtggtgggcgcctgtaaccccaggccctcaggaggttgaggcaggagaattgcttgaaccaggaagtggaggttgcggtgagccaagattgtgccactgcattccagcctgggtgacagaataagactccatctc

SEQ ID NO: 730217 - DNA, 3170 bp, Homo sapiens; identical to SEQ ID NO: 238061

SEQ ID NO: 730218 - DNA, 1646 bp, Homo sapiens
agatggtactacgtgtgcatgtgccaccatgcctggctaatttatttttaagatggagtcttgctatgttgcccaggctggttttgagctcctggcctcaagcaatcttcctgagacaggaatcccaaagtgctgggattacaggtgtgagccactgtgcccagccaaatattagaacttttaaattcatttagtatgtaagcttactgccaagcatgaaagaatcactttgaaggccagtaatgttttaaaggtctggaagattctcttgagggctaggaagcattatgtgctaggttcttgaaccaggagaaaaggggtatcactaagaagaagggaaggaatcctggtatgcaaaatagcttgggcgctatccttgcacatttgacaagtttagtgaagtactattgaactgttcagtaaagtatctgttgcctatagataaaatgtcttttgtagatacttatatatctacctacctatagatatctatatatctgtatctatatatcccttaaagctaagctaatttccttaaccttttctctgttgatatttgtttggtagcctttatctgattctagttaataactcgtaccctgtcatttttttaaaaataccctttgtttttgtaatgtgttctttcattcttcttcccaattcagttttggtacgttcctgttacgtaaatctaatctggtgagcagagactttcttaggattatgccacttggtgaggcaatcacagggtcttagccctgaaggcgcccatactgactttatcagtttattctagggagatcaggtttggggcactaacttaatactaacaaactcctaagattaatttaattttatttatttgtttgagacggagtcacccagggtggagtgcagtggcgtgatcttggctcactgcaacctctgcctccctggttcaaacgattcttgtgcctcagcctcctgaggctgggactacaggcgcatgtcaccacgtctggcttatttttgtagttttagtagagacaaggtttcaccatgttggccgggctggtcttgaactacctcaggtcccaccttggcctcctaaaatgctagaattacacagacgggagctaccatgcctagccaaaactcctaagatttacttacttacttactttatttatttatttgagacggagtctcgctctgtcccctaggctggaatgcagtggtgtaatctcagctcactgcaacatctgcctcctgggttcacctgtctctgcctctcagatagctgggattgcaggtgcatgccaccatgcccgactaatttttgtatttttagtagagatggggtttcaccatgttggccaggctggtctcgcactcctgacctcaagtgatccacccgcctcggccccccagaatgctgggattacaggtgtgagccactgtgcccggccctaagattaattttcaaacaatgtgcatcagtatgttagaaatacctagtgttagccgggtgtggttgtgtgtgcctatagtcccaactactctggaggctgacttgggaggattgcttgaggccaggagttcaggggcgcagtgaactatgattacaccactgccccaacctgggtgacagtgggagaccctgtctt

SEQ ID NO: 730219 - DNA, 3156 bp, Homo sapiens; identical to SEQ ID NO: 234290

SEQ ID NO: 730220 - DNA, 2376 bp, Homo sapiens; identical to SEQ ID NO: 236589

SEQ ID NO: 730221 - DNA, 2178 bp, Homo sapiens; identical to SEQ ID NO: 229536
  misc_feature (1)..(1): n is a, c, g, or t
  misc_feature (1513)..(1513): n is a, c, g, or t

SEQ ID NO: 730222 - DNA, 1559 bp, Homo sapiens
cagagagcgttgagctgggaacagtgacaagtgcttatcaagttccttcactctcaacacggttgacaagaactgatggcattatggaacacatcacaaaaatacccaatgaagcagcacacagaggtaccataagaccagtcaaaggccctcagacatccacttcgcctgccagtcctaaaggactacacacaggagggacaaaaagaatggagaccaccaccacagctctgaagaccaccaccacagctctgaagaccacttccagagccaccttgaccaccagtgtctatactcccactttgggaacactgactcccctcaatgcatcaatgcaaatggccagcacaatccccacagaaatgatgatcacaaccccatatgttttccctgatgttccagaaacgacatcctcattggctaccagcctggggggaggtgggctgggctggctctgggagttctggaagctcccaagctttgtagctcaggccaacagagcccagggacagaggcagagccccagaggggtgacaccccctctgagtcccattcgcttcacctatcttctatggccgccccatagccatactgcccattagcgtggccgccagcattacagctcagaggcatcgccgctacaaagctttggtggcatcagagccgctcagtgtgcggctctatcgtctgggcttggcttaccttgctttcacaggcccactggcatacagtgccctctgcaacacagctgccaccctcagctatgtggcagaaacctttggctccttcttgaattggttcagcttcttcccccttcttggccgcctcatggagtttgtcctccttctgccttaccggatctggaggctactgatgggggagactggcttcaacagcagctgctttcaggagtgggcgaagctctatgagtttgttcacagttttcaggatgagaagcgtcagctggcttaccaggttttgggcctctcagaaggggcaacaaatgaagaaatacatcggagttaccaggagctagtgaaggtctggcacccagaccacaacctggaccagacagaggaggcacagaggcacttcctggagatccaggctgcgtatgaagtcctgagtcaacccaggaagccctggggatcccggaggtgaaaagaaacttccccctgaggactgactcttcctagcagagctgggcaacttgtcccaaatctagctttgcccacgaatggcatcccaacagagttaaagaaactgcttgcaggggctgggcgtggtggctcatgcctgtaatcccagcactttgggaggccgaggcgggcagatcacgaggtcaggagttcgagaccagcagcctggccaatatagtgaaacttcgtctctactaaaaatacaaaaaattagccaggagtggtggcaggcacctgtagtcccagctacttgggaggctgaggcaggagaatcacctgaacctgagaggcggaggttgcagtgagccgagatcacgccactgcactccagcctgggcaacaagagtgaaactccgtctc

SEQ ID NO: 730223 - DNA, 873 bp, Homo sapiens
gaactgatggcattatggaacacatcacaaaaatacccaatgaagcagcacacagaggtaccataagaccagtcaaaggccctcagacatccacttcgcctgccagtcctaaaggactacacacaggagggacaaaaagaatggagaccaccaccacagctctgaagaccaccaccacagctctgaagaccacttccagagccaccttgaccaccagtgtctatactcccactttgggaacactgactcccctcaatgcatcaatgcaaatggccagcacaatccccacagaaatgatgatcacaaccccatatgttttccctgatgttccagaaacgacatcctcattggctaccagcctgggagcagaaaccagcacagctcttcccaggacaaccccatctgttttcaatagagaatcagagaccacagcctcactggtctctcgttctggggcagagagaagtccggttattcaaactctagatgtttcttctagtgagccagatacaacagcttcatgggttatccatcctgcagagaccatcccaactgtttccaagacaacccccaattttttccacagtgaattagacactgtatcttccacagccaccagtcatggggcagacgtcagctcagccattccaacaaatatctcacctagtgaactagatgcactgaccccactggtcactatttcggggacagatactagtacaacattcccaacactgactaagtccccacatgaaacagagacaagaaccacatggctcactcatcctgcagagaccagctcaactattcccagaacaatccccaatttttctcatcatgaatcagatgccacaccttcaatagccaccagtc

SEQ ID NO: 730224 - DNA, 1563 bp, Homo sapiens; identical to SEQ ID NO: 284118

SEQ ID NO: 730225 - DNA, 1741 bp, Homo sapiens; identical to SEQ ID NO: 236625

SEQ ID NO: 730226 - DNA, 2008 bp, Homo sapiens; identical to SEQ ID NO: 481649

SEQ ID NO: 730227 - DNA, 1540 bp, Homo sapiens
ttctctcttcccaaaactcagacactgagagaggttctcgtcagagtccaaaatgcacattaagttgtggggatcttattaacaatgatgattctgatgctgtaggtttgaagacgactcaagattccctggagacatcaatgctgctggtccatgggccacggcttggatagaaagggtttagggagaggttgacaagtaataatgcagggtgggtgagtactgctctactggcattctaaaagcagagtgagacagagaggggtatggggagtggggaggaggcaggcaaagcctcctagaagtgagtgacttggaccctgaataggtgagtcaatttaccaagcagaaaagtaggaaaggcctttggtcagagggagcaccatggatgtggaccccggctggctcctgcatagagtgaagaatgcagaggaaggtgatgggacgatggccagagaggaggctggaaagctcaccagggtctggatggtgaagggtcagctctgtttgccatggtaagacctaagactccagtcagcagggagtcttgaggtttcacagaggtctggttatagtggacatgacaaactgctttgaaaatagccaatactacatcatgttagagaatttgcataacccagcagggcgcggtggctcacgcctgtaatcctagcactttgggaggccgaggcgggcggatcatgaggtcaggagatagagaccatcctggctaacacggtgaaaccgtctctactaaaaatacaaaaagaaattagccgggcgtgggggcgggcacctgtagttccagctacacgggaggctgaggtaggagaatggcgtgaacccgggaggcggggcttgcagtgagccgagatcgcgccactgcactccagcctgggcgacagagggagacgccgtctcaaaaaaagaaaaaaaaaaaaaaaaaaaagagaatttgcataacccaaaggagattgtgcttgaacactcccaggcagtgaataatctgcaaaggagtaagactgtagttgagaggcaggtttttagacttccacaggcttgggggacaaacagaacagaaattgatttctggttccctgctttctagctatataacctcaagaaaattaattaactttctgaatcttagttttctcacctgtagaaaggatgcaataaatcctgtctcatcaaagaattgtgaagaggaagtcattcatttaattaattgaagcactacattttggcaaagcatgcagtttgttgataacaggaggtatttgttaacttattattaatgttgatttggagctcccatgaatttttgcctaggaaatgacctggtagatcggatagttaccatgttgatagattgccaagtgccttttctcatgtgtggggttctgatgccatcatcagctggaagctcagttggtcttgtgggtggcatgctgcaccagttgtctgattcagcaatgctgtgagagaattgagagggcgttcattcagtaaagggtgggaaggattttcttaaatgttt

SEQ ID NO: 730228 - DNA, 1761 bp, Homo sapiens
gagctgatgtccactaatagaaagaatagaaagatctgattatttcctttttgccagtgtgtagtcaccttggtaaaaggccataggtccctttggaaaaggctgggagaaagatttaccttataaatgtttggcggtggagtggagttcttccacaatagtacctactctccccttcattcaaagagttctgggtctgtaaaccagctcaggtctggtaattgattgaggggatatgactctatttttatgtttcaagttagacttgttcatttgacctacaactcttccacttctacaaagcaagtcagaatttgctagacttcccagctgtttcacttccaggaacaccatgatcaactagtcagcataggtctctgagtcagactattttgactgctgtttcaactccattgtccattatggtaaccacacccgccttgcttttggtggtttattgccaccacttggctgccaccaacctggggcccaattacccccattgcacttaggttttccaacttgatggcagcagtttccacatccttgacatctattctcacagatattcctcaaattgctgtctgtctgtttaaattggaaaaatcatttagttcttttgaagtgtagcgcaccttctcatgggtcatactttgtacttcacctttcagggcttgctgggatttgagtccagttatcagttgataaggaaagtgggatgggggtgggtcctgaagagaatcagtggggtcttccatgacagctgcctcaggggaggccattacagttttctcgggcaaagcagggttaacctgctcaaacatgggttggggggtgcagttgcttcttctgacaaagaagactcgttggaatttaggggttcagtgtccccatcttcgtcatgatcttcccatatgtccccaaagcaattttcaaagtcctattccttcccaatctatgcccccactttaacagcagatactctgcaaggtttggaatttaacttgcattgcaattcagacctcgcaggatgaagattcttggtttggttttctgcagtctcagctctgaggctgtaggagataaggatttctttctaggaaggcatagaaactttcaggtcatttatgctgcatctgagtgggaattcaaatccctcaactccttttctttcccactttgtccagcccaattaggagcaaccagccaagttcattatgcccattagtttgacggaaatgttctacgttatcaaatacgtggtcacccagaaccttgcctatcataattatttgattaggagtatctaatagtgatatttttgtgtatctctattaccacatcacaccgatgactatcagtgctttattcactattggaactagagtcattagtgcttctaaatctagtcatttagagaaccaattccagaaacccccaaaccaattcagagaatttattcttaaaattctgttcctggctgggcattgtcttatgcctataattccagcactttgggaggccaaggtgggtggatcacttgaggtcaggagttcaagacaagcctggccaacatggtgaaaccctgtctctactaaaaaaatacaaaaattagccaggcatcgtggtgcatgcctgtatttccagcttcttgggaggctgaggtgggaaaatcgcttgaatctgagaggcagagtttgcagtgggctgagatcgcaccactggactccagcctgaacatcacagactgagaatttgtct

SEQ ID NO: 730229 - DNA, 492 bp, Homo sapiens
tggcgtcccccagctgactggcctacctgctccccactccttctccaagaaggggcagtttggagaaggttgtgccagtcgctgtgactgtgaccactctgatggctgtgaccctgttcatggacgctgtcagtgccaggctggctggatgggtgcccgctgccacctgtcctgccctgagggcttatggggagtcaactgtagcaacacctgcacctgcaagaatgggggcacctgtctccctgagaatggcaactgcgtgtgtgcacccggattccggggcccctcctgccagagatgtgaggctccctactgccccttccacctgccaccagcagggggcagtgtagtgtcagctgccagagcacccctccccccgcgcccgccgcccacctctcccaccttacccccggtctcttcctctgacccgtcttcagactagttactgcagtgggaaggtgggagggagacggtggggtaagggctgattga

SEQ ID NO: 730230 - DNA, 1118 bp, Homo sapiens
aggtgccgggaggagtgcccggtgggccgctttgggcaggactgtgctgagacgtgcgactgcgccccggacgcccgttgcttcccggccaacggcgcatgtctgtgcgaacacggcttcactggggaccgctgcacggatcgcctctgccccgacggcttctacggtctcagctgccaggccccctgcacctgcgaccgggagcacagcctcagctgccacccgatgaacggggagtgctcctgcctgccgggctgggcgggcctccactgcaacgagagctgcccgcaggacacgcatgggccagggtgccaggagcactgtctctgcctgcacggtggcgtctgccaggctaccagcggcctctgtcagtgcgcgccgggttacacgggccctcactgtgctagtctttgtcctcctgacacctacggtgtcaactgttctgcacgctgctcatgtgaaaatgccatcgcctgctcacccatcgacggcgagtgcgtctgcaaggaaggttggcagcgtggtaactgctctgtgccctgcccacccggaacctggggcttcagttgcaatgccagctgccagtgtgcccatgaggcagtctgcagcccccaaactggagcctgtacctgcacccctgggtggcatggggcccactgccagctgccctgtccgaaggggcagtttggagaaggttgtgccagtcgctgtgactgtgaccactctgatggctgtgaccctgttcatggacgctgtcagtgccaggctggctggatgggtgcccgctgccacctgtcctgccctgagggcttatggggagtcaactgtagcaacacctgcacctgcaagaatgggggcacctgtctccctgagaatggcaactgcgtgtgtgcacccggattccggggcccctcctgccagagatgtgaggctccctactgccccttccacctgccaccagcagggggcagtgtagtgtcagctgccagagcacccctccccccgcgcccgccgcccacctctcccaccttacccccggtctcttcctctgacccgtcttcagactagttactgcagtgggaaggtgggagggagacggtggggtaagggctgattga

SEQ ID NO: 730231 - DNA, 870 bp, Homo sapiens
aggtgccgggaggagtgcccggtgggccgctttgggcaggactgtgctgagacgtgcgactgcgccccggacgcccgttgcttcccggccaacggcgcatgtctgtgcgaacacggcttcactggggaccgctgcacggatcgcctctgccccgacggcttctacggtctcagctgccaggccccctgcacctgcgaccgggagcacagcctcagctgccacccgatgaacggggagtgctcctgcctgccgggctgggcgggcctccactgcaacgagagctgcccgcaggacacgcatgggccagggtgccaggagcactgtctctgcctgcacggtggcgtctgccaggctaccagcggcctctgtcagtgcgcgccgggttacacgggccctcactgtgctagtctttgtcctcctgacacctacggtgtcaactgttctgcacgctgctcatgtgaaaatgccatcgcctgctcacccatcgacggcgagtgcgtctgcaaggaaggtaatagggtggagtttcccagagagaagacttgggggatggccaagggaagaagggagagtccaagagtatgggtgggccaagggcaggggagcggctgcagggtaagggtggaggggcagcagctggacacagggaaagtatccaggctactttcttcctggaatatccactttgcttttcttcaaccacaaagatcctacctgtccttaaaggctgaggccaaaagccacctcactggcgaacgtccctcaccctcagtcatacggaaacacaattaccatgctgggaagggcctcacatctgccagagtgacacattgcgaacctttaggctggactcggatacagttgacacta

SEQ ID NO: 730232 - DNA, 493 bp, Homo sapiens
  misc_feature (492)..(492): n is a, c, g, or t
caatatcgaattgaagccttaccccttactgaaagacctttgatagattctgagggtagaatgttgaccaggatggagctgggccttggagagtggggaaggcaggcagtaacacagcaggcagtagatcaacgaggccatatcatggattgtgctgtgggatgtgaaggaaatgaacagacggaggacgcagagcagggcacctcgagctaccacggtcactaaaagctgctatgaccaagtgttctgtgagctgaaacctgaaggccaggaaggagtcactcttgtgaggggctgaaaggaacatcacagagaggggaggagctagcacaaaagctctccagatgggagaggctggtgcactgggcaagggaaagccagcaccatggtgcccagaagggaaggcagctggggggccagtctacgcagggccttgcagagtgtctgggtttactctaagggcaggtgaaatgggaagggtaccgagctcgnt

SEQ ID NO: 730233 - DNA, 379 bp, Homo sapiens
ggagctagcacaaaagctctccagatgggagaggctggtgcactgggcaagggaaagccagcaccatggtgcccagaagggaaggcagctggggggccagtctacgcagggccttgcagagtgtctgggtttactctaagggcagaggggaaggttttgatcatgacgcactgcagtctgaaactcctgggctcaggcaatcctgtctcagcttcctgggtagttgggactgtaggcaggcaccaccacctctgcctaattattattatcattttttttggagagacagggtctcaatatgttgctgtgtctcagaggggaaggttttaagtcagggaatgattctgtgagcttaaaaaatcacttggaaattgccata

SEQ ID NO: 730234 - DNA, 1151 bp, Homo sapiens; identical to SEQ ID NO: 728494

SEQ ID NO: 730235 - DNA, 337 bp, Homo sapiens
  misc_feature (33)..(33): n is a, c, g, or t
  misc_feature (188)..(188): n is a, c, g, or t
  misc_feature (208)..(208): n is a, c, g, or t
  misc_feature (298)..(298): n is a, c, g, or t
  misc_feature (312)..(312): n is a, c, g, or t
  misc_feature (316)..(316): n is a, c, g, or t
  misc_feature (321)..(321): n is a, c, g, or t
  misc_feature (323)..(323): n is a, c, g, or t
cggtacctgcgtactgggggtatggagcagcanccacacccacaggtgagcatctgacatcgtggagcagcaccccacacccacaggtgagcatctgacagcctggagcagcacccacacccccaggtgagcatctgacagcctggaacagcacccacacccccaggtgagaatctgacagcctggancagcacccacacccccaggngagcatctgacagcctggagcagcacccacacccccaggtgagcatctgacagcctggaacagcacccacacccccaggtgagcatctgncagctgctcagccngccngctcnanccggaccagctcat

SEQ ID NO: 730236 - DNA, 515 bp, Homo sapiens
  misc_feature (25)..(25): n is a, c, g, or t
  misc_feature (46)..(46): n is a, c, g, or t
  misc_feature (50)..(50): n is a, c, g, or t
cctgtggcattcagctggaacacangctgaccaccaggtgcgcatntganagcctgggtcggcacccacacccccaggtgagcatctgatggtttgcagcaacaccgacacccacaggtgagcatctgacagcctggaacagaacccacacgcccaggtgagcatctgacagcctggaacaacagcctgcaccaccaggtgcgcatgtgacagcctggaacggcaccaacacccccaggcgagcatctgacggcctggaacagcacccacacccccaggtgagcatcagacagcctggaacaacacccatcacatcaccgggtgagcatctgacagaaaattaacaaagatattcaggacctgaactcagctctggatcaagtggacctgatagatatctacagaactctccatcccaaaacaacagaatatacattcttctcatcacatggcactctaaaatgatcacataattggaagtaaacacccccgcataagtgggaccgagctcgatt

SEQ ID NO: 730237 - DNA, 759 bp, Homo sapiens
  misc_feature (47)..(47): n is a, c, g, or t
  misc_feature (55)..(55): n is a, c, g, or t
  misc_feature (290)..(290): n is a, c, g, or t
  misc_feature (353)..(353): n is a, c, g, or t
  misc_feature (376)..(376): n is a, c, g, or t
  misc_feature (404)..(404): n is a, c, g, or t
  misc_feature (424)..(424): n is a, c, g, or t
  misc_feature (720)..(720): n is a, c, g, or t
  misc_feature (734)..(734): n is a, c, g, or t
  misc_feature (738)..(738): n is a, c, g, or t
  misc_feature (743)..(743): n is a, c, g, or t
  misc_feature (745)..(745): n is a, c, g, or t
cccccactgcttccaggggagcatctgacaacctagaacatgcaccntcaccccnaggtgggcatctggcagcataaaacagcacccctactggcagatgagcatatgacagcctggaacagcacccacacccccaggcgagcatctgacagcctggagcagcacccacacccccaggtgagcatctgacagcctggagcagcacccacacccccaggtgagcatcttgacagcctggaacagcacccacacccccaggtgagcatctgacagcctggaacagcaccctncacccccaggtgagcatctgacagcctggagcagcaccccacacccccaggtgagcatctganagcctggaacagcacccacaccnccaggtgagcatctgagacagcctggancagcacccacacccccaggngagcatctgacagcctttgtctggagcatcacacacaaccacaggtgagcatcggagagtctggagcagcacccacatcccaaggtgagcatctgacaacctggagcagcacccacacctcgaggtgagcatctgtcctcccggagcaggacccatacctccaggcgagcatctgaacccatggagcagcacacacgcccccaggcgagcatctgaccgaacggagcagcacccacacccccaggtgagcatctgacagcctggaacagcacccacacccccaggtgagcatctgncagctgctcagccngccngctcnanccggaccagctcat

SEQ ID NO: 730238 - DNA, 770 bp, Homo sapiens
  misc_feature (25)..(25): n is a, c, g, or t
  misc_feature (46)..(46): n is a, c, g, or t
  misc_feature (50)..(50): n is a, c, g, or t
  misc_feature (731)..(731): n is a, c, g, or t
  misc_feature (745)..(745): n is a, c, g, or t
  misc_feature (749)..(749): n is a, c, g, or t
  misc_feature (754)..(754): n is a, c, g, or t
  misc_feature (756)..(756): n is a, c, g, or t
cctgtggcattcagctggaacacangctgaccaccaggtgcgcatntganagcctgggtcggcacccacacccccaggtgagcatctgatggtttgcagcaacaccgacacccacaggtgagcatctgacagcctggaacagaacccacacgcccaggtgagcatctgacagcctggaacaacagcctgcaccaccaggtgcgcatgtgacagcctggaacggcaccaacacccccaggcgagcatctgacggcctggaacagcacccacacccccaggtgagcatcagacagcctggaacaacacccatacccacaggtgagcatctgacatcgtggagcagcaccccacacccacaggtgagcatctgacagcctggagcagcacccacacccccaggtgagcatctgacagcctggaacagcacccacacccccaggtgagaatctgattgtctggagcatcacacacaaccacaggtgagcatcggagagtctggagcagcacccacatcccaaggtgagcatctgacaacctggagcagcacccacacctcgaggtgagcatctgtcctcccggagcaggacccatacctccaggcgagcatctgaacccatggagcagcacacacgcccccaggcgagcatctgaccgaacggagcagcacccacacccccaggtgagcatctgacagcctggaacagcacccacacccccaggtgagcatctgncagctgctcagccngccngctcnanccggaccagctcat

SEQ ID NO: 730239 - DNA, 507 bp, Homo sapiens
  misc_feature (47)..(47): n is a, c, g, or t
  misc_feature (55)..(55): n is a, c, g, or t
  misc_feature (290)..(290): n is a, c, g, or t
  misc_feature (353)..(353): n is a, c, g, or t
  misc_feature (376)..(376): n is a, c, g, or t
  misc_feature (468)..(468): n is a, c, g, or t
  misc_feature (482)..(482): n is a, c, g, or t
  misc_feature (486)..(486): n is a, c, g, or t
  misc_feature (491)..(491): n is a, c, g, or t
  misc_feature (493)..(493): n is a, c, g, or t
cccccactgcttccaggggagcatctgacaacctagaacatgcaccntcaccccnaggtgggcatctggcagcataaaacagcacccctactggcagatgagcatatgacagcctggaacagcacccacacccccaggcgagcatctgacagcctggagcagcacccacacccccaggtgagcatctgacagcctggagcagcacccacacccccaggtgagcatcttgacagcctggaacagcacccacacccccaggtgagcatctgacagcctggaacagcaccctncacccccaggtgagcatctgacagcctggagcagcaccccacacccccaggtgagcatctganagcctggaacagcacccacaccnccaggtgagcatctgagaggagcagcacccacacccccaggtgagcatctgacagcctggaacagcacccacacccccaggtgagcatctgncagctgctcagccngccngctcnanccggaccagctcat

SEQ ID NO: 730240 - DNA, 579 bp, Homo sapiens
  misc_feature (362)..(362): n is a, c, g, or t
  misc_feature (425)..(425): n is a, c, g, or t
  misc_feature (448)..(448): n is a, c, g, or t
  misc_feature (540)..(540): n is a, c, g, or t
  misc_feature (554)..(554): n is a, c, g, or t
  misc_feature (558)..(558): n is a, c, g, or t
  misc_feature (563)..(563): n is a, c, g, or t
  misc_feature (565)..(565): n is a, c, g, or t
acccacaggtgagcatctgacatcgtggagcagcaccccacacccacaggtgagcatctgacagcctggagcagcacccacacccccaggtgagcatctgacagcctggaacagcacccacacccccaggtgagaatctgacagcctggaagagcaagcgcaccccgaggtgagcatatgacagcctggaacagcacccacacccccaggcgagcatctgacagcctggagcagcacccacacccccaggtgagcatctgacagcctggagcagcacccacacccccaggtgagcatcttgacagcctggaacagcacccacacccccaggtgagcatctgacagcctggaacagcaccctncacccccaggtgagcatctgacagcctggagcagcaccccacacccccaggtgagcatctganagcctggaacagcacccacaccnccaggtgagcatctgagaggagcagcacccacacccccaggtgagcatctgacagcctggaacagcacccacacccccaggtgagcatctgncagctgctcagccngccngctcnanccggaccagctcat

SEQ ID NO: 730241 - DNA, 798 bp, Homo sapiens
caaaatgtggcacatatacaccatggactatcacatagccataaaaagaatgaaatcatgtcctttgcagcaacatggatgcagctggaggccattatccaaagcaaattaacacaggaacagacaagctaataccacatgttctctcttataagtgggagataagcattgggtactcatggcaaaaagatggcaacaatagacactggggaatactagaaaggcagggggcaagggttaaaaaactaactattgggtgctatgttcactacctgagtgacaggatcaatcataccccaaacctcaacatcacacaatgcgcccacataacaaacctgcacatatattccctgaatctaaaataaaagttgaaatgataaaaaacgtgggcggagggggaggaattatttaaaaaaaaaaaaaaaagcaaattgtggtatacccacataatagaatactacttggcaataaaaaggaattaaatatggatactcacaacatgaccaaaagaatccagaccaaaaaatagtacattactgtatgattccacttatataaaaacctataaaatgtaaacaaatctatactgatagaaagtagctcgacagttgcctgagaattagggaggttagggaagggtggaaggaagggattaacaaagaagcagaaaggcactttggggaataatagatacgttaaccatcttaattgtggtgatggtttcatggtgtgtacatatgctggaatgtatcaaactatacagtttaaatacatgcagttttttttgtaggtcaatca

SEQ ID NO: 730242 - DNA, 803 bp, Homo sapiens; identical to SEQ ID NO: 728495

SEQ ID NO: 730243 - DNA, 717 bp, Homo sapiens; identical to SEQ ID NO: 728496

SEQ ID NO: 730244 - DNA, 721 bp, Homo sapiens; identical to SEQ ID NO: 728497

SEQ ID NO: 730245 - DNA, 1152 bp, Homo sapiens; identical to SEQ ID NO: 45738

SEQ ID NO: 730246 - DNA, 984 bp, Homo sapiens; identical to SEQ ID NO: 728499

SEQ ID NO: 730247 - DNA, 847 bp, Homo sapiens; identical to SEQ ID NO: 728507

SEQ ID NO: 730248 - DNA, 1358 bp, Homo sapiens
aaaaagcaggaggaagaggcgacggcggcctgtggacgtcttgcaggggtccccgaagccaagcagggtcccaaggccgattcagactccgacctagagacggaaggtgctcggggcaggggccaggcccgtctcctccccttgggggcttctcccgcaggggttgtgggaggtgggctggcgccgccgaggaggcaggagacctctgtccagcagggcacgtagccctctgcggggcgtctccagccccctgccctctcctcggcgctcctggcggcatcaggaactttaccatgagaaggcgcttctagaaggaggttaaaatggaaaatcccgccagacagtgcaccaaaggctgtcccgccctgaaatgcaatcagagctgggttttcccaatccacagatgtggacctgttggagaaccagctgggagtggcaggagcccaggccctctgtgccgccctcacagtgaaccaggccatgcggaagatgcagctgtcagggaatggcctggaggagcaggcggcccagcaccttgccgaactcctgctggcccacacagacctgaagtccctggacctgagctacaaccagctgaatgaccaagcaggcagatctgtgcatgggactgcagggcttcctcatcttccacagctttgggggcggcactggctctgggttcgtgtctctgctcatgaagcggctctcggtggactacgggaagaagtccaagctggagtttgccatttgcccagccccccaggtctccatggccatgacggagccctacaactccatcctgaccacctacacgaccctggaacattctgactgtgccttcatagtcgacagcaaagccacctatgacatgtcagcacaacctggacatcgagtgtcccatgtacaccaacctcagtcgtctgggcagatcgtgtcctccatcacggcctccctgtgattcgatggggccctgaatgtgtacttgacagaattccaaaccaacttggtgccatacccccacatccacctccccctggccacctacgccctggtcatctcagccaagaaggcctaccatgagcagctgtccgtggccaagatcgccagtgcccgcttcgagccagccaatcagatggtcaagtgtgaccctcaccatggcaagtacatggcctgctgcatgttgtacagaggggatgtggtcctgaaagatgtcagtgcggctgtcgccaccatcaagagcaagcacaccaaccagtttgtggactggtgtccgattggatttaaggtaggactgggtgatgtggagtccttgtgccatcaggaagcaggagacctgcagaataatgctgcccctgaag

SEQ ID NO: 730249 - DNA, 753 bp, Homo sapiens
aaaaagcaggaggaagaggcgacggcggcctgtggacgtcttgcaggggtccccgaagccaagcagggtcccaaggccgattcagactccgacctagagacggaaggtgctcggggcaggggccaggcccgtctcctccccttgggggcttctcccgcaggggttgtgggaggtgggctggcgccgccgaggaggcaggagacctctgtccagcagggcacgtagccctctgcggggcgtctccagccccctgccctctcctcggcgctcctggcggcatcaggaactttaccatgagaaggcgcttctagaaggaggttaaaatggaaaatcccgccagacagtgcaccaaaggctgtcccgccctgaaatgcaatcagagctgggttttcccaatccacaggcacccatggacttggagaactggtcggggacaccctgtacctgaggtcttgctggatccatagcattgtgcccatcttctgctttctgtgccaagggagtgccccagagctgaacctgctgcacggtggcctggggccccagatgtggacctgttggagaaccagctgggagtggcaggagcccaggccctctgtgccgccctcacagtgaaccaggccatgcggaagatgcagctgtcagggaatggcctggaggagcaggcggcccagcaccttgccgaactcctgctggcccacacagacctgaagtccctggacctgagctacaaccagctgaatgaccaagcag

SEQ ID NO: 730250 - DNA, 840 bp, Homo sapiens
  misc_feature (13)..(13): n is a, c, g, or t
  misc_feature (65)..(65): n is a, c, g, or t
  misc_feature (539)..(539): n is a, c, g, or t
  misc_feature (552)..(552): n is a, c, g, or t
  misc_feature (559)..(559): n is a, c, g, or t
  misc_feature (621)..(621): n is a, c, g, or t
  misc_feature (704)..(704): n is a, c, g, or t
  misc_feature (775)..(775): n is a, c, g, or t
  misc_feature (813)..(813): n is a, c, g, or t
ccttggtataccngagggacaaactagagatcagttgacaaaggagaagtgacaaaagataagcngcagaaggacctcagaagggcagagcaaagggtgagcctacagtaagacacttctatcagcagtgttaatggaagaaattcctaccaatgggcaatcaaaaaagccagtgtgagaagaaaactgatgagctgtcaactgtcaaaaatcagggggaagggggaagcattagtttggatgtaggcccttgttcagtcattttctctaaggccttggaagcaaacatcttctggcatatggcttgttaatgttgtgtttacactaactgccaaaatgtgcctgttgtaagtttggttaaaacttttatcttagtattgaaaatatatagcaagttttaagtcattactgagttacttgttacccttacagaattaagaaaaatagcacagtatgacattttaaaattcatgtacaggtgcattctagttacatgaacatgctagttaaataaaagtcacaattaagtcattatgacncagagtactttanaataaancagatgccctgaggccctgttgaggaagtagaatcccaatgggactccagacagtaaatctntttcgctgttttcagctctgtcacatgctcagtttgtgacccagggaaaagactattgctttgccatgcctgttttcctaaanaaaacagttgctggcatttgcacatccacaacgtgttgattaacaaagggattggtggagataaacagatnccaaacctgacctatttcttaaactttatggaataaancaaatttaggatttctcatcaatcata

SEQ ID NO: 730251 - DNA, 995 bp, Homo sapiens
  misc_feature (715)..(715): n is a, c, g, or t
  misc_feature (750)..(750): n is a, c, g, or t
  misc_feature (780)..(780): n is a, c, g, or t
  misc_feature (796)..(797): n is a, c, g, or t
  misc_feature (804)..(804): n is a, c, g, or t
  misc_feature (826)..(826): n is a, c, g, or t
  misc_feature (906)..(906): n is a, c, g, or t
  misc_feature (908)..(908): n is a, c, g, or t
  misc_feature (985)..(985): n is a, c, g, or t
agcgggccgcgctcgtggctcgagctccgcgcactccctccgcggccgctgagccgagcggacgcccccgggggccgcgtcgcagccctccgtgctcccccctatcatgcccggtgcccaggctggggccgcccaagcagccaggacaccatgcccgaggacggcgctggcgacggcggggaggtgcccgcgctcatcccggacggcgagccgctgcgggaagagcagcggcccctgaaacagtccctgggaagctccctgtgccgcgagtcgcactggaagtcctgctcctcacgctgctcatccacgcctgcggggccgtggtggcctggtgtcgcctggccacagtgccgcggctggtcctggggcccgaggccgccttggcccggggagccgggggcccgccaccgacctacccggccagcccctgctccgatggctacctgtacatcccgctggccttcgtctccctcctctacctcctctacctggctgagtgctggcactgtcacgtgcggtcctgccaggcgccacgcaccgacagcccacacggtgctggcgctgatccgccggctgcagcaggcgccgccgtgcgtctggtggaaggccaccagctatcactacgtgcggcgcacacgccagatcacgcgctaccgcaacggcgacgcctacaccaccacgcaggtgtaccatgagcgcgctgacagccgcacgncccgcggcgagtttgactactcggcgcacggcgtncgcgacgtctccaaggagctggtggggctngcggacacgcggccannggctgcncttcaacaagtgcttcacttcngcagcgcggaggccgaggcctcgtacctcacgcagcgggcgcgcttcttcagcgccaacgaaggcctggacgactatctngnatgcgcgcgagggcatgcacctgaaggacgtagacttccgcgagtcgctcatggtcttcgccgaccccgcagccgcnctgcgtacgc

SEQ ID NO: 730252 - DNA, 1136 bp, Homo sapiens
  misc_feature (1)..(1): n is a, c, g, or t
  misc_feature (14)..(14): n is a, c, g, or t
  misc_feature (37)..(37): n is a, c, g, or t
  misc_feature (947)..(947): n is a, c, g, or t
  misc_feature (951)..(951): n is a, c, g, or t
  misc_feature (1128)..(1128): n is a, c, g, or t
naactgtgattggntcaattttaccataccgaaagantaaattcatttgagcttttacctacgcctttgctttttgttaaaggaagaattcaatgcaatgtgttcagaaagttacatttaaatcgttaataaagagaaaaaggaagagaaagagaggacaccattccgacacaaacgtttatgtgattttagccattacaacagtaattcagaaatatctcaaatgttacattgatgtcatcaatattacaaaaaaggaaaaaaaagtgacaggcaacagtgaagagcaccagagacccagcgcacacctaaagtagaccatgcttctttccttccactgccaggttatcgtcccgggaagccccccaccccctcgctttcctcctccgctttccctaacccgtctcgcgggggcatctacgcctcgtcctcgccctcctcctcctcgaactccccttgttcgtcggccgtggcgtcctggtactgctggtactcggacaccaggtcgttcatgttgctctcggcctcggtgaactccatctcgtccatgccctcgcccgtgtaccagtgcaggaaggccttgcgccggaacatggccgtgaactgctcggagatgcgcttgaacagctcctggatggccgtgctgttgccgatgaaggtggccgacatcttcaggccgcggggcgggatgtcgcacacggccgtcttcacgttgttggggatccactccacgaagtagctgctgttcttgttctgcacgttgagcatctgctcgtccacctccttcatggacatgcggccccggaagatggcagccaccgtcagtagcggccgtggcgcgggtcgcaggcggccatcatgttcttggagtcgaacatctgctgggtgagctcgggcacgtgagcgcccggtactgctggctgccccggctggtcaggggcgcgaancggngcatgaagaagtgcaggcgagggaagggcaccatgttcaccgccagcttgcgcaggtctgcgttcagctggcccgggaagcgcaggcaggtggtgaccccgctcatggtggccgacaccaggtggttgaggtccccgtagtggggggtggtcagcttcagggtgcggaagagatgtnatacaggg

SEQ ID NO: 730253 - DNA, 1136 bp, Homo sapiens
  misc_feature (1)..(1): n is a, c, g, or t
  misc_feature (14)..(14): n is a, c, g, or t
  misc_feature (37)..(37): n is a, c, g, or t
  misc_feature (420)..(420): n is a, c, g, or t
  misc_feature (445)..(445): n is a, c, g, or t
  misc_feature (462)..(462): n is a, c, g, or t
  misc_feature (465)..(465): n is a, c, g, or t
  misc_feature (468)..(469): n is a, c, g, or t
  misc_feature (477)..(478): n is a, c, g, or t
  misc_feature (484)..(484): n is a, c, g, or t
  misc_feature (487)..(487): n is a, c, g, or t
  misc_feature (493)..(493): n is a, c, g, or t
  misc_feature (501)..(501): n is a, c, g, or t
  misc_feature (503)..(503): n is a, c, g, or t
  misc_feature (507)..(507): n is a, c, g, or t
  misc_feature (547)..(547): n is a, c, g, or t
  misc_feature (558)..(559): n is a, c, g, or t
  misc_feature (566)..(566): n is a, c, g, or t
  misc_feature (580)..(580): n is a, c, g, or t
  misc_feature (586)..(587): n is a, c, g, or t
  misc_feature (947)..(947): n is a, c, g, or t
  misc_feature (951)..(951): n is a, c, g, or t
  misc_feature (1128)..(1128): n is a, c, g, or t
naactgtgattggntcaattttaccataccgaaagantaaattcatttgagcttttacctacgcctttgctttttgttaaaggaagaattcaatgcaatgtgttcagaaagttacatttaaatcgttaataaagagaaaaaggaagagaaagagaggacaccattccgacacaaacgtttatgtgattttagccattacaacagtaattcagaaatatctcaaatgttacattgatgtcatcaatattacaaaaaaggaaaaaaaagtgacaggcaacagtgaagagcaccagagacccagcgcacacctaaagtagaccatgcttctttccttccactgccaggttatcgtcccgggaagccccccaccccctcgctttcctcctccgctttccctaacccgtctcgcggggggatgtnggggtcgtggtgggggtcgtggtgntggggctccccttgttngtnggnngtggggtnntggtgntgntggtgntcgggcancnggtngttggtgttggtgtgggggtgggtggagtgggtgtggtgngtgggctgggnngtgtggnggtggggggggggnttgggnnggggcgtgggggtggggtggtggggggtggggttgggggggtgctgggtgggggtggtgttgggggtgcgggtggccgacatcttcaggccgcggggcgggatgtcgcacacggccgtcttcacgttgttggggatccactccacgaagtagctgctgttcttgttctgcacgttgagcatctgctcgtccacctccttcatggacatgcggccccggaagatggcagccaccgtcagtagcggccgtggcgcgggtcgcaggcggccatcatgttcttggagtcgaacatctgctgggtgagctcgggcacgtgagcgcccggtactgctggctgccccggctggtcaggggcgcgaancggngcatgaagaagtgcaggcgagggaagggcaccatgttcaccgccagcttgcgcaggtctgcgttcagctggcccgggaagcgcaggcaggtggtgaccccgctcatggtggccgacaccaggtggttgaggtccccgtagtggggggtggtcagcttcagggtgcggaagagatgtnatacaggg

SEQ ID NO: 730254 - DNA, 738 bp, Homo sapiens; identical to SEQ ID NO: 582345
  misc_feature (1)..(1): n is a, c, g, or t
  misc_feature (14)..(14): n is a, c, g, or t
  misc_feature (37)..(37): n is a, c, g, or t
  misc_feature (423)..(423): n is a, c, g, or t
  misc_feature (434)..(434): n is a, c, g, or t
  misc_feature (438)..(439): n is a, c, g, or t
  misc_feature (442)..(442): n is a, c, g, or t
  misc_feature (444)..(444): n is a, c, g, or t
  misc_feature (447)..(447): n is a, c, g, or t
  misc_feature (454)..(454): n is a, c, g, or t
  misc_feature (457)..(457): n is a, c, g, or t
  misc_feature (463)..(463): n is a, c, g, or t
  misc_feature (466)..(466): n is a, c, g, or t
  misc_feature (499)..(499): n is a, c, g, or t
  misc_feature (515)..(515): n is a, c, g, or t
  misc_feature (573)..(573): n is a, c, g, or t
  misc_feature (577)..(577): n is a, c, g, or t
  misc_feature (591)..(592): n is a, c, g, or t
  misc_feature (596)..(596): n is a, c, g, or t
  misc_feature (602)..(602): n is a, c, g, or t
  misc_feature (615)..(615): n is a, c, g, or t
  misc_feature (617)..(617): n is a, c, g, or t
  misc_feature (692)..(692): n is a, c, g, or t

SEQ ID NO: 730255 - DNA, 1403 bp, Homo sapiens
  misc_feature (20)..(20): n is a, c, g, or t
  misc_feature (70)..(71): n is a, c, g, or t
  misc_feature (73)..(73): n is a, c, g, or t
  misc_feature (94)..(95): n is a, c, g, or t
  misc_feature (101)..(102): n is a, c, g, or t
  misc_feature (104)..(104): n is a, c, g, or t
  misc_feature (137)..(137): n is a, c, g, or t
  misc_feature (143)..(143): n is a, c, g, or t
  misc_feature (192)..(192): n is a, c, g, or t
  misc_feature (199)..(199): n is a, c, g, or t
  misc_feature (229)..(229): n is a, c, g, or t
  misc_feature (232)..(232): n is a, c, g, or t
  misc_feature (235)..(235): n is a, c, g, or t
  misc_feature (243)..(243): n is a, c, g, or t
  misc_feature (276)..(276): n is a, c, g, or t
  misc_feature (293)..(294): n is a, c, g, or t
  misc_feature (301)..(301): n is a, c, g, or t
  misc_feature (305)..(305): n is a, c, g, or t
  misc_feature (320)..(320): n is a, c, g, or t
  misc_feature (330)..(330): n is a, c, g, or t
  misc_feature (371)..(371): n is a, c, g, or t
  misc_feature (376)..(376): n is a, c, g, or t
  misc_feature (390)..(390): n is a, c, g, or t
  misc_feature (612)..(612): n is a, c, g, or t
  misc_feature (666)..(666): n is a, c, g, or t
  misc_feature (679)..(681): n is a, c, g, or t
  misc_feature (684)..(684): n is a, c, g, or t
  misc_feature (690)..(690): n is a, c, g, or t
  misc_feature (703)..(703): n is a, c, g, or t
  misc_feature (720)..(720): n is a, c, g, or t
  misc_feature (729)..(730): n is a, c, g, or t
  misc_feature (739)..(740): n is a, c, g, or t
acggtcagagcctccccatnagtcccggggtaaagcgacccattgaaaacagaaaactaattctacccanngncacgagaaatgaaacagaacnntataanngnaaaatacgggaccagaaatggtggcctccgcantaaccnaatcatcctaaatgtcctctaagagaccagacctccccagaaataaccnataaaanacctattaccagaatcaggagaaaacctcnacntgncctgcttnacggaatctaacccaccggcagagtatttttgnacaattaatgggaagtnncagcaancagnacaaaagctctttancccccaaatnactagaaatcatggcgggctctagctgctctgttcataacncagcnactggcaaggaaanctccaaatccatgacagtcaaagtctctggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgtnttattctccagatttatgaactttttttcttcagcaattggtaaagtatacttntgtaaacaaaaannnganatattngctttgctgctanctgaatgccccagaatngtgaaacanncatgagtanncatattcatggtactacagttatttgcacatgttccgtacaaccacaacaaccaccaccccccccccaacccaccgcacacacccacaccccaaaccaccaccccaacaacccaacacccccacgcacacacgcacagcaccgcccaaagcacgcagaacgaacaagcgagcacaacagtggcgcggcagccgggcgcgcacaggtcgagccgagcgaacgagcgaggacaccgacgaccagggcgagggcgacgcgacgcgcccccagcaccaacgccgcaacagcaccatgcacccacccacacgacacacacgaaaggagagacaacgaaaaccaacagaagggacgcgacgggcgagcaacactaacgagcgggggggcggaccaagagagaatgagacgacgaggaagaacaacaaaacgaaggaaggagaaggacagcagcaggcgccgcaaccggcaccagcagacagggaggaacgagacgcgcgaggcagcagacgagaccccggcgcgcgccgaggcggaagaaggagcgacccacccgacagaccgacacagaactaacgacagcacacagcagaacgcccgaccacgacgcccaacacggacgcacccgacaacgcagaaccccaggccgaggcgacgacacagcgagccc

SEQ ID NO: 730256 - DNA, 941 bp, Homo sapiens
  misc_feature (876)..(876): n is a, c, g, or t
  misc_feature (892)..(892): n is a, c, g, or t
  misc_feature (895)..(895): n is a, c, g, or t
gggcacatcaaaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccaaaagtgtgggaacagatttgtggaaaagaaggagaggagtgttgactgtggggaagccagaggaatgtattgaatccctgctgcaatgccaccacctgtaccctgaaagccggacgctgtgtgcgcacatgggctgtgcngtaaagactgcaactnaanctgcaggaacacgtgcagggactccagaaactcctgtgacctccca

SEQ ID NO: 730257 - DNA, 570 bp, Homo sapiens
acagtttatgatgtcagagtgaatactttctttgagttgcagtcagaaactgtagatttttaaaaatttaaaattcattattctctgtcagtattccaaagtgtatacagaaagctattgcactgttcaggagatggcgcttaacattttggaaattcaaggtgatgaatgtccagataagactatctctcctggtacaaagtttgacaatgctgaacatttttaaaggttctttttgatatacaaagtgcaccaatgagtgctttttaattcttacaataattctgggtgaggtaggtatttttccaattcccattttatgcttcggtagccctttgtatttatacttcaaaacacttggctctcttgtaattatttaagaaattagttgtgattatttgtttaatgtgcaggagttacaaaaggcaagctttagaacaagacagacctggttatgattcctggctctgaaagctgtacaccctgtgaccctagacaggtgttttaatgcctcgctgcctctgtttcttgctctgtaaaatgtgaacaataacagtattggcctcatgc

SEQ ID NO: 730258 - DNA, 976 bp, Homo sapiens
  misc_feature (18)..(18): n is a, c, g, or t
aaaaatgaaaatggggcnccagaagatgaagagaattttgaagaagctattaaaaatgtgaacacagcactaaatacaactcagatcccaagcagtattgaagatatatttaatgatgatcgctgcataaatatcaccaaacagactccatcatttggattttagctcgtgccttaaaggaattgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgt

SEQ ID NO: 730259 - DNA, 399 bp, Homo sapiens
cacaaagggagactagcaattatttggtcttcgaggcaagttagcaccacacagagactcttctggatataaaggaaagactgtaaagaatttgcagagagaataactctcgctatgtgacccgaggtgattttatgctttgcctgtgcagcctataaaataatcttgtgtggtccccatgatgcacatcaaccaggagatgctggagagtctgagacagcgtgctggcagcactctgccgggggaaggacacggaggtgtccaggctcggctccaaaagcagacaagcctgcactgcgctggagcaggtgagaagtagctgggttccaccgtgcccttttcgtctgtgtcccttgccacccaacacgagctcagcacacagttgatcttcactaacta

SEQ ID NO: 730260 - DNA, 673 bp, Homo sapiens
  misc_feature (37)..(37): n is a, c, g, or t
  misc_feature (44)..(44): n is a, c, g, or t
  misc_feature (51)..(51): n is a, c, g, or t
  misc_feature (62)..(62): n is a, c, g, or t
  misc_feature (67)..(67): n is a, c, g, or t
  misc_feature (70)..(70): n is a, c, g, or t
  misc_feature (72)..(73): n is a, c, g, or t
  misc_feature (85)..(85): n is a, c, g, or t
  misc_feature (94)..(94): n is a, c, g, or t
  misc_feature (115)..(115): n is a, c, g, or t
  misc_feature (117)..(117): n is a, c, g, or t
  misc_feature (121)..(121): n is a, c, g, or t
  misc_feature (123)..(124): n is a, c, g, or t
  misc_feature (170)..(170): n is a, c, g, or t
  misc_feature (172)..(172): n is a, c, g, or t
  misc_feature (195)..(195): n is a, c, g, or t
  misc_feature (201)..(202): n is a, c, g, or t
  misc_feature (218)..(218): n is a, c, g, or t
  misc_feature (226)..(226): n is a, c, g, or t
  misc_feature (238)..(239): n is a, c, g, or t
  misc_feature (244)..(244): n is a, c, g, or t
  misc_feature (248)..(248): n is a, c, g, or t
  misc_feature (259)..(259): n is a, c, g, or t
  misc_feature (319)..(319): n is a, c, g, or t
tattacccgccataaaattcacattaaaaatttaatncccctcnttaaaantgtctttaganaaatnatncnncaaaaaatttcntttacagtncataccatcatgaatgtattnantttncnncaaatctgaatatgctgctgctgcttaaaaagggtacctcatttcntnattattattttaaaacgcagacntctttnnagaatgccgctaagcntgagatcntcattttcaatnnaagcnagcntagaacttttntatttttttttccctaaccactcttaagtggaaaccaattctggactataaatgcagaancagctataggagaagcagttattaatatagattctctagtgccacacagaagataccagtcagcttttaactgagcacttcacctttttcatttttttaaatatatttgatcatgtttttatgttctagtcataaaacaataccccaatacattatataaagctttagtgttacaaaacagaataaatcatttccctatctcctaaacaacaaaattttctcctatatctaggataattttttttcatattttaaatttgtcaggtcagaatgtctcctgtagttggtgatttctcagcaccattttctcagcatatttcttcagtaagttacataaaataatgatgtatctca

SEQ ID NO: 730261 - DNA, 717 bp, Homo sapiens
  misc_feature (50)..(50): n is a, c, g, or t
  misc_feature (244)..(244): n is a, c, g, or t
  misc_feature (253)..(253): n is a, c, g, or t
  misc_feature (265)..(265): n is a, c, g, or t
  misc_feature (397)..(397): n is a, c, g, or t
  misc_feature (407)..(407): n is a, c, g, or t
  misc_feature (706)..(706): n is a, c, g, or t
ttgttttagtaggtctatacataccaccataagacatatatgcttataantagtttgcacgtctaggacatatactcagtggagaaacagtgaatcaccatatgcaaaggcatgtgtatagtacttgacttgcactgtgacgagcaccaggtgccagacatttggccaacatgatctgggtgtgtcagagagtcttcagatcgattacatttggatggcagactaagtaagcagattgcctccnttatagggntgggcctcatcnatccatcaagggccaggagagaattaagaggcctaatgggaaacaaatgctttcctgggtatccagctttccttccatcttgggaatttcagcctccataatctcagaagcaaattcatgtatatatatacncacacatatncatttcataggtatgtggctaagattgtatttttacaagttcagccatgagattggtgaagccagccaatgaataagggtgtgttctattatacgattcagtcttcttttgtaaacgattgaagttctgcatttgaagtaggaggataggagggagcaagtccacctaggatgataacagctgaatttctcaacatacacttcagagccgtaggggtcaacttagagactcaaaaatctcacccataatcctgcccctaaacaccagggctagggaacactgtggccctcaggtgattntctctcgtgcc

SEQ ID NO: 730262 - DNA, 664 bp, Homo sapiens
  misc_feature (1)..(1): n is a, c, g, or t
  misc_feature (29)..(29): n is a, c, g, or t
  misc_feature (40)..(40): n is a, c, g, or t
  misc_feature (80)..(80): n is a, c, g, or t
  misc_feature (245)..(245): n is a, c, g, or t
  misc_feature (254)..(254): n is a, c, g, or t
  misc_feature (266)..(266): n is a, c, g, or t
  misc_feature (653)..(653): n is a, c, g, or t
ntattataccaccccataagaacatgatnatcgcttatanattagtttgctcacagtctagagacaatatagctgcagtntggagaaacagtgaatcaccatatgcaaaggcatgtgtatagtacttgacttgcactgtgacgagcaccaggtgccagacatttggccaacatgatctgggtgtgtcagagagtcttcagatcgattacatttggatggcagactaagtaagcagattgcctccnttatagggntgggcctcatcnatccatcaagggccaggagagaattaagaggcctaatgggaaacaaatgctttcctgggtatccagctttccttccatcttgggaatttcagcctccataatctcagaagcaaattcatgttacaagttcagccatgagattggtgaagccagccaatgaataagggtgtgttctattatacgattcagtcttcttttgtaaacgattgaagttctgcatttgaagtaggaggataggagggagcaagtccacctaggatgataacagctgaatttctcaacatacacttcagagccgtaggggtcaacttagagactcaaaaatctcacccataatcctgcccctaaacaccagggctagggaacactgtggccctcaggtgattntctctcgtgcc

SEQ ID NO: 730263 - DNA, 638 bp, Homo sapiens
acatggagaggaccccatgtgaacagaaccctgaatctgctcattttctgtgctcctgaatgtgtagctacagactctaatttcgaaaacaaacctgataagtgggacggagccaaggcctaggaagctggagccctctctaatgctctggagcctgcccacctcctgagatctggaccagtctctgcctcttctggggcctcagtttcccaattgtaatgtaatgagaaattaaatgtaaaactgcataaacatatgctctgtgagaatttggtgtcagagttctcaatactggatgataatttggagtggggtgggtttgggacccatgggttctcaggcctcctttcacacccagtgcagtaggtgtagagctctggacagccaggtgttctttcctgagccagctgattacaacacaatggaccaagggctctgatcttaaatatggggggagcagatgacaaaccccattatagtgaagaagagcaagaaactagacttgtgggcctggggaaaagaaaaaaacacttctatttctcccaaactgtagaatctcttgtcaaatatttaattttgattatatctgagcttgataatacattcatgtgttaacagctgcttaaatttgttttttc

SEQ ID NO: 730264 - DNA, 631 bp, Homo sapiens
  misc_feature (585)..(585): n is a, c, g, or t
ctcggagatttccactggtgaagtacttgaatgccttttctggaactggcactaccgcccaacttgttggctccagcatccaaagattgtttccaccggacacgaaacacggtgtcacgtttgcgtcagcaacaactgtcactggtacaatagagcattttcgctgcaataaaaatagttctcaccacaatggtgtcaaggtgacattgattgcaatgatgtcagaaatcggggcaacctcaagtttggctgctactctgggcaaaaggttctttccgaaggcagatgctccagcacagatgtgtgtgtaattgaactgcttctgagttgccaaaatcaatggtgtcgctatgcctgctactttacagagatcttgtgccaccttgtcacatttggttccagctactaagcaggacacttcacctccaaggcgtgtggctgcagtaatggtatttaaagtaatgggtgctagggaatcatttgcatgctcagctattaccagggtactctgaaatcgtagcaatgaggccgcccgccggagctgccccggagccgccgctcggaacatggtctccgcttccgccncaacctcggccttacagcagccccgtgcccggccaactggcgccgc

SEQ ID NO: 730265 - DNA, 695 bp, Homo sapiens
  misc_feature (649)..(649): n is a, c, g, or t
ctcggagatttccactggtgaagtacttgaatgccttttctggaactggcactaccgcccaacttgttggctccagcatccaaagattgtttccaccggacacgaaacacggtgtcacgtttgcgtcagcaacaactgtcactggtacaatagagcattttcgctgcaataaaaatagttctcaccacaatggtgtcaaggtgacattgattgcaatgatgtcagaaatcggggcaacctcaagtttggctgctactctgggcaaaaggttctttccgaaggcagatgctccagcacagatgtgtgtgtaattgaactgcttctgagttgccaaaatcaatggtgtccaggttcctctggaagtaggcctgttgtacacaatcatgctgagccacccaggaactttttgctgctatgcctgctactttacagagatcttgtgccaccttgtcacatttggttccagctactaagcaggacacttcacctccaaggcgtgtggctgcagtaatggtatttaaagtaatgggtgctagggaatcatttgcatgctcagctattaccagggtactctgaaatcgtagcaatgaggccgcccgccggagctgccccggagccgccgctcggaacatggtctccgcttccgccncaacctcggccttacagcagccccgtgcccggccaactggcgccgc

SEQ ID NO: 730266 - DNA, 639 bp, Homo sapiens
caactacaatctaatatcagctatacaaaatgtataaggtctaataaactagaaggagatatattaaagtctacagctctgaataacaggattgtggatgattttatgcttatattttatgattatatatactttggctctactaaaaacagaaaaaattagctgggcatggtggtgcacacgtgtggtcccagctacttggagggctgacgtgggaggatcacttgagcctgggaagttgaggctgcagtgagccaagatagcaccactgtactctaccctgggcaacgggagtgagagcgtgtgtcgaaaaacaaataaaaataaaaataattgaatattttagaatgacttgagacacatttaatatgttaagtaaaaacaacaggatgcaagtatctcatatttttaaaaaaggcaattgcaacttttacatgcaaatctcacacacacaaaccccccaaaacaattactaaactatgattcaccaaaatactaacagtggttatctctaattagtcaaataatttaatattcttgatatttttcaaattataatatgcaagaatataatttaatattgacatttttcaaattataatatgcacatactacctatataatcagaagatttaaaaa

SEQ ID NO: 730267 - DNA, 625 bp, Homo sapiens
  misc_feature (63)..(63): n is a, c, g, or t
tttaattcggtaatcaaaatgaaaagggtttaataaatagaggaagatataatgataaaatanactgtggaggcaggccaatcacttgaggttaggagcctgagcaacatggtgaaatcttctctctactaaaaacagaaaaaattagctgggcatggtggtgcacacgtgtggtcccagctacttggagggctgacgtgggaggatcacttgagcctgggaagttgaggctgcagtgagccaagatagcaccactgtactctaccctgggcaacgggagtgagagcgtgtgtcgaaaaacaaataaaaataaaaataattgaatattttagaatgacttgagacacatttaatatgttaagtaaaaacaacaggatgcaagtatctcatatttttaaaaaaggcaattgcaacttttacatgcaaatctcacacacacaaaccccccaaaacaattactaaactatgattcaccaaaatactaacagtggttatctctaattagtcaaataatttaatattcttgatatttttcaaattataatatgcaagaatataatttaatattgacatttttcaaattataatatgcacatactacctatataatcagaagatttaaaaa

SEQ ID NO: 730268 - DNA, 693 bp, Homo sapiens
caactacaatctaatatcagctatacaaaatgtataaggtctaataaactagaaggagatatattaaagtctacagctctgaataacaggattgtggatgattttatgcttatattttatgattatatatactttgggaggcaggccaatcacttgaggttaggagcctgagcaacatggtgaaatcttctctctactaaaaacagaaaaaattagctgggcatggtggtgcacacgtgtggtcccagctacttggagggctgacgtgggaggatcacttgagcctgggaagttgaggctgcagtgagccaagatagcaccactgtactctaccctgggcaacgggagtgagagcgtgtgtcgaaaaacaaataaaaataaaaataattgaatattttagaatgacttgagacacatttaatatgttaagtaaaaacaacaggatgcaagtatctcatatttttaaaaaaggcaattgcaacttttacatgcaaatctcacacacacaaaccccccaaaacaattactaaactatgattcaccaaaatactaacagtggttatctctaattagtcaaataatttaatattcttgatatttttcaaattataatatgcaagaatataatttaatattgacatttttcaaattataatatgcacatactacctatataatcagaagatttaaaaa

SEQ ID NO: 730269 - DNA, 449 bp, Homo sapiens
ctctactaaaaacagaaaaaattagctgggcatggtggtgcacacgtgtggtcccagctacttggagggctgacgtgggaggatcacttgagcctgggaagttgaggctgcagtgagccaagatagcaccactgtactctaccctgggcaacgggaaatgacttgagacacatttaatatgttaagtaaaaacaacaggatgcaagtatctcatatttttaaaaaaggcaattgcaacttttacatgcaaatctcacacacacaaaccccccaaaacaattactaaactatgattcaccaaaatactaacagtggttatctctaattagtcaaataatttaatattcttgatatttttcaaattataatatgcaagaatataatttaatattgacatttttcaaattataatatgcacatactacctatataatcagaagatttaaaaa

SEQ ID NO: 730270 - DNA, 372 bp, Homo sapiens
gccgaggtggggggatcgcctgaagtcaggagtttgagaccagcctgatcaacatggtgaaaccctgtctctactaaaaaatacaaaaatcagtcaggcatggtggcaggcacctgcagtcccagctacttggaaggctgagccaggagaatcttgcttgaacccaggatactgtagaggttccagtgagccgagatcacgccattgcattccagcctgggcaccaagagtaagactccatcttggagaagggctccatttctcttgaagaaggtactgcccggccagatgggtggacctgatgtgctttgatatgcctgagtcaaagcctgaattagattttgtctatactctgggtctatgcaccacaac

SEQ ID NO: 730271 - DNA, 812 bp, Homo sapiens
ttttttttaaaaagagacaggtcttactctgttatccatgctggagtgcagtggtgccatcatagctcattgcagctttgaacaccatggctcaagtgagcctcctgcctcagcctcctgagaagttgggattatgggcgtgagccactacataccaaattttctctgtcctctcacctgtcgataggcacttaggttgattccctatctgggctactgtataattctgcagtgagcatggagcgcaggcatctctctgagatcccgatttcaattcctttggatacatacccagaatgggggactgttagatcatatggtagctccatttttaactttttcgggcacctccatgttttccataatggctgtattaatttacattcccaccaacagtgcacaagggtccctttctccacaccctcaccaactcttgctgtctccagagttttcggttaacagccatgatatctcattgtgattttgatttgcatttccctgataattagtgctgtttctagttctttgacttaaacagagatccttctgagagaaatacaattagtcattttctatggtagggagaaatccaccataagacaaagaggccagaactaaggcaaagaggacctgtgttctggcactggctctacagtgttgtggctgcattatctagggtaaacacgcccatgggactctgcctggatctctattgagccacaggacactgaaattatccatttgcaggtctgccttcccgtgtataggccgtctgtcctggtctgggctggcgggtaggcattacaccttcc

SEQ ID NO: 730272 - DNA, 759 bp, Homo sapiens
ttttttttaaaaagagacaggtcttactctgttatccatgctggagtgcagtggtgccatcatagctcattgcagctttgaacaccatggctcaagtgagcctcctgcctcagcctcctgagaagttgggattatgggcgtgagccactacataccaaattttctctgtcctctcacctgtcgataggcacttaggttgattccctatctgggctactgtataattctgcagtgagcatggagcgcaggcatctctctgagatcccgatttcaattcctttggatacatacccagaatgggggactgttagatcatatggtagctccatttttaactttttcgggcacctccatgttttccataatggctgtattaatttacattcccaccaacagtgcacaagggtccctttctccacaccctcaccaactgatttgcatttccctgataattagtgctgtttctagttctttgacttaaacagagatccttctgagagaaatacaattagtcattttctatggtagggagaaatccaccataagacaaagaggccagaactaaggcaaagaggacctgtgttctggcactggctctacagtgttgtggctgcattatctagggtaaacacgcccatgggactctgcctggatctctattgagccacaggacactgaaattatccatttgcaggtctgccttcccgtgtataggccgtctgtcctggtctgggctggcgggtaggcattacaccttcc

SEQ ID NO: 730273 - DNA, 609 bp, Homo sapiens
  misc_feature (497)..(497): n is a, c, g, or t
tcccccgggctgcaggattcggcacgagcttttgacagataacatttaatagtaataaataagtggtaataagtaataaataataattgagtgcttttcacattccaggtgctgagctgttttgcatttcacgcccctcatcttcatttatattgttgttcttaattatccccattttaccgatgaggaaagggagattgtaaccaccccgaggctgcacagctaatacccagagagcagaatttcgccacatgcgaagattctagctaatcctgcattatctggtacccaccatttgtatcccggcatcatttatcttctccctaccttgttgccaaggcacgtgtgggtccctaacggctggcaccaattattcaagacaccctaagggagaccagaaggaaagcgatatttaagaaatgcaggcacagaaaatttaagcattttagactcattctccatcagaacagggaggtctttgaagaggctgcttttgnccagcaattagtcaatgactctagaatttcagcgcagatccgatgagtatagaaggacgccgtgtacgccctgtgttgcccatgcaacgcaggcatgcctcttctcctttgg

SEQ ID NO: 730274 - DNA, 663 bp, Homo sapiens
  misc_feature (551)..(551): n is a, c, g, or t
tcccccgggctgcaggattcggcacgagcttttgacagataacatttaatagtaataaataagtggtaataagtaataaataataattgagtgcttttcacattccaggtgctgagctgttttgcatttcacgcccctcatcttcatttatattgttgttcttaattatccccattttaccgatgaggaaagggagattgtaaccaccccgaggctgcacagctaatacccagagagcagaatttcgccacatgcgaagattctagctaatcctaaaatctgtttttcaccagacgacgccggcccttccggcttgtcgtgcagcacggcattatctggtacccaccatttgtatcccggcatcatttatcttctccctaccttgttgccaaggcacgtgtgggtccctaacggctggcaccaattattcaagacaccctaagggagaccagaaggaaagcgatatttaagaaatgcaggcacagaaaatttaagcattttagactcattctccatcagaacagggaggtctttgaagaggctgcttttgnccagcaattagtcaatgactctagaatttcagcgcagatccgatgagtatagaaggacgccgtgtacgccctgtgttgcccatgcaacgcaggcatgcctcttctcctttgg

SEQ ID NO: 730275 - DNA, 1207 bp, Homo sapiens
actttggaaggccgaggtaggcggatcacctgagctcaggagtttgagaccagcctgtctctactaacaatataaaaattagctgggagtcacggtgggcgcctgtaatcccagctactcgggaggctgaggcaggagaattgcttgaacccaggagacagaggttgtagtgagctgagatcgcaccactgcactctagccttggcaacagtgcaagactgtctcaaaaacagcaacagagagcaggacgtgagacttctacctgctcactcagaatcatttctgcaccaaccatggccacgtttgtggagctcagtaccaaagccaagatgcccattgtgggcctgggcacttggaagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacgcaggagaaactgatccagtactgccactccaagggcatcaccgttacggcctacagccccctgggctctccggatagaccttgggccaagccagaagacccttccctgctggaggatcccaagattaaggagattgctgcaaagcactccccaagtctgtgacaccagcacgcattgttgagaacattcaggtctttgactttaaattgagtgatgaggagatggcaaccatactcagcttcaacagctggagggcctgtaacgtgttgcaatcctctcatttggaagactatcccttcgatgcagaatattgaggttgtctcctggtgagattatac

SEQ ID NO: 730276 - DNA, 1244 bp, Homo sapiens
attagtattagtaaatcattaaaattaatatagtattattttctgttactttattgtcctgcctcagtgcctcataagaactttgagcccagaattattatctcaggattctttggcaaactactgtaatcagcagattaatgtagtttctaatggtctccatctcctgggattccaacccttgtctaataccctccccatgggtgtcagctggatccataggcttgctgctgttgcacagaatacagcaaacatgatgagaggttgattctgtgattagttgacaaaagatgtgacttctgtcttggactcttttcaatggcttttttttttggcttcgcacattttgatgaagaaaccttcccatactgaagaggctcacattatatggaattctggacaacagctgtcaaagtactgaatataccatcaagcatgtgagtgagattgattataacttgtgagagtctctgaatagaagacccagttaagccatgcccagattcctgcaccacagaaacttcgagataataaaggttgtttttttttttttgtggtgaagaatatgtttctcatctttttttataatataaatacttttgaaatgtaacttttttatcttaataaacatttaacaaatcatttgaagatggataatcacagatatcaatttttaccaacataaccaggactttccttgtaactttgactaatagatgatcttttgaacattaccactttgtaactgcatttcagactatgatttagttgaatcacccaaagtgtgtaatgtcttttaatgtgcactatcaattctgttctgccataatgacctcattttgggttcttaaatatattcatctcagtcttgtggggtgactctctcaagaagaatgactgctgctaataccaagaacttctgttgtttccataaataacagccagattacagccagaacctcaaggctgagcacagccgctcatgtttggaatcccagccctttgggattaataggcctagacaggaggatcacttgaggacaggagtttgagaccagattgggcaacaatgcaagattttgtctctgaaaaaaataaaataaaataagctgggcatggtgttacatgcctttaatctcagctactcagaggctgagcctggaggattgcttgagtccagcagttcaaggtagtaagctacgataacaccaccacatcccagtctgggtaacagaacgagaccc

SEQ ID NO: 730277 - DNA, 1299 bp, Homo sapiens
attagtattagtaaatcattaaaattaatatagtattattttctgttactttattgtcctgcctcagtgcctcataagaactttgagcccagaattattatctcaggattctttggcaaactactgtaatcagcagattaatgtagtttctaatggtctccatctcctgggattccaacccttgtctaataccctccccatgggtgtcagctggatccataggcttgctgctgttgcacagaatacagcaaacatgatgagaggttgattctgtgattagttgacaaaagatgtgacttctgtcttggactcttttcaatggcttttttttttggcttcgcacattttgatgaagaaaccttcccatactgaagaggctcacattatatggaattctggacaacagctgtcaaagtactgaatataccatcaagcatgtgagtgagattgattataacttgtgagagtctctgaatagaagacccagttaagccatgcccagattcctgcaccacagaaacttcgagataataaaggttgtttttttttttttgtggtgaagaatatgtttctcatctttttttaaattttattattatactttattttgggataatttgttatggaggaatttgacaaataatataaatacttttgaaatgtaacttttttatcttaataaacatttaacaaatcatttgaagatggataatcacagatatcaatttttaccaacataaccaggactttccttgtaactttgactaatagatgatcttttgaacattaccactttgtaactgcatttcagactatgatttagttgaatcacccaaagtgtgtaatgtcttttaatgtgcactatcaattctgttctgccataatgacctcattttgggttcttaaatatattcatctcagtcttgtggggtgactctctcaagaagaatgactgctgctaataccaagaacttctgttgtttccataaataacagccagattacagccagaacctcaaggctgagcacagccgctcatgtttggaatcccagccctttgggattaataggcctagacaggaggatcacttgaggacaggagtttgagaccagattgggcaacaatgcaagattttgtctctgaaaaaaataaaataaaataagctgggcatggtgttacatgcctttaatctcagctactcagaggctgagcctggaggattgcttgagtccagcagttcaaggtagtaagctacgataacaccaccacatcccagtctgggtaacagaacgagaccc

SEQ ID NO: 730278 - DNA, 528 bp, Homo sapiens
attagtattagtaaatcattaaaattaatatagtattattttctgttactttattgtcctgcctcagtgcctcataagaactttgagcccagaattattatctcaggattctttggcaaactactgtaatcagcagattaatgtagtttctaatggtctccatctcctgggattccaacccttgtctaataccctccccatgggtgtcagctggatccataggcttgctgctgttgcacagaatacagcaaacatgatgagaggttgattctgtgattagttcgcacattttgatgaagaaaccttcccatactgaagaggctcacattatatggaattctggacaacagctgtcaaagtactgaatataccatcaagcatgtgagtgagattgattataacttgtgagagtctctgaatagaagacccagttaagccatgcccagattcctgcaccacagaaacttcgagataataaaggttgtttttttttttttgtggtgaagaatatgtttctcatcttttttt

SEQ ID NO: 730279 - DNA, 682 bp, Homo sapiens
cttagtattctggggaatggtccagattccccaaaagggaatgagctctgttgcaggaggctcactgtttataaagttaataatactctttcctttttgttttttagcttttattttttcccctggaaaatataaaatatgggtttaaaagaaacatcaaccttgagcccattttttggggttctctatggaaaggaagaggagagattatggttcttgatatggccaggtacactaagaaaacttttttttttcattctttaaaaatctaagtaaatattaacactagaactcatcatttgcatatttatttgttattaaagccccagaaaatgtatcttactgacttatgatgatgatgtatttgatgaatatgagtcaaaaattttgctaagccttatctcctcttctgctctaagaaaagagattgttgaaagacctgtgctggaagtagttgaaagcatatttttattgcaattaaattctcagtttttataaacaagggataatgttcaaacacagtggacagtgcattatggactatttttttaagtctcagtatgatattcttttctttcagaacaagaatgtttcacttacccgtgacgtttctggttggccatattttttcttaaacacaaagggaccctgcagtagacttatgcagatggcagactatttt

SEQ ID NO: 730280 - DNA, 628 bp, Homo sapiens
cttagtattctggggaatggtccagattccccaaaagggaatgagctctgttgcaggaggctcactgtttataaagttaataatactctttcctttttgttttttagcttttattttttcccctggaaaatataaaatatgggtttaaaagaaacatcaaccttgagcccattttttggggttctctatggaaaggaagaggagagattatggttcttgatatggccaggtacactaagaaaacttttttttttcattctttaaaaatctaagtaaatattaacactagaactcatcatttgcatatttatttgttattaaagccccagaaaatgtatcttactgacttatgatgatgatgtatttgatgaatatgagtcaaaaattttgctaagccttatctcctcttctgctctaagaaaagagattgttgaaagacctgtgctggaagtaaatgttcaaacacagtggacagtgcattatggactatttttttaagtctcagtatgatattcttttctttcagaacaagaatgtttcacttacccgtgacgtttctggttggccatattttttcttaaacacaaagggaccctgcagtagacttatgcagatggcagactatttt

SEQ ID NO: 730281 - DNA, 1347 bp, Homo sapiens
ggaccgctgagggggccgacccaactgctgccgcactctcttgaacgcggatagctgaagtcggggtgcacgacttttttggggagcggggacgtgaagtacagcgctagagaggccgcccagagggctgtggagctccggaaggagccttaggagtttgttgtcgtggtagacagactcccccgggagctttctctgactccgaaccctgccttgctctgacttcctgttggagatgatcgattcgagagagggaaagagccgagaacgccctgaatctcaaatcacctcgtttcacccaccggcagcgtcaagcggggttttgtccagtcgtcgagttacgtatatgggaccgattctcatctcttccggggcttaatgttctgtggctggtttctcttttgtctgccctccccggcaaatctctttggtgcctcatgatatatttcactgctgaattttctcaattaccaagtggactgtttaatgtacagcttttacttcccctcctcttccagttatccgaaagaaataatgaatatcgcatcagtcttggaatgtgtattaagactgtaaggtgaaaataagcggcataaaccaggcagtatttacttgctggttaaatgaatgacccccttattttattttgtatatagccagaaccgaaaaactttgaaaaccttcattagtctctacacaaaacacactcggtcaatacatttcataatggttcctctttcaacatagttctccatttgtgcttacttaaactactttgatggacttatcaattatttctcccaaacaaaatgagagattttccaattgggtattatgaccagttaactctttgcttaaggcaccatatctttacccaagattactttataataaatgtattaacgttttggaatcacagacctttctgcatgatttccaatccccagcagaatgtattcaggtaagctctggtctctaagagtcagagttaggaaattgaaagctttttgcagcttttctcagccccgtctttctgcccctacttctcatacacacccttcttgggtcacatggtacctttattctctgttagtcatactcgatagtagcattttataatgtaggggaagaaagtactatgctttctatttcacaagaagattgcacctgccatttaaagttatctgatgggcggtttttaaaagatattgttttcctcagcctttggctttctaacaatgttcttttagcttgaattgtctgccttagagaaagttgcatatttcatttttattttagttttttcttttgaactcaggctaaatctaaactaaataaaatgccttt

SEQ ID NO: 730282 - DNA, 964 bp, Homo sapiens; identical to SEQ ID NO: 232859

SEQ ID NO: 730283 - DNA, 911 bp, Homo sapiens
gtccggggaaacagagggaagcaaacagatccaagaaatgtgttcaagattgattttgcaggacagaaaatgggaggtgtataaagagacttccaagctcctgatctaagcttaggagggaatggccagctactgagatggggaagctgaagtgtgagggagttcaccattgcaagtaagtcgcatttaaaatatacatgaagatgaaagtctatgagagtggtggtcattcatccataaaagtgagagagagggtttctgttcatttccaggtgggtttgtgcccttcgtgatgaccccttggactcacctcaagcagaggtctaaattacttgagagtgtgttcatgtaaattcactagtcagatatgaatgccactcaggcatcacaaaacaatcacagaagacaggagtgagcgcattctcaagaatgttttctgaaatgagcagaagagctttgataccagaagactttgtgttggaatttggctttctattattagaaaacgttatcatccggagtatttaaaagatagatatttggtttagtttcctgagtgactttccaccagctgtaaagcaaactgcatcaagcattgtagaagcctcagttgagatttataacaaaatgagtgttgacctcctgccaacacccgccaagtcccattatgtctttaacttgagggacttatccaaatgtgtgcaaggtagtgtactgaaccctcgttttctgatctgcaccctccctacttttccattggcccccaaatatctcagtaacattgtatgtatgcaggtgttggtgactcacccagaaatcccatcacctgttcctattcaggctgagtgcttcacaactatttcacatggccaacactgcctcccatttctcactcccagctgattacttgt

SEQ ID NO: 730284 - DNA, 910 bp, Homo sapiens; identical to SEQ ID NO: 232858

SEQ ID NO: 730285 - DNA, 532 bp, Homo sapiens
  misc_feature (452)..(452): n is a, c, g, or t
  misc_feature (463)..(463): n is a, c, g, or t
  misc_feature (466)..(466): n is a, c, g, or t
  misc_feature (484)..(484): n is a, c, g, or t
tggagagcaggcagctgctcttgatgaaaacggcagtggctctgaaaagatcctttagatcgaccacttaaaaatataccttaggccctctccccgcggatgcggctgaccaactggatgtccttgggcatgatggtcacgcgcttggcatggatggcgcacagataagatgcaggccacagtctgccagctgcccaaccattcaggcttttcattattataggaagcatctggccaaggaccaccaacatcttcctgtcctgcccctgaagctgtgcctagaggaggtctctcatagatgcccacgttctcttgacaagatatttggggaggacccctggctactgtcactgctgccatgcttgccaggaggaggcaccttcctgacacttcactgctgctgctcagcaggcctgccaagtggttctgctgtgttctaggagaaacagganaaatgcctctnctnccactttgcactgtgctntgtcacctgggcccttaaacaccattgcctgcccctgacgccccaaca

SEQ ID NO: 730286 - DNA, 573 bp, Homo sapiens
  misc_feature (493)..(493): n is a, c, g, or t
  misc_feature (504)..(504): n is a, c, g, or t
  misc_feature (507)..(507): n is a, c, g, or t
  misc_feature (525)..(525): n is a, c, g, or t
tggagagcaggcagctgctcttgatgaaaacggcagtggctctgaaaagatcctttagatcgaccacttaaaaatataccttaggccctctccccgcggatgcggctgaccaactggatgtccttgggcatgatggtcacgcgcttggcatggatggcgcacagataagaaaactgagtctcagagaaattatggcttgtcctggataagatgcaggccacagtctgccagctgcccaaccattcaggcttttcattattataggaagcatctggccaaggaccaccaacatcttcctgtcctgcccctgaagctgtgcctagaggaggtctctcatagatgcccacgttctcttgacaagatatttggggaggacccctggctactgtcactgctgccatgcttgccaggaggaggcaccttcctgacacttcactgctgctgctcagcaggcctgccaagtggttctgctgtgttctaggagaaacagganaaatgcctctnctnccactttgcactgtgctntgtcacctgggcccttaaacaccattgcctgcccctgacgccccaaca

SEQ ID NO: 730287 - DNA, 478 bp, Homo sapiens
attcagatttcactagtttttacatatacaatttttgagagtgtgtatgtagctctttgacattttattgcatgtatagattcctgtaattgccatcacaatcagaatacagagctgatccattaacactaagaaacaatttccttcctcttgagagtcctaccctcctcccagccctaagccctggcaaccacttattggcttttatcacaataattttgttaccctacatatatattttaatgttttttagtatctatttaatttttttcttttttttgagacagtctcactctgtctcaaaaaaaaaaagaataactaggaccacctaatttagactaaggcatgttaaggaagactaaggtatgtcagggaaggcttcttggaagtaggagtgagccaggttacagaaagatagctaagccagagagaagaatatgtttaaaggtacggggtcactggaaacttggataactta

SEQ ID NO: 730288 - DNA, 487 bp, Homo sapiens; identical to SEQ ID NO: 247404

SEQ ID NO: 730289 - DNA, 604 bp, Homo sapiens
actatgcttattacctgggtgatgaaataatctgtacaccaaacccccatgacatgcaatttacctacataacaaatctgtacacataccccgaacctaaaataaaagttaaaaaaaaaatcttacttgatccctcatggaatctcatatcaacaaaggagaggatcttttataataacaaaatcaggtaacacttttataatttcctttatgtctgtacttattgaaatagttgattgtcagaagatagttttctccttgcaatgattagccatacccttgagaaaaactcctaaaagggtataaaacacagtttggatatgtaaggtttgagatatctattaaactttgatgaggaagtatattggaaatcagtacttggagctagagaaaaggatagatctggagataaatatttgggagtcattaatgtatagatgacatttaaattcaaaggactaaatgaactcacctagggagactgaacagataaagagaagagatagagacctccaacattcagaggccagtcaaacagaggaaagtaggcaaaggagaatgagaaagaataggcagagaggtaggaggaaaatcaggaaagtgt

SEQ ID NO: 730290 - DNA, 999 bp, Homo sapiens
aggcagtgctttgagctctaatggatgaacattgctaaccagcgaaggtggagagagggcacccgtctgagaagatgaagaggcagcaaagcacagctggcctcggggaaccggaagccacagggacatcaggctgtgtgctgctgtctgtcggccaccagctgggggactatcctggacctggaagggcatccctgacactccccaccagatgccaggggcacccccagccccaggtgagaaccacggatcccatggcgaatgaggtcagcctgtgggaagtggggctgggactgctctgcacagcttaataggaaagttgggttctatttggtggggttttggtcatgccaatggctggtcagggctgtccgtgaggaactgatttgaggacaagttagagaaggggctgccgaggccagtggggcactcgctgtctgggtctaagaaaaagaaaataaaggctggtgatgtgacagttggtgggagcacagacggaaggaactggcggtggagacacacggttggccctgcacagggctacggtagctacctgggggtcatcctattaattctcctcatggtcccaagaggcggctgtgaggatccctctcctgaggacaaaactgctccagagccacacagaaccaagatccgggccaactccaaagcgggcgatcttgacccctcacccgtggtcctgaggcagggatcggagccccctggacacacagacactcccaccttgctgaagataattcgctttctcatccgtgaaagaataaagtcggactaactcatctccacactcacttccaactctaacaacctgtgttaggaaatcaaaggtaaggactctgaccacaaacccaagaagcaaaacccgagactcacggaacgacgccaccattgcagttcccagcttgactagttgtttttcttttctggtctgttctgctcttttggtttaaataattaaagatccttgttgacaagtaa

SEQ ID NO: 730291 - DNA, 556 bp, Homo sapiens; identical to SEQ ID NO: 460457

SEQ ID NO: 730292 - DNA, 733 bp, Homo sapiens
aaaaacatcctctgaagcctctctaacccagggatcctcctcactcttcccctacccattccccccaccctccgttatactggggccagttatctagtagatactgccaattacccttggcagaggtgccctgctcactaatttcatttgaaggagagccctggaacctggttttaatgtctggcacacgccactccaggatctcccagtttgtgtttctacatctgcaggctgatgctgatttctaaccaccccatgtcaatcattttagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttcccctgctcaccttcatgattgctgccaacttacaactttgccgtccttaaactcatgggccgaggcaccaagttctgatcccccgtagaaatcccccctattctctaaatatgcgagtgctctaaaccacgacaggctcacactgctgcgtctacca

SEQ ID NO: 730293 - DNA, 723 bp, Homo sapiens
  misc_feature (504)..(504): n is a, c, g, or t
  misc_feature (521)..(521): n is a, c, g, or t
  misc_feature (523)..(523): n is a, c, g, or t
  misc_feature (541)..(541): n is a, c, g, or t
  misc_feature (555)..(555): n is a, c, g, or t
  misc_feature (557)..(557): n is a, c, g, or t
  misc_feature (575)..(575): n is a, c, g, or t
  misc_feature (578)..(579): n is a, c, g, or t
  misc_feature (686)..(686): n is a, c, g, or t
  misc_feature (689)..(689): n is a, c, g, or t
gccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttcccctgctcaccttcatgattgctgccaacttacaactttgccgtccttaaactcatgggccgaggcaccaagttctgatcccccgtagaaatcccccttctctaatagcgaggctctaaccacacagnctacaatgctgcgtctncnatcttactctttgccttnccacaactgccctntnttacttgatgagtgaacnggnnaggagagtcttgcagtgattaaggtctctctttggactctcccctcttatgtacctctttagtcattttgcttcatagctggttcctgctagaaatgggaaatgccntangagatgacttcccaactgcaagtcacaaaggaat

SEQ ID NO: 730294 - DNA, 588 bp, Homo sapiens
  misc_feature (369)..(369): n is a, c, g, or t
  misc_feature (386)..(386): n is a, c, g, or t
  misc_feature (388)..(388): n is a, c, g, or t
  misc_feature (406)..(406): n is a, c, g, or t
  misc_feature (420)..(420): n is a, c, g, or t
  misc_feature (422)..(422): n is a, c, g, or t
  misc_feature (440)..(440): n is a, c, g, or t
  misc_feature (443)..(444): n is a, c, g, or t
  misc_feature (551)..(551): n is a, c, g, or t
  misc_feature (554)..(554): n is a, c, g, or t
tttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagctgctcaccttcatgattgctgccaacttacaactttgccgtccttaaactcatgggccgaggcaccaagttctgatcccccgtagaaatcccccttctctaatagcgaggctctaaccacacagnctacaatgctgcgtctncnatcttactctttgccttnccacaactgccctntnttacttgatgagtgaacnggnnaggagagtcttgcagtgattaaggtctctctttggactctcccctcttatgtacctctttagtcattttgcttcatagctggttcctgctagaaatgggaaatgccntangagatgacttcccaactgcaagtcacaaaggaat

SEQ ID NO: 730295 - DNA, 921 bp, Homo sapiens
gtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacgtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttcccctgctcaccttcatgattgctgccaacttacaactttgccgtccttaaactcatgggccgaggcaccaagttctgatcccccgtagaaatcccccctattctctaaatatgcgagtgctctaaaccacgacaggctcacactgctgcgtctacca

SEQ ID NO: 730296 - DNA, 1558 bp, Homo sapiens
gcctgtttcccctttgctttctgccatgattataagtttcctgaggccttcccagccatgcttcccgtacagccttcggaactatggaacgttagcagctggggacctttctgccaccacaaaagcctagattatcctgatggacgatggaagacacatggctgttgttccagctgacatcaagccaaccactggacaagataggaaagctctcctagaacacgaaggcccgaatgaactggcccagagcagagaaactgctcagccaaactgccaagctgtgattaacaaaggcttcatcttaatccaccagattttggggtggtttgttacacagcgaatgctaactgatacagtcattatcattaggtctttcttgagctgatcatacttcccagcatagaatacgccaatgtcctgctccttattcctggctgccagcattgtaagagctgagtggaaggctggggttttcagcactcaatatgcactagacaatccaaaagatctacaaaaactttacatctacaagccaaggcactgaatctcagccccagaaagagactgtgaccttccttcctcatcaggatcccaagaagccgtagaacaagaggctaagaggttcgaaggacactggaaaggcttcatgctgctgtaggttgtggatggacaagctttgtgtctggagctgctgtagtgggccactcagttagttcacccaggctcccacattctccatgctctgtttcaggaaacaaccagaactgtggacagtcttaccaaagacactaacatcatcaccagagaattaaagaaatccagtgagtggcccacaacaattggctggcataggacatgatcctagcttcccacagggcacttgggattgtgcagtcagaagtgattgatgtgcatatgtttccacagacctctctgatgtctatgccgtcaccaaaaatattcagactgcaaaccaggaaatgcattgaattgccaccattgtccttatacttccgtttaaggacactccaggcccaacgtctcaaggccttttaggctagcttccttcaaacctcaaatcttggttgctgtctaatttaacctttaacccttttaccatttgccctgagaacacttgccggcagcacttccagctgcagcgtttacccaaagatacctctgccaggaaagaccttgcttttattattacttttgcatttctctagcatattgacattggaaacaaaagacatcattctatatatagcattctggttttagtggtggtagttccatttacaaaatatagtaattcttgatcactgaaaatgtcagagcctagaaaacggagcattcctatgcgtgatgttaacatcattaaacagttgttggccaaagactcatgtgatgaatccaatttttctaaaataaatagctcagatgattcagatgattctgatattaggtctgtttagaaataaaacttcaaaaacagtttttatattttacttccacattgaaaatcagtcagatttgctttggcctcaaagaatgtgtt

SEQ ID NO: 730297 - DNA, 708 bp, Homo sapiens
tgttctctgactcctcctcctccccgctctttcttgcctgaagatcaagggcttcgctagtgatgtgctcacccttaaccaacatgtacattatgaatctcctgaaagggtgtcgggaacgtgggaaacagctccctctgtccggtgaggactgaagaagtagtatttatacttatgtttttaaaagatgcagaaaaacatgctcctgcttttttccagagcaaagacataaagcaatgggtgtcatagaaacagtactggaatcagagacagattcctacttcgggctctatcacagactagctatgtggcatcttgggctagtatgggatgttcagtgctttatctttatctataactctgcttcattcgttcattcatataaaaaacatatgtggcgaacctagactgttctaggtgctatgctggcttctggggaatgtgaaggtaaaaacatcctaccttgatagagcaaagagtggatgggggggagggctcccacagggtcgataaatccagagataagcaaatttactatgatagtgggatgatatatatgctatgagacaggaggacgtgagtatctacaaaaacaaggaggagtgtctcctaacagggactggagaaccaaggttgcagtcagggaagtttttataagggaagagatgttggatggacaacatagaatgagactctgtttcaaaaaac

SEQ ID NO: 730298 - DNA, 693 bp, Homo sapiens
aggccaaggcaagggtcatgaccagggtccagcctcagtaatgcactcaccccctcaccctggggcactgctgcaggcccaccataagcagcctacattgctcccctcctgccctctcttcccagaaagcccctcacctgtcacttcctgaagaatatggaagccaaggaggtcttcttcaggcattcctctccacccatgcacttcctccctccctgcaagcttcaaaggaattgatttccagagagacccttcccagttgccccacctttccgtcagcctcttccaggaactgtcctctgacatctctctgtctaggtctccttgtcactcttgtgcacaccaagactgttctccccctgtcagccactgagtccactcagatatcttctgcttcccaaaattaaaattacaaaccaaaacagagacagcttccatgaccttacacattgtagacacttggctacagcagtgaatgacataaacaaagtccctttcctcatgtagccctcatgctagtagagtgaaacagataataaataaactagtcaaatgttcagcatgtgagttggtgatgacagcacggtgcttcatgcctgtaatcctagtgctttgggaggccgagatgtgaggatggctaaggtcaggaatttgagaccagtctgggtaacatagtgagaccctgtatctacc

SEQ ID NO: 730299 - DNA, 647 bp, Homo sapiens
aaagaacaccctaacaatgaggcattattaaaggcccacataaaaaacctaatagacaccagctgccctctcttcccagaaagcccctcacctgtcacttcctgaagaatatggaagccaaggaggtcttcttcaggcattcctctccacccatgcacttcctccctccctgcaagcttcaaaggaattgatttccagagagacccttcccagttgccccacctttccgtcagcctcttccaggaactgtcctctgacatctctctgtctaggtctccttgtcactcttgtgcacaccaagactgttctccccctgtcagccactgagtccactcagatatcttctgcttcccaaaattaaaattacaaaccaaaacagagacagcttccatgaccttacacattgtagacacttggctacagcagtgaatgacataaacaaagtccctttcctcatgtagccctcatgctagtagagtgaaacagataataaataaactagtcaaatgttcagcatgtgagttggtgatgacagcacggtgcttcatgcctgtaatcctagtgctttgggaggccgagatgtgaggatggctaaggtcaggaatttgagaccagtctgggtaacatagtgagaccctgtatctacc

SEQ ID NO: 730300 - DNA, 492 bp, Homo sapiens; identical to SEQ ID NO: 497408
  misc_feature (17)..(17): n is a, c, g, or t
  misc_feature (50)..(50): n is a, c, g, or t
  misc_feature (54)..(54): n is a, c, g, or t

SEQ ID NO: 730301 - DNA, 663 bp, Homo sapiens
gatacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgccttactggaagttgaaaggtagttgttgttatgatcggcgctgggtctggatgtgtggtgtttaaaacacgggctgctgggcagttcgctttcgttttcacgtttttgtgggggtagggcgattgctgctttttttctcaccccgcgggggatcctttagtaacgcgccaattatactgtgggtttatgttctccagggtattgtcgtgaaaacgtcacgatctcgtgctttctccaggccaaagccgcgtttttcctgcaagtttggggtgtgtagaggaaaaagccagaactgctttctcttccctggggtatcccagggtcttggtaaccgctggcagaaacgacagaatacgtacggggcgggcaattaatcctggtccagggaagtatccggcttagaggtttaggaaggacctgtcggggttgagttccccacccagggggagatcgagtccgcgggagctgctgatcccacccaggcagctgctgggctt

SEQ ID NO: 730302 - DNA, 639 bp, Homo sapiens; identical to SEQ ID NO: 216989

SEQ ID NO: 730303 - DNA, 1719 bp, Homo sapiens; identical to SEQ ID NO: 398250

SEQ ID NO: 730304 - DNA, 273 bp, Homo sapiens
gagcacgaggcgtgagtcactgtgcccagcctgttgtatttatttttctagattacagttaattttgttttcatttcttgaaacctagtagaatatgtatctgcctataattcaagggcaattgaaagaaagaaaaataactcaaggccaggcatggtggctcacatctgttatcccagaactttgggaggctgaggcaggaggatcatttgagcccaggagttcaagaccagcgtgggcaacataatgagactctgatgctacaaaaaactt

SEQ ID NO: 730305 - DNA, 403 bp, Homo sapiens
cacgagaatggactaaaagccccaattaaaaagcaacaatgatcggattaggtttataaagctctactgagttacatgttgcctatgagaaacccaatttaggccagatgtggtggctcacacctgtaatttcagcactttgggaggctgaggcagcaggatcacttaaccccaggagtttgagaccagcctgggcaacatggtgaaaccccgtcactacaaaaaaataaaaataaaaaattagccaggcatggtggcagtgcacctgtggtctcagctgcccactactcaggaggctcaggtgggaggatcacttgagcccaggaggttgaggctaccatgaacagtgtttgtgcccctgtaccccagcctgggcaacagagtgagactctgtctcaggacc

SEQ ID NO: 730306 - DNA, 511 bp, Homo sapiens
gcacgagtagtgttagagttctgttgccaggcataaacatatgctcagatgatcagaacattgctgacttaaagttttatgaatttatttgctggttaatatttcttatattttacatggtacaaaatgacttttcttctttctgaataatatctgacaatgtagttcaacagattttgcaggtgaaatactccttgaaatagtgaagtctattgtgtgcctaccttataacgttttctggcactgtacttgtgtgaacaacatgaggataaattcagatgcaaaaagtcaagcgttctgtattctcaggttaggaagggtgcgggggtggagatattcacttgttcagcattaaggctgaagaagaccttggcatctgtagatcctagggagctgctaagttcaacttaaagaatatttcctttaacaaaggcaaatcattaaaggcatagagacgaacaacaagacagctttgtcagctttgctacaggccttaatgtcgtttgaacag

SEQ ID NO: 730307 - DNA, 534 bp, Homo sapiens
ctcagaagcgaggcagccgtgaggcggaggacaggctgggtggatcccaaagggtgcgctccagcccccaacccaggcactgggactctggtggcaccctgggtggcaggcaagccttgaaatcaagtgcacgagccttggaaaggaggaccgggagagttatggcatttatgaatgaagaagagaaagagaatcactcggatgggaaaagttaactggattgttcccacctgcatggatcaccgggatgaagctgtgccaccctgtaggaattagaagaccatgtccaggaattgagcactgggtgcaggatccagtcttctgaggccctgaaaccacatgtggtcctaatatgctatttagaaaatacaaagtggaaagaagaaaaatgaaagtcacgcatcgtccttcaacccggggacaactcctgctaacactcggatggatgaatttcacatatacatataaatattctcatctacagtcaaatttaataatgtgaatgccttaataaaccactaattcttcaatttc

SEQ ID NO: 730308 - DNA, 839 bp, Homo sapiens
ctcagaagcgaggcagccgtgaggcggaggacaggctgggtggatcccaaagggtgcgctccagcccccaacccaggcactgggactctggtggcaccctgggtggcaggcaagccttgaaatcaagtgcacgagccttggaaaggaggaccgggagagttatggcatttatgaatgaagaagagaaagagaatcactcggatgggaaaagttaactggattgttcccacctgcatggatcaccgggatgaagctgtgccaccctgtaggaattagaagaccatgtccaggaattgagcactgggtgcaggatccagtcttctgaggccctgaaaccacatggtgagaagttgaaggtcacacagctgaagcaacttagccgtctcgccttgcggcctggaacccctggcaatttccggagcaccggcaagagacttttgcacagtttctgcttggagtctaccgactgtctgtctcagaggtctggacagctgcttgttacatttggctcacgctagcttaaaaaaggaatttatggaccttactgcagaacgtcccaattcttcaggccaaggtgcctgtgttcctgctcggtttctggattgcttggtacttaaatgaaacatcttattaatcatttcccgggaatgctgtgcaggcaaaaggaaaacaaaggcattcaggagccacagaaaagtgtactggctcctgtcctggatcaactcagaaaatgaaacacatcggattctgtccaggccgggcacagcaacctggcccatccatgtggagcctgcagtgaccacttccgctgtctgcacaaaactggagggaggctgggg

SEQ ID NO: 730309 - DNA, 494 bp, Homo sapiens
gagatgcaacccaaaggagtaaggcagtgccgggagcggcagaagcggagcgggggcgagggcaaggtagccgcggccacgctggctgcggcatggagacacgggaggaacgggacccgcgggcggcacgggaaagggctgcggctcagaccactgcggcgggacgggcggatcagcggggatctaagtctcctgaggcaagggcgccccgaccgcagcgactcctgacacacccaggccgcaggacgaagcgctaccgcctggggctgccagctcccgcctcccgcccgcagagcccgggccccacgtagaggatccggcgccgccgacactcgcacactcaccgcgcgcgcgccacccttgcgcggcagcccgccgccctcggcgcgacctccgccccaccccgcgcgccgcggcgcctgggctacgtcacgggcgcgtgcgctctccgcgcgccgtcagcggcgcgggtggggcattgccagctcggcgtc

SEQ ID NO: 730310 - DNA, 831 bp, Homo sapiens; identical to SEQ ID NO: 229710

SEQ ID NO: 730311 - DNA, 1549 bp, Homo sapiens
tgaggactaaagttgtaggtcacacttttgttagctctttaaccctgagcaagttagttaagttttgtctcaaaaccttaagaattctctggctccttagggtgggtgtgagggtggactggaacagcagcagcctgcagtgagggagctggctacacttcagggcgtggggccatttccctcggttttgaagctttgctttagaggttaaccagttgcccaggtaaaaaccaaagttcaggttttcttggtgatgtatatcatgattctgtcaaactcagcagcctgtgtttattgatgaggttgcaatggggtcagaatctatcctagagaatgaaattttgttgtatgcgacaacatggatgaaccttacaaacagtatgctcagtgcaataagacagatacagaacaaatattgtacgattccacttatctgaggcacctagaagaggcagatgcatacaggcagaaagtagcaaaagctgtcagatgctgggggaaggaggagtattgtttaatgggtacagagttgttggggatgatgaaatgttttggatatggatggtggtgatggttacacaacattgtgaatgtatgtaatgtcattgaattgtgtacttacaagtggttaaatgataaatattatgtatattttagccacaataaaagaaaaatgaaggaaaaaaatgcattttaaagaaccgctagggctatgcatggtggttcacgcctgtaatcccagtgctttgagaggcttaggcaggagtactgcttgaggccaggagattgagatctgtctgggcaatatagccagacaccacctctaccaaaacaaaaaaaaaagtattttaaattagcctagtgtggcacattcctatagtcccagctgttctagaggctaaggagggaggctcactcctcccaggagatcgaggctgtagtgtgctacagttaacaccactgtaacccagcctggataacaagtccagcccaggtaacagtgtgtatggtgtgtttattggaaggcaaaattactatttttcatcttttatctataaggcttattcatttttataaccattttgatcaaatctcaaattggatgcatttaacagttaagaatgcagttcaggccgggcatggtggctcacgcctgtaatcccagcactttgggaggcagaggcgggtggatcacaaggtcaggagttcgagaccagcctggccaatgtggtgaaaccctgtctctactaaaaatacaaaaattagccgggtgtggtgacgcgtgcctgtagtcccagctactcgggaggctgaggcaggagaatggcgtgaacctgggaggcggtgcttgcagtgagcgtagatggtgccactgtactccagcctgggcgacagagcaagactctgtctcaaaaaaaaagaaaaaaaaaagaacgcagttcaaccacagtattattcctaaaagggaaaaatgtcctttattatatcatttccaggaatgcactataataaaaactaagttgcgtgttaaaaaaaaatgtgtcctggg

SEQ ID NO: 730312 - DNA, 779 bp, Homo sapiens
  misc_feature (178)..(178): n is a, c, g, or t
  misc_feature (181)..(181): n is a, c, g, or t
  misc_feature (578)..(578): n is a, c, g, or t
ggggtgggcccccatacccccaggggcaagagatccttgcattgtaaggtggcgcattggcaataccaaacccggcaacttgctgggcaagcgccccagcatagtaccccagggagatgaaacctttgggggggattccctcaggccccattaggccccccagtgtataccccaggangtnacacccatgccaagatcagggtgcaacccatcttggaaggcgagaagccattatcatccatgaagttcacgccagggtcctgtacactgacggcctacaagctgaccccccgtggctacgaatggggccgccagaacacagacaagggcaaccaccccaaagggctacctgccttcacactatgagagggggcagatgctgctgtcggaccgtttccttggctttttcatggtccctgcccagtcctcgtggaactacaacttcatgggtgttcggcatgacccccacatgaaatatgagctacagctggcgaaccccaaaaagttttaccccgaggtgcacaggccctctcacttcctcaactttgctttcctgcaggagggggaggtttactctncggatcgggaggacctgtatgcctggcccgtttccctgcctcctgcttcagcctcccgaggccgaagcctcagcccctccagacaggccgctgacattcagcagtttggcctctttccctctgtttgggcttgtgttgttgacctcctgatggcttgtcatcctgaataaaaaataataataaattttgtataaataggga

SEQ ID NO: 730313 - DNA, 534 bp, Homo sapiens
cgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggagctagaggcccaccttgaggctgaggagggtgcgcggcagaagctgcagctggagaaggtgacgacagaggcaaaaatg

SEQ ID NO: 730314 - DNA, 1643 bp, Homo sapiens
  misc_feature (276)..(276): n is a, c, g, or t
  misc_feature (322)..(322): n is a, c, g, or t
  misc_feature (1014)..(1014): n is a, c, g, or t
cccagccgtcttggcgttgtcctctccaacccccgccgctccgcgtagaacgccgctctcaggctgccgtcaagctcccgcggcactctcctaggtggcccgacgagacccagagtgacccgcgggacgcctgtatcgaccgcgtcctcttcccaccagcgtgggattcggttgaacgtggagtccccagcaatcttcagtctctcaccagggccagggactcgtctggggcgcgggggaaagaagcgtggcggggctgtagatgccgcgtgagtnggatgcagattgcaccgctggagcgcttgacaaccaaccgagcgtnggcttagtttgttttcccgcacagcaagctctctgtctttcagaggaaggtaaaggtggtgaaagctctaaactaaaattgtatcgaaatggctgcagaaatcgactttctgagagagcaaaatcgaagactaaatgaagattttaggcggtatcaaatggaaagtttttccaaatattcatctgtacagaaagctgtctgccaaggagaaggagacgacacatttgaaaacctagtatttgaccaaagctttttagctcctcttgttactgagtatgataaacacctaggagaactaaatgggcagctgaaatattaccaggcataacgaggaccttggaaaagttcacctttcaaaccaaatttatagttagaatttgctattctgatctcctagaccaagcttccttgatcttctcggttgaaagagagagaaaaaggctggcagaactgcctgttccacctggcccttgcgaaagtgtactccaggataagcttctctcctttagcctaggaagcacaatcaagactaatacacaatcatgaattagttaccgttttaagtgagattttgcatgcttttacatgtaaattcagggtttgtgtgtgtgtgtgtgtgtgtgtgtgtgtgcgcgcgcgcacactctccatttgctcattcacacttactgagagttgactacttatttttngctattttgcttttactcatattttgcgccaactttaaagtgctttcttttcttttgaaatcctaacatctttttactccttcagagaacgttaatcagaccttcatttaattccctttctggtgtgcattatattctgccttgtattttagttaggattttttttaaccatctttcctactatttttcaatgagcatgtctgtttaccttagcgccttgtatggtacggagagtttagatagttaatgaaggtggtgaatcagaaactgaatgaatgactgctaaaaaagacctccattttcttctttactgttagcattttaccttttgaaatactagaaaaatatacatacttatatgggcttcacctaaactgaggtgaattaactaagatatacattcaagatacaggaaccatctggtatttgttatagtgacatactccagaatatctttcatctgtttttcacaactacaagtcataggaattacatttataaacatttctcaccatgttacataaaatatttctattttatttatattctacttaaaatgaatgttttattgtgttctgtttattagtaaattatccatattaattatccctttgttataaataaagaat

SEQ ID NO: 730315 - DNA, 1570 bp, Homo sapiens
  misc_feature (276)..(276): n is a, c, g, or t
  misc_feature (322)..(322): n is a, c, g, or t
  misc_feature (941)..(941): n is a, c, g, or t
cccagccgtcttggcgttgtcctctccaacccccgccgctccgcgtagaacgccgctctcaggctgccgtcaagctcccgcggcactctcctaggtggcccgacgagacccagagtgacccgcgggacgcctgtatcgaccgcgtcctcttcccaccagcgtgggattcggttgaacgtggagtccccagcaatcttcagtctctcaccagggccagggactcgtctggggcgcgggggaaagaagcgtggcggggctgtagatgccgcgtgagtnggatgcagattgcaccgctggagcgcttgacaaccaaccgagcgtnggcttagtttgttttcccgcacagcaagctctctgtctttcagaggaagatcgaagactaaatgaagattttaggcggtatcaaatggaaagtttttccaaatattcatctgtacagaaagctgtctgccaaggagaaggagacgacacatttgaaaacctagtatttgaccaaagctttttagctcctcttgttactgagtatgataaacacctaggagaactaaatgggcagctgaaatattaccaggcataacgaggaccttggaaaagttcacctttcaaaccaaatttatagttagaatttgctattctgatctcctagaccaagcttccttgatcttctcggttgaaagagagagaaaaaggctggcagaactgcctgttccacctggcccttgcgaaagtgtactccaggataagcttctctcctttagcctaggaagcacaatcaagactaatacacaatcatgaattagttaccgttttaagtgagattttgcatgcttttacatgtaaattcagggtttgtgtgtgtgtgtgtgtgtgtgtgtgtgtgcgcgcgcgcacactctccatttgctcattcacacttactgagagttgactacttatttttngctattttgcttttactcatattttgcgccaactttaaagtgctttcttttcttttgaaatcctaacatctttttactccttcagagaacgttaatcagaccttcatttaattccctttctggtgtgcattatattctgccttgtattttagttaggattttttttaaccatctttcctactatttttcaatgagcatgtctgtttaccttagcgccttgtatggtacggagagtttagatagttaatgaaggtggtgaatcagaaactgaatgaatgactgctaaaaaagacctccattttcttctttactgttagcattttaccttttgaaatactagaaaaatatacatacttatatgggcttcacctaaactgaggtgaattaactaagatatacattcaagatacaggaaccatctggtatttgttatagtgacatactccagaatatctttcatctgtttttcacaactacaagtcataggaattacatttataaacatttctcaccatgttacataaaatatttctattttatttatattctacttaaaatgaatgttttattgtgttctgtttattagtaaattatccatattaattatccctttgttataaataaagaat

SEQ ID NO: 730316 - DNA, 888 bp, Homo sapiens
agaatgcacgatgtccgtgattgtaccactgcactccagcctgggtgagaccctgtctcaaagaaaaaaaacaaaaaaggtagcttttgtggaatgtgaattatatctcaattttaaataaaggttatgcccatctattgacacaaaatgatgtccctgagattttattcaatgaaaaaagaacagccttgataaaaccacacgtatagaaaaaagtgggcaacatggcctgaactctccccaggcacccccaacagaaaacgcagtctgggagcctgcagcctcagatgaagggctgggttgaggccccagacctgcagagggcggctctgggctgcctggcttcaccctctgcagagaaacctgaaatctctagcctgtagaggagcttctccctgcttttctccactgctagaccctcatgctcagggccagggcccagagtgggaatgagagaggtggggtgatgacagcctcaggatactccgctcaagctggccttggttctagctcccaagctgcagccacctcttagggggttcctgctgcctggacgcctctccctgtcactcaatgtcacgtcctcagagaagccctccctgaccccagtctcattcaggccccgtcatctgccctcccagatttcagcatgtgtcactgcagatctcaggacgtgtacagggttccagctcataagggtacacatttggggaccaagtttcccctctcttgctgtcctccaactttccaggaaccagtccctgagctcctcctgcaggacgaggccccacacattgcttctgatcacagccatcctttccccgctcacttttctcactttatctccccaaaccgggacagtcaagaaccacagaggaccgaagtgca

SEQ ID NO: 730317 - DNA, 963 bp, Homo sapiens
gagatggagtctcactctgtcgcccaggctggagtgaagtggctcgatcttggctctctgcaacctccacctcccaggttcaagtgattctcctgcctgagcctcctgagtagctgggagtacaggtgcccgccaccacacctggctgatttttgtagcttttgtggaatgtgaattatatctcaattttaaataaaggttatgcccatctattgacacaaaatgatgtccctgagattttattcaatgaaaaaagaacagccttgataaaaccacacgtatagaaaaaagtgggcaacatggcctgaactctccccaggcacccccaacagaaaacgcagtctgggagcctgcagcctcagatgaagggctgggttgaggccccagacctgcagagggcggctctgggctgcctggcttcaccctctgcagagaaacctgaaatctctagcctgtagaggagcttctccctgcttttctccactgctagaccctcatgctcagggccagggcccagagtgggaatgagagaggtggggtgatgacagcctcaggatactccgctcaagctggccttggttctagctcccaagctgcagccacctcttagggggttcctgctgcctggacgcctctccctgtcactcaatgtcacgtcctcagagaagccctccctgaccccagtctcattcaggccccgtcatctgccctcccagatttcagcatgtgtcactgcagatctcaggacgtgtacagggttccagctcataagggtacacatttggggaccaagtttcccctctcttgctgtcctccaactttccaggaaccagtccctgagctcctcctgcaggacgaggccccacacattgcttctgatcacagccatcctttccccgctcacttttctcactttatctccccaaaccgggacagtcaagaaccacagaggaccgaagtgca

SEQ ID NO: 730318 - DNA, 557 bp, Homo sapiens
tcaagctgcagctccggggcacatcccgctgcgctcccacgacggccccgcggatggcaaagtcagcggcatcgcctatgcaggcaatcaaaggatgttgatggataagtgtttcaggcagaataatggccctcaaagatgttgacaccagaatcttcagaacctttgcatatgttacctaacatgacaaaagggactttgctgatgtgattaaggttaagaactttgagaagggaagattatcctggattatacaggtcgacgtttatttctttctgaactttcctggaggatcatcggccatactccagcagaagggtggatttgaaaaaataacgtttccacggcaacagtggcagcaattcaaaggaagacgttggagaattcacatgctattttagctggctctgtgattgcaatcacacaaatcattacattccagcgagatcccatcaacagaaggtttttccatttcagtctgtcaagtttttcaggcatgaatactgtaagcaagaagagaaaagttacaataaattgacatttatagtaaaaaaaaa

SEQ ID NO: 730319 - DNA, 460 bp, Homo sapiens
gcatcgcctatgcaggcaatcaaaggatgttgatggataagtgtttcaggcagaataatggccctcaaagatgttgacaccagaatcttcagaacctttgcatatgttacctaacatgacaaaagggactttgctgatgtgattaaggttaagaactttgagaagggaagattatcctggattatacaggtcgacgtttatttctttctgaactttcctggaggatcatcggccatactccagcagaagggtggatttgaaaaaataacaaggaagacgttggagaattcacatgctattttagctggctctgtgattgcaatcacacaaatcattacattccagcgagatcccatcaacagaaggtttttccatttcagtctgtcaagtttttcaggcatgaatactgtaagcaagaagagaaaagttacaataaattgacatttatagtaaaaaaaaa

SEQ ID NO: 730320 - DNA, 420 bp, Homo sapiens
tgtctcctgcctgcccctgggaactgaacgtcttggtataaaacccgattgtacatttgttcaattctgagataggagaaaaaccgccctatggtgggaggtgagacatgttggcagcaatgctgccttgttattctttactccgctgagatgtttgggtggagagaaacataaatctggcctacgtgcccatccaggcatagtactttcccttgaacttaattatgatatagattcttttgctcacatggttttttgctgaccttctccttattatcaccctgctctcctactacattcctttctgctgaaatcatgaaaataataatcaataaaaactgagggaactcagagaccggtgccggtgcaggtccttggtgtaccgagtgccgctctcctgggcccaatgatgtttataaa

SEQ ID NO: 730321 - DNA, 715 bp, Homo sapiens
  misc_feature (685)..(685): n is a, c, g, or t
aggcaggggcggcctctctgacgagaaggaggccactgggctgaggccaatgaatgggaaagagccagccacatggtgagctgggagagggcatcccaggcagtgcaaccagcgcttgcaaaggccctggggctggacagttcttggcggagtctgagggcttgagtctgggggagcctggctgcccagaggtggcagatgacatgaagaaataaccatgtaagggctggctgtgtatgagagcaagcattgggaaggatgaatgccaactatgttccaggaacttccactgttctcacacacccaggtgagtggtgttcaggtgggtggcacccaggtgagtgacatcccagttgagtggcacccaggtgagtagcatccaggtgagtgacacctaggtgagtgacattcaggttagtggcgtctgtgtgagtggcatcatccaggtgagtagcttccaggtgagtggcacccaggtgagtggcattcgggtgagtggcattatccaggtgacacctgggtgagtggcatccaggtgagtgatatcatccaggtaagtggcacctaggtgacatccaggtgagtgacgacatccaggtgagtgacatcatccaggtaaatggcacccaggtgagtagcattcaggtgagtgacacccaggcgagtggcatccacgtgactagcntgtccaggtgcataacacccaggtgagtga

SEQ ID NO: 730322 - DNA, 430 bp, Homo sapiens
aggcaggggcggcctctctgacgagaaggaggccactgggctgaggccaatgaatgggaaagagccagccacatggtgagctgggagagggcatcccaggcagtgcaaccagcgcttgcaaaggccctggggctggacagttcttggcggagtctgaggtacaggatgatccctggatgagcgcctgagtgcacgaagcatgggtggagagggtcagctcccagcgtggctgcaggagggggtcgtgtaatgaatactaagtgccagttctgcaggatggaaacagttttgaaattggacggtggcgatggtggtgcgataatgcgaatggacccaatgccactgaaatattcactttaaaaaagttaaaatggcaaggtttacattaactagactttgccataataaaaggaaaaggaaaaaatataaa

SEQ ID NO: 730323 - DNA, 1716 bp, Homo sapiens; identical to SEQ ID NO: 245489

SEQ ID NO: 730324 - DNA, 1102 bp, Homo sapiens
tgagacaaagtctcgctctgttgcccaggctggagtgcagtggcgcgatctctgctccctgcaagctccacctcccgggttcacgccattctcctgccccagcctcccgggtagctgggactacaggtgcacaccaccacacctggcctatttttttgtatttttagtagagtcggggtatcaccatgttcgccaggatggtctcaatctcctgacctcatgatccacccgcctcagcctcccaaagtgctgggattacaggcgtgaggcactacgcccagcctcatgctgtttcaaaattgtacttaagtgtggttcagtctgaacattcctttgtacaaatgtggaaacacggggctgtagatgctgttaactactgaaggcaaaagtgtgacttcatggtataggtgtgattgattaaattattggctattggtgaccagctcaatcttcagtccctctccactctgggaaaattggagggtggggctgaaaccctctaatcctgccttggccctgtgactagccctaccctgaagtttcgtaggggctgcccatcactggagccaggaaatgggaggcaggccagatatgtattttgcaatccacaactatagacttctaacttcctgaaatgttcatggactgaatcaactctcctgtccacttcatgctgtacaccagcagtgagccctgggcctcaagggtgtgggagaatgtctgccttctaaacagaatcattttcaattgctgtgcctgtgaaaatctgcctgccttttatgctttccctgtctcttctcttgtcatttaggcttctcctgttatcagggcctgtaagaagcaccacccttcccagtctgttggctgacaaccggctgcaagcccttgttaccactgtgtgagaaccaggaaaccaggattagtcaaggactttatggcttatcagccagcctcactgtctccccatccctgtaggtggctgagtgacaggaccctgggggaggacctgagagcctcctgggaacaaagagcatccaggacatgtctgtcaagtcgctaacaaggtcatctgacccacctgagaatgtgaaactacctatct

SEQ ID NO: 730325 - DNA, 591 bp, Homo sapiens
tttgagacaaagtctcgctctgttgcccaggctggagtgcagtggcgcgatctctgctccctgcaagctccacctcccgggttcacgccattctcctgccccagcctcccgggtagctgggactacaggtgcacaccaccacacctggcctatttttttgtatttttagtagagtcggggtatcaccatgttcgccaggatggtctcaatctcctgacctcatgatccacccgcctcagcctcccaaagtgctgggattacaggcgtgaggcactacgcccagcctcatgctgtttcaaaattgtacttaagtgtggttcagtctgaacattcctttgtacaaatgtggaaacacggggctgtagatgctgttaactactgaaggcaaaagtgtgacttcatggtataggtgtgattgattaaattattggctattggtgaccagctcaatcttcagtccctctccactctgggaaaattggagggtggggctgaaaccctctaatcctgccttggccctgtgactagccctaccctgaagtttcgtaggggctgcccatcactggtcaactcattagggtacaaaaagac

SEQ ID NO: 730326 - DNA, 435 bp, Homo sapiens
cagcaggatggacctgcccagtttggaacacatgatgaaagctccaccccaggaggctctggagccttccacagagcccctcctgaccactgtggaggagcgagagccagaaaatcacgcagagaccctgccagagaaaccacgcgaagccagagcaccactgaaatcttggagtcaggaagacaagaacttcgctcaatcttactttgacttcagcaagccggggatcaagagggccaccatcaaagggcaaatccagcttctccagccaccagccacgtcccctctgctgcagggaagcaaggaagactcagtgccgccaggaaaagagaaagagaatccattattggtgaaaatccattttaagctgtcagcccccacaatcccagagaaatgactagacagaaccaataaagcctccagtgctggcaaaag

SEQ ID NO: 730327 - DNA, 456 bp, Homo sapiens
cactggcattaggcggctttccaccctgggggtcgggcctcaccaaggttgggaatgctcaggctggggtctgccctgttgaaagcctgttggccccaaccctggggtccaggacacttttcttgaggggagaatgagggtgcagggctctccagtacaccttgctttctggtagtgaatggacacagaatgtaatctcagctgcccagacgcgggcagcagcagaagaccccttacccccagcgacctcttcagaggggcctctgggctcacccctctccttcaaccaccctctggggcccaagtgacactctctcttttgtgttgcagctcagtgccgccaggaaaagagaaagagaatccattattggtgaaaatccattttaagctgtcagcccccacaatcccagagaaatgactagacagaaccaataaagcctccagtgctggcaaaag

SEQ ID NO: 730328 - DNA, 526 bp, Homo sapiens
cggcctcccaactaaatttacttttaaaatgggatattcatcacctgagtattgtcaggcttgttactcttatctctgtttacagatcacttataagtcaaaggtattgtgtaagaacaaagtggtattttaaatgacaaaagggctttcatccttagtgcagccttatataattgagcacagtgattctgtctttggtcatctgtaatccacacaggtggatggttttatagattgatgtgtaatttgtgggggttatagaaacgattatattcatatagcaaagtctatatgtattatttgtagttcagagctaggaaaactcaatgcagtccttcctgatcttgactcaggaaatcagtagttccaaggatgattcagtcttgtctagttccacaaatggaaggagggtgtctgcataaaaagataaggggaatcagtcaggaagcccattttgaatagcttcatgaatcccttaaattgttgctcacttcagcagaactcattaaagctatcacaattttta

SEQ ID NO: 730329 - DNA, 472 bp, Homo sapiens
cggcctcccaactaaatttacttttaaaatgggatattcatcacctgagtattgtcaggcttgttactcttatctctgtttacagatcacttataagtcaaaggtattgtgtaagaacaaagtggtattttaaatgacaaaagggctttcatccttagtgcagccttatataattgagcacagtgattctgtctttggtcatctgtaatccacacaggtggatggttttatagattgatgtgtaatttgtgggggttatagaaacgattatattcatatagcaaagtctatatgtattatttgtagttcagagctaggatgattcagtcttgtctagttccacaaatggaaggagggtgtctgcataaaaagataaggggaatcagtcaggaagcccattttgaatagcttcatgaatcccttaaattgttgctcacttcagcagaactcattaaagctatcacaattttta

SEQ ID NO: 730330 - DNA, 1169 bp, Homo sapiens
ttgtgtaatatttatggcttaaaatggactaaaggtcctgttcttgccttgtctgaacttgccgcttttgcattctttgagttcagtttaaagacagttactttaagcccattttaaaccctcaggctagaaatcgtaccactgttaattagccacattatttggtctaacagtttatcattctgaaactgagcttacctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactatgacaataactatgacaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctgtagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgctgctgtgatgctactataatgta

SEQ ID NO: 730331 - DNA, 440 bp, Homo sapiens
gttatatctaatgacttgatcagatgcaggtgcaagttaaattttatgaggaggaacacctgggtcatgttgaatttggttgcttaataggaaatgcttctgtttgatactaagcggaggtcaccgactactagagaggcaggaggtattttcctagctggaatttaatgagggtccaggatgagttttctgatagagtcctctgccctttctctttcctcacattttccctcttctgggtgtgtgccaaaacaagtgggatgggaatggtcttcttacatgagcttgccagtctggaggccccctcagtcttctgcagcccacgtgtctccctccacctgcactgcaaggtccacctgcactgaagcgggatgatgcccacttcagatccttgtttccagctgttcaggtggcagagatttcaaaagaaaaagaaaaaa

SEQ ID NO: 730332 - DNA, 100 bp, Homo sapiens; identical to SEQ ID NO: 554332
  misc_feature (85)..(87): n is a, c, g, or t

SEQ ID NO: 730333 - DNA, 415 bp, Homo sapiens
  misc_feature (142)..(142): n is a, c, g, or t
  misc_feature (149)..(149): n is a, c, g, or t
  misc_feature (156)..(156): n is a, c, g, or t
  misc_feature (201)..(202): n is a, c, g, or t
  misc_feature (226)..(227): n is a, c, g, or t
  misc_feature (241)..(241): n is a, c, g, or t
  misc_feature (243)..(243): n is a, c, g, or t
  misc_feature (245)..(245): n is a, c, g, or t
  misc_feature (249)..(249): n is a, c, g, or t
  misc_feature (257)..(258): n is a, c, g, or t
  misc_feature (263)..(263): n is a, c, g, or t
  misc_feature (296)..(296): n is a, c, g, or t
  misc_feature (299)..(299): n is a, c, g, or t
  misc_feature (400)..(402): n is a, c, g, or t
ggtcaaaggtagatatcaagccaagagggttagggaggtggggtacatttctctgagcagtcagggtgggaaaaaagaatgcaagagtggactgaatgtgcctaatggagaagacccacgtggtaggggatgaggggcttcntgggtcntgttccntaccccatttgtggtcacagccatgaagtcaccgggatgaaccannccttccagtggctcgctccctganntttgcctcccctcncnanatcnccttcccnnacacntccctccccacacctcccactcccctgggcatnttntggcttgactggatggaaggagacttaggaacctaccagttggccatgatgtcttttcttctttttcttttttttaacaaaacagaacaaaaccaaaaaannnccagaaaaaaaaa

SEQ ID NO: 730334 - DNA, 348 bp, Homo sapiens
gtaagagccgcggagggagcgagcgagccggctagaggccagcgccgccgccgccgccgcctccgagccgggcagcaacagccccggcagcggcgcaggctccagcgcgccgggcccggccggccgcagcccccgacgcctgggtgcgcctgcctgccggcctccgcaccgtccgccgccgctcccggggctgttgtgtctgcgactgctcccggccggaggtgcagggagctcagccgagccgccgctgccatcccggagcgagcaagcgagcgagcgcgcgggagggaggaaggcggcggcggaggaggaggaggagcgggaggagcgcgggcgggggcgggggcc

SEQ ID NO: 730335 - DNA, 481 bp, Homo sapiens
ttagcaacctgagcgccccgcccaggtgccttactattggtctcgtggagcgggatgggcagctctgccgtgcaatcccagctcgcagcccttgccccgcgtgtactcacgggaggactcgcagacgttactgccctcttgcgtgccccggccacccccgggcggcttgtagccggtgcgcggggtggctggggctacgtgcagagctgtcgcggagccggaacagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacggtgagagcgcaacttagttggcggagttgggggaagttttgtgatttgaggaggggtcggggtgcggagcgcgg

SEQ ID NO: 730336 - DNA, 846 bp, Homo sapiens
ttagcaacctgagcgccccgcccaggtgccttactattggtctcgtggagcgggatgggcagctctgccgtgcaatcccagctcgcagcccttgccccgcgtgtactcacgggaggactcgcagacgttactgccctcttgcgtgccccggccacccccgggcggcttgtagccggtgcgcggggtggctggggctacgtgcagagctgtcgcggagccggaacagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacgaatgggacaacagaagaagtgacttcaaaagaagacgaagaggaagagatggatgaagatatagaagacttagatcactatgagatgaaagaagagcctattagtgagaagaagttggaggatgaaggaactgaaaaagaaaattgggcaatattagagaaaattaggaagactgaaaggcaaggccatttaaatgtgttgaccctgatagtcctttgcacagtgatctttagatcttaaaaagaagcgataggagacattttgcttatctttcaagtgttcctgacagcatctcagaggatggtgtcctctggcttactctctgggaaatgctgctctgttggaaatccggagttctgagtgatccccatgcgttttctgctgcagagcaggacatgctgaagtgattccttcgtgagcagatgttagaggtctccct

SEQ ID NO: 730337 - DNA, 686 bp, Homo sapiens
aaaggagattatattcccatttggtggactctgttatacttcctttgaagtagggaggagagaggattggggattgttgagtactttctgttctccccaattttttttgttagtaatccacatttatttgagtaattcatactgtagggtgtccagtttttagacacttctatatttatatgtatcatttgatcctcacattagccttgggttttagaaacaattatccacattttacaaatacaaagactgttgctcaggaggttttgtaggtaggtcaaggagctaggaagtggcagtgctgagatttgtgctcatgtctctgactgcaagctcagagctcttacagagcaccatgccagctttattccccctgtcgtccttgggacagctttgccaattggggccatagtctggtttaactccctgctttgtctaactatttatttggatttcgggggacgtggaaattttctttgacaatcttgattttttgtgtggtgtttggtgaattttttttattactatactttaagttctagggtacatgtgcacaatgtgcaggtttgttgcataggttttcatgtgccttgttggtttggtgtgcccttaactcgtcatttacattaggtatttctcctaatgctatccctcccccagccccacacctcatgataggccctggt

SEQ ID NO: 730338 - DNA, 176 bp, Homo sapiens
  misc_feature (18)..(18): n is a, c, g, or t
  misc_feature (31)..(31): n is a, c, g, or t
  misc_feature (33)..(33): n is a, c, g, or t
  misc_feature (36)..(36): n is a, c, g, or t
ctaggtgactctgagganccccatacagcananagnggcctgcacactgtgcttggtgagttcacaaatctgttgtaacctgtagcttccctgtcacttctctggctctcctctcctgctaagctttgtttcctaattaaaatcttctgccactgccatagctactggtgctactg

SEQ ID NO: 730339 - DNA, 1152 bp, Homo sapiens
caggcaggagtgtgctgctgagacgctaaaggggtcacctccctatccgcacacagtgtatggggtgttaggcctgagcagatgaaaggaagaaagggatcctcaaggagaacccgttggcagtgagcgagccccacataccaaacttgaggccccaggctttagccaaccaatgacccagggtcagtctggtctcccaggggagggtgggccagggatcagcactgtggcttccagtggccccacagatgcccttagctgcagtcccagcatgcctatatatggcaaagccagggacatgcatgccagggcttccgtacagccccttgcttaactcttgggctttgtgagtcactcagacctaggcttaaatcccaagatggccatttactgctctgtgatattggacaagttattcagtctccctgagcaagttcccctccctctaaagtgggaagatgataccacctcccttggagggcaactgtgaagagccaatgaacgaacacttaacacagcacccggctcctcgtgaatactgtgtaatattatggtatttcttggcttctgcaggccacatgccattggctttctatctaagctgcttgctctctacagggcctaatggagtgcccagggcctgggaaggcattggtgagcttcactgggactagattctccaaagcctggagtatgaagggtgcatgggctgcgtccagctacctgtgagcccctgtaggccctcacagtctgaaatgcccatggaggtgcctacaggttctcttcttaaagttgtcaggagatggggacattgcaacttgaaggcaagcctggccctgggtttgcttatcttggtggatctttcttacatctgatctttttacattcggtccattcactttggctggccatcaccaaagacaaagacagtggccaccatctttctcatcagtaatccaataatgaggttgctctgctacttaccaagccaagcaagcccattcctttagcctttctgcgtaggatcttatttcccatggggacctggggtcaaaccctgcctctgctgttcactcatcatgggaacacaaacacacacttcccctttgtctgtgcaatggacaggttgggtgacgtggtctcagtgaggct

SEQ ID NO: 730340 - DNA, 433 bp, Homo sapiens
ggggttggggatgtgagcagtgttgtgaaattcctgagccccctgagggccactaccttctggggataggtgaagtggaaacaaagttctctaactctggaggggtgccctggtctcggggagggggagcactggctcctttaaggccttgagggaatatatcttcccctcccttagagccgtgtcccaaaatcaaagtggaatgcgaagtggaagaaatagaccagtgtaccaaacccagagattgcccagaaaacatgaagtgttgcccgttcagccgtggaaagaaatgtttagacttcagaaaggtgaattggataaaacatgtacctgaatgcttgaagccatgcttgatgtctgcagttctgttacaggtttgtgtcctagaaacacaggaattttaataaattatcttttgtacaactctattaaa

SEQ ID NO: 730341 - DNA, 430 bp, Homo sapiens
aaaatcaaagtggaatgcgaagtggaagaaatagaccagtgtaccaaacccagagattgcccagaaaacatgaagtgttgcccgttcagccgtggaaagaaatgtttagacttcagaaaggtcagccttactttataccataaggaggagcttgaataacctccaggatttggctcataatccaggcctctctccacgtgtgcctgattgatgctccaaattggcttccacgggccaaaccttggctgttccagaaactgaaccccaggaattgcttacacactttcttccagcgtagcatctcttcaaacacaatgctcttccccttgaccacttctcagtatgaaactctatgtcttcaactttcagaccccccatttatttgtatgaaggcttcagttgccttaataaagtgctctgtggggtccga

SEQ ID NO: 730342 - DNA, 679 bp, Homo sapiens
  misc_feature (25)..(25): n is a, c, g, or t
  misc_feature (29)..(29): n is a, c, g, or t
  misc_feature (358)..(358): n is a, c, g, or t
  misc_feature (679)..(679): n is a, c, g, or t
agcggggaccagaaggagcttactngggncctgacgtgtcaggaggccctgggggatcctgctgaagctgcgattggcgcagagctgagatgtctgagctctagacacagggacctcagtgtcaaaagatttgggaagatgaattgggtcggggggtcccggtccaggttctgatcaagcaggaaagaagaaagcaaaaggaatattttgaaaaacacaggttaaaatcaaaaatgaaatcactgggagttttatctcctgtcaaaaattctgctgtcagcttagacattcttaacctatatatggtaaatcagatatcttgcaagaagaaaattcctgaaactgtgagaaaaccaanccatgtgaacatgaatagagacataaaaatgcccctaagaaagcataatttagaacttacaatgtcgcctcactgtgtaccttctaaactctgccttgatgatacagaaaccaatgtaaactgtcaaagactaagtagcaaggaagatcttggcccagtccagtcacaaggcatggactcatatagtatgcttcaccctcagtttcagcaaaatagagaactgcagtggcactccatcatctttttcagtggagttacttctaacagacatatttcaaaactaaatttcacatctggaataggcgcttactcctccggaan

SEQ ID NO: 730343 - DNA, 502 bp, Homo sapiens
  misc_feature (25)..(25): n is a, c, g, or t
  misc_feature (29)..(29): n is a, c, g, or t
agcggggaccagaaggagcttactngggncctgacgtgtcaggaggccctgggggatcctgctgaagctgcgattggcgcagagctgagatgtctgagctctagacacagggacctcagtgtcaaaagatttgggaagatgaattgggtcggggggtcccggtccaggttctgatcaagcaggaaagaagaaagcaaaaggaatattttgaaaaacacaggttaaaatcaaaaatgaaatcactgggagttttatctcctgtcaaaaattctgctgtcagcttagacattcttaacctatatatggtaaatcagatatcttgcaagaagaaaattcctgggtatgtctgaaaggaagatctgcaaagatttttgcttcaatgactagtttcctatgtcatcacttgaattatttattacactttcctgggatgttaatcatagaagtctaatactgcaaaataaagtccattttgtcatataaaaaaatttacagtgaaaaa

SEQ ID NO: 730344 - DNA, 804 bp, Homo sapiens
  misc_feature (25)..(25): n is a, c, g, or t
  misc_feature (29)..(29): n is a, c, g, or t
  misc_feature (483)..(483): n is a, c, g, or t
  misc_feature (804)..(804): n is a, c, g, or t
agcggggaccagaaggagcttactngggncctgacgtgtcaggaggccctgggggatcctgctgaagctgcgattggcgcagagctgagatgtctgagctctagacacagggacctcagtgtcaaaagatttgggaagatgaattgggtcggggggtcccggagcttggaaggttcttccatttgtttgtgtcctcttttatttcgttgagcagtggtttgtagttctccttgaagaggtccttcacatcccttgtcgacctgctttagttttgtggaaagccaatgtccaggttctgatcaagcaggaaagaagaaagcaaaaggaatattttgaaaaacacaggttaaaatcaaaaatgaaatcactgggagttttatctcctgtcaaaaattctgctgtcagcttagacattcttaacctatatatggtaaatcagatatcttgcaagaagaaaattcctgaaactgtgagaaaaccaanccatgtgaacatgaatagagacataaaaatgcccctaagaaagcataatttagaacttacaatgtcgcctcactgtgtaccttctaaactctgccttgatgatacagaaaccaatgtaaactgtcaaagactaagtagcaaggaagatcttggcccagtccagtcacaaggcatggactcatatagtatgcttcaccctcagtttcagcaaaatagagaactgcagtggcactccatcatctttttcagtggagttacttctaacagacatatttcaaaactaaatttcacatctggaataggcgcttactcctccggaan

SEQ ID NO: 730345 - DNA, 1232 bp, Homo sapiens
cacagggcagccccgacaacagtgcggccagggactcaggcggccagacgtccgccgggtgtccctctggctggctgggcacgagacggcggggcctggtgatggaggccccccagggcagcgaggccacactgcctggccctgcccctggcgagccctgggaagcaggcggcccccacgcggggccacccccggctttcttttcggcatgtccagtctgtggaggactcaaggtaaacccccctccttgagagccgcagatcccgccccgcggctgcaaaggggctgaatttgcccccagatggcagaggaagtggcgccagcctccttgcagactggtgctctgtgttctgtgggagggaccgggggtctcccggagaggggagctggagggcgcgccctgtggctgccaccggaggaaggggctgacttggggaggtgagttctggaaggcaggggctctgggtctggcaggtcggggtcaccagagccccaatgcccagctgcttcactccgtgtcccccacccctgaggatcaggtgagtgctgcacctctgttggctcgtgccttgcactggggtgccaagggctggaggccctgccgctggccttgtcctccttgggcctcacgcccccttcgggggtggccggttctccccatcacctctctggggcagtcacaccacctgttaagcatcaagctaccacagaggctccggcacctgggctccaccagcccagccccccgggctccgtgtgcgctgggcctcatccccatctatgggaggaaactgaagctcaggaggctgtgtggcttgcggggtctctgggttctgggccccactgttccccagtgaagcccttgtgggaaggttccgggagcaggtggtgtcctcagagcagcctcgcctgctgaccccactgggagaggcgccgtgcctcgggcccctggtgggagctccgctggctcctgtctgaacctcctcgcagggccaaaggctggcttggcctgtgtttcccctggcccaggcctcagcccctgcgtcggaggtggggctgtgttgggcccattgtcccccgccctgggtggcttcctcttgcacagcctggagcctgccctgaccacagcccagcagctccctgtgaacacctctttgtcccttcactgtcggctgtttctaaacccagacactgtttgtaatagactggaaataaaatgttcttttcttacc

SEQ ID NO: 730346 - DNA, 486 bp, Homo sapiens
cgtggttgtacttctgactccatccatgacaggcaaactgtcatgtgggagttcagtcagggtggtggggaaaattacagaggagaagttttaagataaagttataggaaatagacacaaaccttcttggaaggctggtacccacaggatccccattccttgtaaaggtcgtgcactgacacgcatcctgagggccagttccacgtccagtgcctctcgcctttacttccacgtcaggctactgtttccctatcgagggccttccttcctattctgtgatcaaatggttcactgcagttctagagatggagaagccaggagagagaagctgagccatttgttccaagttaagctagagccagggttggaatccagaaccctatcatgaaaaatacagcgttagattaacatttttgaactgcttaattgcccatttttgaactgcttaattgccaaataaattttgagatctcgtaaggctgggtc

SEQ ID NO: 730347 - DNA, 487 bp, Homo sapiens; identical to SEQ ID NO: 58243

SEQ ID NO: 730348 - DNA, 1319 bp, Homo sapiens
agctctcacccctccagtgccgacggtagcgaaagactttcctccaggggcttcctcactggggaattgccggaaagagcaaacaaaaaaggcgctggtgtaggctccaaaataaacacatctgaattcatgatggcatcgacagaggctcttattggattaaaagtttcaaaacaaacaataacgctttggaaaaagggttgaatgcaccctcaggcacgaccatggagaaaggtgggaacatacaattggagattcctgacttcagcaactctgtcctgagccatctaaaccagttgcgcatgcagggccgtctctgtgatattgtggtcaatgtgcaaggacaagcttttcgggctcacaaagtggtgctggctgccagctccccctatttccgggatcacatgtccttgaatgagatgagtacagtctccatttcagtcatcaagaaccctactgtttttgaacagctcctttctttctgttacacagggcggatatgcctgcaactggcagatatcatcagctacctaacagctgccagttttctgcaaatgcagcatattatagacaaatgtacacagatcctggagggcattcatttcaaaattaatgtggctgaggttgaagcagaattaagtcaaacaaggacaaagcatcaagagagacctccagagtctcacagggttacaccaaatctcaaccgctcccttagcccacgacataataccccaaagggaaaccggcgaggtcaggttagtgctgtgctggatatcagagagctaagtcctcctgaggagtccaccagccctcagatcattgaaccaagttctgatgtagagagccgggagcccattcttcggatcaaccgagcaggacagtggtatgtggagacaggagtggcggaccgtgggggtcggagtgatgatgaagttagagttcttggagcagtacacatcaaaactgaaaatctggaggagtggcttgggcctgagaatcagccttctggagaagatgggagtagtgcagaggaagtaacagccatggtgattgataccacaggccatggttctgtaggacaggaaaattatactttagggtcttcaggagccaaggtggctcggccaacaagcagtgaagttgacagatttagcccctccggcagtgttgttcccttgacagagagacacagagccagaagtgagtctcctgggagaatggatgagcctaagcaacccagctcccaggtatggagttgtggatttagaactgctttggtggttggaggaattgctactgtgtatgaatagaaaataatg

SEQ ID NO: 730349 - DNA, 2166 bp, Homo sapiens; identical to SEQ ID NO: 215339

SEQ ID NO: 730350 - DNA, 794 bp, Homo sapiens
aaatgtttaaaagttagctatatttatacaaggaaaaccaaaagaaatacttaaatgagacttttaaaattcgaggctctccactgagacttgttccctggcgccacgccgggagttccgcagagcctcgccccctgccagggcgcccgggggcaaggaccgcacgggcatgccgctcctccagcagtccctttccccttcttccccaagatccagcgcgtgctcggttgcccttctccgttccttgcaggcccttgggtcaggacccaccacctgccggaccatcattttccgagtccctccggcctagtcggagtgctcgctcgcgcctcctaaagctctcagccgagcgcgccgagacccctcagggcggccgcaattaatggatgcctcgaagttgacgtacatatatattcagaaatgttttgccacctgagacctatgaggaggttatgtctagagaagatatttccacactggtttcccttttcaagagctttatcgggagctgaagcagtcaatgccttgaggcctttctattttgcagtacatccagatttctttggacagcaccccgtagaaagggaaatcaatgaaaattctcttaaaaggttaagtgtctacctagaaaacctccagaaaccaggcttcaagtctttgaaaccaactcagcttacattttatgtaagagaaacagaccagagttcctccgatggccaggaaccttttagtacttccgtttatctgttgaacatatccaaagcttgaatactaatatgcatacccagcctctc

SEQ ID NO: 730351 - DNA, 1033 bp, Homo sapiens; identical to SEQ ID NO: 216792

SEQ ID NO: 730352 - DNA, 821 bp, Homo sapiens; identical to SEQ ID NO: 286747

SEQ ID NO: 730353 - DNA, 864 bp, Homo sapiens
  misc_feature (679)..(680): n is a, c, g, or t
  misc_feature (690)..(690): n is a, c, g, or t
  misc_feature (722)..(723): n is a, c, g, or t
  misc_feature (746)..(746): n is a, c, g, or t
  misc_feature (763)..(764): n is a, c, g, or t
  misc_feature (771)..(771): n is a, c, g, or t
  misc_feature (858)..(858): n is a, c, g, or t
ggcacgaggccacctgcccaagaaacttgttggttgttgccctcaggtcgctcccgggcgcggacacggaacccggccatggaagatccgtcgggggctcgcgagccccgggcccggccgagagagcgggacccgggacggcgcccccacccagaccaaggccgcacccacgatcgaccgcgggaccgacccggggacccgcgcaggaagcgaagcagcgacgggaaccggcgaagggacggggaccgggacccgaagagagaccaggagagggacgggaaccgcgaccggaaccgggaccgggagagggagagagagagggaaagagacccggaccgaggcccccgccgggacacacacagggacgcgggccctcgcgcaggtgaacacggagtttgggaaaaaccgcgccaaagccggacgcgggacggagcccggggactgacctgggacgcagccgcgcctcctgggcccgcgccctgggaagccccggagccgccgcagccgcagaggaagggagaccccgggcgccgcagacccgaaagtgaacccccttcggagagatatctgccctcgacccccaggcctggacgagaggaggtggaatattaccagtcagaggcggaaggactcctggaatgccacaaatgcaaatacttgtgcactgggagacctgctnncaaatgctgnaggttctcctgaacttgctgatcctggcctgnngctctgtgtcttacagttcacanggggctacacgggcatnncagctgnggggctttactactatcagttccggaggggcttacagtgggtttgatggtgctgacgggggaaaaggccagaagtggatgtcaggtntaccag

SEQ ID NO: 730354 - DNA, 944 bp, Homo sapiens
  misc_feature (759)..(760): n is a, c, g, or t
  misc_feature (770)..(770): n is a, c, g, or t
  misc_feature (802)..(803): n is a, c, g, or t
  misc_feature (826)..(826): n is a, c, g, or t
  misc_feature (843)..(844): n is a, c, g, or t
  misc_feature (851)..(851): n is a, c, g, or t
  misc_feature (938)..(938): n is a, c, g, or t
ctagtagaggcctcgttttaattcggacgaggtgttgccctcatgtgttgctccctgggctgcggacacggaacccggccatggaagagtcgtcgtgtggtgctcgctgatgcccctgtgtgtccctgtgctcgatgatgatgctggtgaccctgggatcgtgcgcctcccacctcatgacctaatgtgcctgctactccactgtattctgacctgctgtgtgacctgatccctggtgtgaccactgactgcagtgtgatatgctgatatgctatgcttgacggtgtgaacgctgtgcgtgaatgtgtgactgtggtgacctggtgactccgatagatgatgaccaggagagggacgggaaccgcgaccggaaccgggaccgggagagggagagagagagggaaagagacccggaccgaggcccccgccgggacacacacagggacgcgggccctcgcgcaggtgaacacggagtttgggaaaaaccgcgccaaagccggacgcgggacggagcccggggactgacctgggacgcagccgcgcctcctgggcccgcgccctgggaagccccggagccgccgcagccgcagaggaagggagaccccgggcgccgcagacccgaaagtgaacccccttcggagagatatctgccctcgacccccaggcctggacgagaggaggtggaatattaccagtcagaggcggaaggactcctggaatgccacaaatgcaaatacttgtgcactgggagacctgctnncaaatgctgnaggttctcctgaacttgctgatcctggcctgnngctctgtgtcttacagttcacanggggctacacgggcatnncagctgnggggctttactactatcagttccggaggggcttacagtgggtttgatggtgctgacgggggaaaaggccagaagtggatgtcaggtntaccag

SEQ ID NO: 730355 - DNA, 2188 bp, Homo sapiens
ccaggcggtgcgcttcggacccagccagggcatgtgctcggaggcccgcctggctcgcaggttgcgggatgcgctgcgggaggaggagccgtgggcagtagaggagctgctgcgctgcggcgcggaccctaatttggtgctagaggacggcgcagcggctgtgcacttggcggccggagcccggcacccgcgcggcctgcgttgcctcggggccctactgcgccaaggcggggaccccaacgctcgatctgtcgaggcactgacgccgctgcatgtggccgccgcgtggggctgccgccgcggcctggagctgctgctgagccaaggagcggacccggcgctgcgcgaccaggacggactccggccgctggacctggccctgcagcagggacacctggagtgcgcgcgagtcctgcaggatctcgacacgcggaccaggacccggacccggatcggggcagagactcaggagcccgagcctgcacctggcaccccaggcctctctggacctaccgatgagacgctggactccatagcactccaaaagcagccatgcagaggtgacaacagggacattggcttggaggctgacccaggaccccccagcctccctgttccccttgaaactgtggacaaacatgggagctcggcgtcccctccagggcactgggattacagctcagacgcctctttcgtcacagcggttgaggtctctggagctgaggacccagcctcggacactcccccctgggctgggtcattgccaccgaccaggcagggacttctgcatgttgtccatgccaaccagagggtacctaggtctcagggcacggaggcagaactgaatgcccgtctgcaggccctgactctgaccccaccaaatgctgctggcttccagtcctccccttcctccatgcctctcctggacaggagtccagctcatagccccccacggacaccaacccctggagcttctgactgccactgcctgtgggagcaccagacatccattgatagtgacatggccacgctctggctgacagaggatgaggcaagctctacaggtggcagggaacctgtcggcccttgccggcacctgccagtctccactgtgtctgacttggagttgctgaagggactccgagcacttggtgagaatcctcaccccatcacacccttcaccaggcagttgtaccaccagcagctggaagaagcccagattgctcctggcccagagttttcagggcacagcctagaactggctgcagccctgcggacgggctgtattccagatgtccaggcagatgaagacgcgctggcccagcagtttgagcagccagatcctgccaggaggtggcgggagggggtcgtgaagtctagcttcacctatctgctgctggaccccagggagactcaggacctgccagcccgagccttctcactgaccccagctgagcgccttcagactttcatccgtgccatcttctacgtgggcaaagggacgagggcccggccatatgtccacctctgggaggcccttggtcaccatgggcggtcaagaaaacaggcctgccccaaggtgcgtcagatcttggacatctgggccagtggttgcggtgttgtgtccctacattgcttccagcacgtggtcgctgtggaggcttatacacgggaggcgtgtattgtggaagccctagggatccagacgctcaccaaccagaagcaagggcactgctatggagtggtggcaggctggccacctgctcgtcgccggcgcttgggggtgcacctgctgcaccgtgccctccttgtcttcctggctgaaggcgagcgacagcttcatccccaggacatccaggcccggggctgagtgctggggagttggccatccagcctggggagaaatgtttgaatgttccagctgccccatgctgacagcagcccccatctctggtttcagaaggggtgtgtgtgtgtgtgtgtgtgtgtgtgtgtgtgtgtgtgtgtgtttgtgtgtgtgtgtgtgtgtgtagggagcacccaggcagatctcccccaggctgagagaggactttgttacagatggtactgctggagaggtagtaagtagtgagctccccatcgtgggaggaggacaagaagggaagcagaaggtgctttggaacagtccggtgcttctgtaagaggc

SEQ ID NO: 730356 - DNA, 1416 bp, Homo sapiens
cagcggctgccacggagctcgcagctgcggcttctgaggagtaagcggcgcggtagcgaaggccgccgaacctgcctggctagccggcgacttgagtgacgaggcagtagaggagctgctgcgctgcggcgcggaccctaatttggtgctagaggacggcgcagcggctgtgcacttggcggccggagcccggcacccgcgcggcctgcgttgcctcggggccctactgcgccaaggcggggaccccaacgctcgatctgtcgaggcactgacgccgctgcatgtggccgccgcgtggggctgccgccgcggcctggagctgctgctgagccaaggagcggacccggcgctgcgcgaccaggacggactccggccgctggacctggccctgcagcagggacacctggagtgcgcgcgagtcctgcaggatctcgacacgcggaccaggacccggacccggatcggggcagagactcaggagcccgagcctgcacctggcaccccaggcctctctggacctaccgatgagacgctggactccatagcactccaaaagcagccatgcagaggtgacaacagggacattggcttggaggctgacccaggaccccccagcctccctgttccccttgaaactgtggacaaacatgggagctcggcgtcccctccagggcactgggattacagctcagacgcctctttcgtcacagcggttgaggtctctggagctgaggacccagcctcggacactcccccctgggctgggtcattgccaccgaccaggcagggacttctgcatgttgtccatgccaaccagagggtacctaggtctcagggcacggaggcagaactgaatgcccgtctgcaggccctgactctgaccccaccaaatgctgctggcttccagtcctccccttcctccatgcctctcctggacaggagtccagctcatagccccccacggacaccaacccctggagcttctgactgccactgcctgtgggagcaccagacatccattgatagtgacatggccacgctctggctgacagaggatgaggcaagctctacaggtggcagggaacctgtcggcccttgccggcacctgccagtctccactgtgtctgacttggagttgctgaagggactccgagcacttggtgagaatcctcaccccatcacacccttcaccaggcagttgtaccaccagcagctggaagaagcccagattgctcctggcccagagttttcagggcacagcctagaactggctgcagccctgcggacgggctgtattccagatgtccaggcagatgaagacgcgctggcccagcagtttgagcagccagatcctgccaggaggtggcgggagggggtcgtgaagtctagcttcacctatctgctgctggaccccag

SEQ ID NO: 730357 - DNA, 882 bp, Homo sapiens
aaaaagagacgggccttgaccagaggacccagtgtcagcactgatgtaccaggtgagcttagggcaagacccagcgacatcactggatgacagtggattctgactatgtggctgttgtgatcactacttggaaataaacacaagacagtgaagcaggcctcaatcccacatagttttgaaggttccttgtcattttctgggagcccctgatgtgtcctattcctcagagagcttactcttccccactcttctctgccctaccaggccaaagggtctttctcttcctttatccctccaccccatttccttccaccaccacttcagtcaaggagtttttgtatcagaaagttatcacaggccagttatggtggtgcacgcctgtaatcccagcactttgggaggccaagctgggtggatcacttgagctcaggagtttgagaccagcctgagcaatatggtgaagcctggtctctacagaaaacacaaaaagcagccagacgtggtggtgcttgcctggagtctcagctccttgggaggttgaagtgggaggattgcttgagtcctggaggtcaaggctacagggagatgagatggcatcactgtaccctgacctgggggacagagcgagacccttttcatgccccgggacatttgctggtgctgtttcttctggttggcataccctttctgaggactggccaacttgtgctctgagccaagggtagaaggagatgtggccttatccattcctccagcttttcccctaccctcagagctcttaggcagtgggtatggcaccttggaagctgcagcagggtcagggcacattgagtgactaagcatagcaagtacaggtggacggggcagaaatgccagaggtgg

SEQ ID NO: 730358 - DNA, 875 bp, Homo sapiens
ggccagccgcgggcaggctcccaccttctccagggccaggaagctcttctgcaggaagccgtcacagcttggcctccctcttcaggaagcgcaggctcacctcttcgccgagcttggtcacctgggcctggggcggaggcacattgtcccgtgtgcagcctctgctggacacgcagccggtccccctcctgcccatggtctccatcagagttggagtcccctgctgtccccaagccctgagcccggctgagctgggcctgccacaccctcagccggaagaaagccacggcgggcaggaccactctgtacccagacgaccaaccaggcatgggtttgtgaagcatgagaaggccacgctcaggtggggtccagacacacttggcacccaccaccgaggctgcccagggaaggccccccagccgccaccaggcccggcagggaagcaggagtgtcgtgcaggtgtccccatgcacggggagccaggtgggctgggcagagccttggggccttgtctccacaccaacagctgctttcctgccgccctgaaggggaggggaggggggaggcgcagccggccccatccctgcatctcatacacgcaaagggtaggcaggcggcacaggcccttcatcagccacggagaggcgcctcccgggaaacttcccctccacccaagcccctgctggcctcctgccccccaggaggtcaccttagagtagatatttttctgtaaaaagccagatggtacatgttcccacctcatgggatctctgttgtaaccctctcagcatggcggttacagcccccacagtagacattgacaacatgtaaaaaatgttcctgtgtgccaataaaactttatttacaaaaacaaa

SEQ ID NO: 730359 - DNA, 417 bp, Homo sapiens
cagaaataattgatttttgttatctgaatgcatttcccttgagaaaggctgtaggaggtattcagatacctgttgaataagtgaatacaggaatgaatgagtgagagaccttgtctattgtacttatgctgactcatctaagttttatgacttttagcaagttactttacatactgacggctctatttccttgtctgtaaggtggagtttataatacctattgcatatttagtaaacttttgttgaatatttcacataagcactagatcaaactcagatctactgagtcgttttttggggtgtgggttatagatctttgttctcttaatagatctttgtcctcttaataggatctactcaaggttctcatgcacccaaagtttgaaaattactcatttaaactctactatttattgg

SEQ ID NO: 730360 - DNA, 616 bp, Homo sapiens
aatcgaccgcccactcttcaaggatttctggcagcaattccttgacagtttaaaagccttggcagtcaagcaacaacgaactgtctacagactgacgctcgtgaaagcatggaacgtggacgagctccaggcctacgcgcagctcgtgtccctggggaatcctgacttcatcgaagtgaagggcgttacctactgcagagaaagttcagcaagcagtcttaccatggcccatgtgccctggcatgaggaagtggtacagtttgtccgcgagctggtggatctgatccccgaatatgaaattgcatgtgaacacgaacactctaattgcctcctgatagcacacagaaagtttaaaattggtggtgaatggtggacatggatcgattataaccgcttccaggagctcatccaggaatatgaagatagtggtggatcaaaaacgttcagcgcaaaggattatatggccagaactcctcactgggcattatttggtgccaatgaaagaagctttgatcccaaggacacaagacatcagagaaagaacaaatcaaaggctatttctggatgttgagattatctgatttcaaggtactgaaggacaaaaacttggatggcc

SEQ ID NO: 730361 - DNA, 647 bp, Homo sapiens
ggaagtatggctgtagtaggaaaaggagaatgccacaatatcccctgtgaaaaaggagataagcttcgactcttctgctttcgactgagaaagagggaaaatatgtcaaaactgatgtcagaaatgcatagtttcatccagatacagaaaaatcaaaccagagaagccatgactccaggagcatggcactaccccaggaacagagtcagcatccaaaaccttcagaggccagcacaaccctacctgaaagccatctcaagactcctcagatgccaccaacaaccccatccagcagttccttcaccaaggtcaccaaggacaaggatatcaaataactactgttcaatctttactcaagtgtggaaattttgcctgaagtcctccacctaaaaacctgatgccattggtaatgatgtttatgaagataagatcaaagcacagaaaataatatatgtatatatatgtatatatatctggttgaaatactatatatatatatatatataccagctattaattctaggaaatggagtattaagggtgcattttatttcattagttttacttttatgcattttcttcatatcatattttgcattcagaattttcataatttgaaaaaaaataaactttttttttcttaaaga

SEQ ID NO: 730362 - DNA, 631 bp, Homo sapiens
atacagaaaaatcaaaccagagaagccatgactccaggagcatggcactaccccaggaacagagtcagcatccaaaaccttcagaggccagcacaaccctacctgaaagccatctcaagactcctcagatgccaccaacaaccccatccagcagttccttcaccaagaaggatgaaacccacccaggagcacagtcatcgcctgcaaactttagaatcacctcaccaactgtggcccctcctctttcttctgacacttccaccaaccgccatccagcagttccttaaataaggtcaccaaggacaaggatatcaaataactactgttcaatctttactcaagtgtggaaattttgcctgaagtcctccacctaaaaacctgatgccattggtaatgatgtttatgaagataagatcaaagcacagaaaataatatatgtatatatatgtatatatatctggttgaaatactatatatatatatatatataccagctattaattctaggaaatggagtattaagggtgcattttatttcattagttttacttttatgcattttcttcatatcatattttgcattcagaattttcataatttgaaaaaaaataaactttttttttcttaaaga

SEQ ID NO: 730363 - DNA, 576 bp, Homo sapiens
ttgagagttaattatttactgttttctaattcttgccagtatttatgaacagctgtagcttgatatttacctactgaattttaggagaactaatggtcacagtttgggttcttttatgtgtatgtttttaaaacagctattttgtgaatctaggtggttggtttttagaagatttcaggagatgcagtccagcacaattagagctggaacattgttacagcaggctttttgttgctcatgggcagatagagggaaagaatcagttgttagccccaaatttccacatttcagtgttgtaaactctgaatgtgataggtagatgtgggctaagaataatttcctccagtgaagacacgggagaagagcttctattatgaggttatagataaggccttagttatatcatggaaatggactccatgtagttctagaactgcatttcccaaagtatatcctgtgagatgctccacagaaaaaatgattgcatggactaagtttgaaaaatgttgcatgctactcttcccctcgaagatgacagtggatgtcagcattaaagactttgacaggtctttctgt

SEQ ID NO: 730364 - DNA, 518 bp, Homo sapiens
gctatacaactcgagctcggtaccggcatgtgctgtaggccagcggatcacctgaggtcgggagttcgagaccagcctgaccaacatggaaaaaccccgtctctactaaaaatacaaaattagtcaggcatggtagcgcatgtgggaggtaatatatccattactctgacctgtcttttaaaaacagagtggtagaccaggtatccttacgttagtgattctgggtcatgacaccccaagatcattggtgagagtacaatgaacatgcaaggatgcatacaaggttgcttttgtgtttgttttttagaaaatgaggtttgcagaccttttgtccttttttactcgatttaaaaaattttcaacaggtatttatctgaagtactgggtacaggccagtttttttgttttttgttgttgttgttttttgaactaccaccacagtcatgcaaatgaatatgagctgttgaattaattaccctatcttctacatctcttctacttcccatcacgctggccta

SEQ ID NO: 730365 - DNA, 517 bp, Homo sapiens
ctgtaggccagcggatcacctgaggtcgggagttcgagaccagcctgaccaacatggaaaaaccccgtctctactaaaaatacaaaattagtcaggcatggtagcgcatgtgggaggtaatatatccattactctgacctgtcttttaaaaacagagtggtagaccaggtatccttacgttagtgattctgggtcatgacaccccaagatcattggtgagagtacaatgaacatgcaaggatgcatacaaggttgcttttgtgtttgttttttagaaaatgaggtttgcagaccttttgtccttttttactcgatttaaaaaattttcaacaggtatttatctgaagtactgggtacaggccagtttttttgttttttgttgttgttgttttttgaactaccaccacagtcatgcaaatgaatatgagctgttgaattaattaccctatcttctacatctcttctacttcccatcacgctggcctacagcacatgccggtaccgagctgattgtatt

SEQ ID NO: 730366 - DNA, 542 bp, Homo sapiens
  misc_feature (415)..(415): n is a, c, g, or t
  misc_feature (431)..(431): n is a, c, g, or t
  misc_feature (446)..(447): n is a, c, g, or t
ctgtaggccagcggatcacctgaggtcgggagttcgagaccagcctgaccaacatggaaaaaccccgtctctactaaaaatacaaaattagtcaggcatggtagcgcatgtgggaggtaatatatccattactctgacctgtcttttaaaaacagagtggtagaccaggtatccttacgttagtgattctgggtcatgacaccccaagatcattggtgagagtacaatgaacatgcaaggatgcatacaaggttgcttttgtgtttgttttttagaaaatgaggtttgcagaccttttgtccttttttagtggaggacaatatattataacaggagatagtcaatgtacacatgactggggaacttggccgctcggtacccggcatgtgctttttgtcttgctgtaatagcacgnacagtgaagcataagngaatatggtctgttnntttaactgctcaattttatacatcatgatctgatcggtcgcttcatcgctggcctacaacacctgccggcaccggctcggcttgtactatgtctg

SEQ ID NO: 730367 - DNA, 726 bp, Homo sapiens
ctgtaggccagcggatcacctgaggtcgggagttcgagaccagcctgaccaacatggaaaaaccccgtctctactaaaaatacaaaattagtcaggcatggtagcgcatgtgggaggtaatatatccattactctgacctgtcttttaaaaacagagtggtagaccaggtatccttacgttagtgattctgggtcatgacaccccaagatcattggtgagagtacaatgaacatgcaaggatgcatacaaggttgcttttgtgtttgttttttagaaaatgaggtttgcagaccttttgtccttttttactcgatttaaaaaattttcaacaggtatttatccgaagtgctgggattacaggcgtgagccagctcacccggccttaggttggggcttttaaatgacccttcaggtgtgtgtctgtgatgacttgaggcttttttttttactgtcttccagtgaaattaccagatgaatatcagtggtgagaaatttgattccttgaaatgtaaggaatttcattcttgaattgtgtgacaaaaccagggagcatgattttgggtccattcaggatctatccagtcaacactgagtatatagttgttgatggagactatgataggttctgaggatggatctgttatattctccataaatctgtatgtgagtcatgcctttgtttgcttcctacttgttctgtttactgggttttttttttctttgag

SEQ ID NO: 730368 - DNA, 414 bp, Homo sapiens; identical to SEQ ID NO: 346066

SEQ ID NO: 730369 - DNA, 488 bp, Homo sapiens
  misc_feature (52)..(52): n is a, c, g, or t
  misc_feature (59)..(60): n is a, c, g, or t
  misc_feature (134)..(134): n is a, c, g, or t
  misc_feature (485)..(485): n is a, c, g, or t
tgcatgatagggaactagcgaatgtggctggatagacttggagatatgagtngtagatnncatgtagtcgaagtaatcttattcctttatggattccaagttgttaaatggttcatattctttagctaaatttncaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaatattttcaagcagcaatagagaaaaaaattcatgcntct

SEQ ID NO: 730370 - DNA, 502 bp, Homo sapiens
  misc_feature (148)..(148): n is a, c, g, or t
  misc_feature (499)..(499): n is a, c, g, or t
ctgctgacttatttgtagaagttgcatatctttagatttattgtaaaaactattggcatatgattcgtctttttcatgtagccccagggtattctttccttaatgaatccaattttcataaatggttcatattctttagctaaatttncaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaatattttcaagcagcaatagagaaaaaaattcatgcntct

SEQ ID NO: 730371 - DNA, 235 bp, Homo sapiens
tgactctaaggatctagacagcggaccccatggttaagtttgagatccctacttcaccgtctctgggatcaggtccgatacatgaagatcattgagaaaagtggttaccaggccctgccttgggttcgctacatcacccagagtggcgattaccaacttcgtaccagctagaagggagaagagatgggggtttgaactgtgtgactaccttatagacccggttgcagattttgcg

SEQ ID NO: 730372 - DNA, 721 bp, Homo sapiens
  misc_feature (655)..(655): n is a, c, g, or t
  misc_feature (675)..(675): n is a, c, g, or t
  misc_feature (679)..(679): n is a, c, g, or t
tgaggccaacgaggcaaaagtttcaaaggttgtcctgtatggggtgttttgtgcgtcttgttaaaataatgaagtgctttatttcattatttgtggggcatcaagtctgcaacttattctttcataaaactgttagtgttctttggttatgcaacttattcttaattggttcagaaatgttaataattagggaatctgggtgataagtgtgtgagaacgccgtaatatatgtattttgtaacttacaaataaatgtgagattatttcagaatttaaaaatatttttaaaaagaacattaacatttacttcaagaaactttctgccattgtcaaatcctaattcctcttactgattacagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattaggtgagtcagtgggctttttctcctgcttttgggagtgaatgcaccagggcagagcagagacctggttgctgaatcttcaatccttggctgcccngcaggctttctttttctttntaanttttattatgttatatgatattttaataattaaaattatata

SEQ ID NO: 730373 - DNA, 532 bp, Homo sapiens
  misc_feature (466)..(466): n is a, c, g, or t
  misc_feature (486)..(486): n is a, c, g, or t
  misc_feature (490)..(490): n is a, c, g, or t
tcgtacattaaaccctccgtgaagggaaacgggccagaagggcttccaccgctgaggggcagagagcccgtttctttttttttttaaaaatatttttaaaaagaacattaacatttacttcaagaaactttctgccattgtcaaatcctaattcctcttactgattacagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattaggtgagtcagtgggctttttctcctgcttttgggagtgaatgcaccagggcagagcagagacctggttgctgaatcttcaatccttggctgcccngcaggctttctttttctttntaanttttattatgttatatgatattttaataattaaaattatata

SEQ ID NO: 730374 - DNA, 903 bp, Homo sapiens
  misc_feature (579)..(579): n is a, c, g, or t
tgaggccaacgaggcaaaagtttcaaaggttgtcctgtatggggtgttttgtgcgtcttgttaaaataatgaagtgctttatttcattatttgtggggcatcaagtctgcaacttattctttcataaaactgttagtgttctttggttatgcaacttattcttaattggttcagaaatgttaataattagggaatctgggtgataagtgtgtgagaacgccgtaatatatgtattttgtaacttacaaataaatgtgagattatttcagaatttaaaaatatttttaaaaagaacattaacatttacttcaagaaactttctgccattgtcaaatcctaattcctcttactgattacagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattagaatcataagaatgtggancctcgccatggcccccaaccatatgtacatatctattattctagcagtgtttagacaagactgcatggagaagtgagcaccacgtaaagactctggcctccgggagtttcttcttccatctagacatactgccagtcctcatctgcaatggcaacgttgtgcaatgtcttgcaaacgacatccacgctcacttgctaaataagaatctatgacattaacatgtagctcgatgctattagcgcttgtcagagcagcgtgcgttccctctcaactcaagctacaaacagtacctgcagacaactcggcttcaccggctacgccaca

SEQ ID NO: 730375 - DNA, 662 bp, Homo sapiens
  misc_feature (79)..(79): n is a, c, g, or t
  misc_feature (338)..(338): n is a, c, g, or t
tgccgtgtgactgtgtactcaactgataggacaaatttcagctgatcctcactattgtgggcaccatcgctggcgttgncattctcagcatgataattgcattgattgtcacagcaagatcaaataacaaaacgaagcatattgaagaagagaacttgattgacgaagactttcaaaatctaaaactgcggtcgacaggcttcaccaatcttggagcagaagggagcgtctttcctaaggtcaggataacggcctccagagacagccagatgcaaaatccctattcaagacacagcagcatgccccgccctgactattagaatcataagaatgtggancctcgccatggcccccaaccatatgtacatatctattattctagcagtgtttagacaagactgcatggagaagtgagcaccacgtaaagactctggcctccgggagtttcttcttccatctagacatactgccagtcctcatctgcaatggcaacgttgtgcaatgtcttgcaaacgacatccacgctcacttgctaaataagaatctatgacattaacatgtagctcgatgctattagcgcttgtcagagcagcgtgcgttccctctcaactcaagctacaaacagtacctgcagacaactcggcttcaccggctacgccaca

SEQ ID NO: 730376 - DNA, 209 bp, Homo sapiens
  misc_feature (182)..(182): n is a, c, g, or t
cgacggaaggtagctgtactgtatggtgaaggataaaatccgttctgtatagcagctgtagttgggtcgtaagtaagtgtcattccagcaagtctcacctctccttctctatgccatggtcttccattagggatgtatttgtttgggttctgtctctttttctgtcctccatcagcaaactnacagataaaggttctgtgggggcagta

SEQ ID NO: 730377 - DNA, 183 bp, Homo sapiens
  misc_feature (17)..(17): n is a, c, g, or t
gcggcccggaaggtagntgtactgagagcacatccgccgcacaagtgaacctcatgggaatggggtttggagcagccctgcccctcgctgtgaacttcctgttggtgctggttcacatgatgctcttatagttggtaagttttatgaagtgtttgctgaggaattctgtcatcttaacccaac

SEQ ID NO: 730378 - DNA, 219 bp, Homo sapiens
ctagaggagtccccgcgaaaggtgaagcgtgttactgagagcaccatccgccgcacaagtgaacctcatgggaatggggtttggagcagccctgcccctcgctgtgaacttcctgttggtgctggttcacatgatgctcttatagttggtaagttttatgaagtgtttgctgaggaattctgtcatctttaacagtaacagctaccttccggataatga

SEQ ID NO: 730379 - DNA, 703 bp, Homo sapiens; identical to SEQ ID NO: 440813

SEQ ID NO: 730380 - DNA, 539 bp, Homo sapiens
gttagctgttactgtggtacaacattacttaaaggaagttggaagagttaactccgcagatctggggaccctaagaggctgtgtgatgcctcagcacttgagcccacgtggaaaggctgtggccagggccctgacctgctgtgtctgcagtggggttgtcccagccctcatgggcagctgaccttgagttctggccttattttcccccctctcagggcttggagaagatctctgcctacatgaagtccagccgcttcctcccaaaacctctgtacacaagggtggctgtctggggcaacaagtaatgccttgaaggccaggaggtgggagtgaggagcccatactcagcctgctgcccaggctgtgcagcgcagctggactctgcatcccagcacctgcctcctcgttcctttctcctgtttattcccatctttacccccaagactttattgggcctcttcacttcccctaaacccctgtcccatgcaggccctttgaagcctcagctacccactttccttcatgaacatccccctccc

SEQ ID NO: 730381 - DNA, 1811 bp, Homo sapiens
gactgcagctgatggaagatgagccccaacttctaaaaatgtatcactaccgggattgagatacaaacagcatttaggaaggtctcatctgagtagcagcttcctgccctccttcttggagataagtcgggcttttggtgagacagactttcccaaccctctgccccgccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaagagctgtttctacatcctgtgctgagagccagctcttccacgcccatagaggggagtcccatgaccctgacctgtgagacccagctctctccacagaggccagatgtccagctgcaattctccctcttcagagatagccagaccctcggattgggctggagcaggtcccccagactccagatccctgccatgtggactgaagactcagggtcttactggtgtgaggtggagacagtgactcacagcatcaaaaaaaggagcctgagatctcagatacgtgtacagagagtccctgtgtctaatgtgaatctagagatccggcccaccggagggcagctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcagctgataacgttcacagccccatcctcagcacgtggattcgagtcaccgtgagaattccggtatctcaccctgtcctcaccttcagggctcccagggcccacactgtggtgggggacctgctggagcttcactgtgagtccctgagaggctctcccccgatcctgtaccgattttatcatgaggatgtcaccctggggaacagctcagccccctctggaggaggagcctccttcaacctctctctgactgcagaacattctggaaactactcctgtgatgcagacaatggcctgggggcccagcacagtcatggagtgagtctcagggtcacagttccggtgtctcgccccgtcctcaccctcagggctcccggggcccaggctgtggtgggggacctgctggagcttcactgtgagtccctgagaggctccttcccgatcctgtactggttttatcacgaggatgacaccttggggaacatctcggcccactctggaggaggggcatccttcaacctctctctgactacagaacattctggaaactactcatgtga

SEQ ID NO: 730382 - DNA, 891 bp, Homo sapiens
gactgcagctgatggaagatgagccccaacttctaaaaatgtatcactaccgggattgagatacaaacagcatttaggaaggtctcatctgagtagcagcttcctgccctccttcttggagataagtcgggcttttggtgagacagactttcccaaccctctgccccgccggtgcccatgcttctgtggctgctgctgctgatcctgactcctggaagagaacaatcaggggtggccccaaaagctgtacttctcctcaatcctccatggtccacagccttcaaaggagaaaaagtggctctcatatgcagcagcatatcacattccctagcccagggagacacatattggtatcacgatgagaagttgttgaaaataaaacatgacaagatccaaattacagagcctggaaattaccaatgtaagacccgaggatcctccctcagtgatgccgtgcatgtggaattttcacctgactggctgatcctgcaggctttacatcctgtctttgaaggagacaatgtcattctgagatgtcaggggaaagacaacaaaaacactcatcaaaaggtttactacaaggatggaaaacagcttcctaatagttataatttagagaagatcacagtgaattcagtctccagggataatagcaaatatcattgtactgcttataggaagttttacatacttgacattgaagtaacttcaaaacccctaaatatccaagttcaagagatagccagaccctcggattgggctggagcaggtcccccagactccagatccctgccatgtggactgaagactcagggtcttactggtgtgaggtggagacagtgactcacagcatcaaaaaaaggagcctgagatctcagatacgtgtacaga

SEQ ID NO: 730383 - DNA, 492 bp, Homo sapiens
gacttggtgcccacatttctcaaggatgggaatgttgtgggagtgagagggatgttgcttcctttataatcgtatacacaattaatttcttatttcctactttgggcttctgcctgctgcacctgctgctattggcctattcatggtagctccagccttccccttgaccttgatgtccctgccatcaggaccttcacatgccatcttgtgttcccccaggagtccctgtgtctaatgtgaatctagagatccggcccaccggagggcagctgattgaaggagaaaatatggtccttatttgctcagtagcccagggttcagggactgtcacattctcctggcacaaagaaggaagagtaagaagcctgggtagaaagacccagcgttccctgttggcagagctgcatgttctcaccgtgaaggagagtgatgcagggagatactactgtgcagctgataacgttcacagccccatcctcagcacgtggattc

SEQ ID NO: 730384 - DNA, 1032 bp, Homo sapiens
agccacgccactccctcctgagagcccaccgcgccacagcttggaggaagagcctgcggggaactggctgcaggacgctctcttcttgagtgcaggtgctggctctgctgtgaccatgcccgtgacctttgccctcctgctcctcctgggccaggccactgcggacccatgctacgatccacagggccgcccccaattctgcctcccgccagtgacacagctggctgccgtggcggcctcctgccctcaggcctgtgccctgtccccaggaaaccaccttggcgccagggaaacctgcaatggcagcctgactttggccctgggtggccccttcctcctgacatctgtcagcttgcgcttctgtaccccaggacccccagccctcatcctgtctgctgcctgggcctcagggggtccctggaggctgctgtggcacaggcccgcctggcctggggccttagggggccctgaaagggtgaccttccactccacaccaggtcctaaggccactgtggcggccagccacctccgtgtggagtttgggggccaggccgggctagcggcagctgggctgagaggccgctgccagtgtcatggccacgctgcccgctgtgccgcccgtgcccggcccccccgctgcactgccgccacataccactggcccggggtgcgagagctgccgccgtcccatcgagactggccctggcggctgcacgccccgagaccccaaccttgactaacctggtcctgcaaacagacgcccgagctgccggttcaactctgagctgttcagactgtcgggcggcggagtgggggtctgtaaccggcggccaccaccacaatgggggggtggccaggccacgggacggggggaccaaacggcattacgaggagcggagacgcgcggagcactggggagggacacgaccaacgggaggaccgacagggagagccacgagggcgcaagacccggagagggccgagcgcgcgggttctcgcgcagagaaaaaaccacgagggggtcggagggcc

SEQ ID NO: 730385 - DNA, 1249 bp, Homo sapiens
gtcccatacagggggagctcaggcagggtcagcggagggacctgcgcctgaatcccgaagttccactctgactcacacagcctgggcccccagctctgacatgccccctctgatggggggcgtctcagccccattccatcctcctgcagctgatgcacctcccagctttcggagtgactcccttctttcaaatccgatgtccctgtcctgctcctgccaaatctggccccctccaacgtggtacctaagggtccagagtcgagggtcgcctttgctgtgccctcgcaccccctgggggcgggcctggggcagtgggtcccaagcctgtcaggattgggcccacgctacaccacgataaacgctggggccaggccactgcggacccatgctacgatccacagggccgcccccaattctgcctcccgccagtgacacagctggctgccgtggcggcctcctgccctcaggcctgtgccctgtccccaggaaaccaccttggcgccagggaaacctgcaatggcagcctgactttggccctgggtggccccttcctcctgacatctgtcagcttgcgcttctgtaccccaggacccccagccctcatcctgtctgctgcctgggcctcagggggtccctggaggctgctgtggcacaggcccgcctggcctggggccttagggggccctgaaagggtgaccttccactccacaccaggtcctaaggccactgtggcggccagccacctccgtgtggagtttgggggccaggccgggctagcggcagctgggctgagaggccgctgccagtgtcatggccacgctgcccgctgtgccgcccgtgcccggcccccccgctgcactgccgccacataccactggcccggggtgcgagagctgccgccgtcccatcgagactggccctggcggctgcacgccccgagaccccaaccttgactaacctggtcctgcaaacagacgcccgagctgccggttcaactctgagctgttcagactgtcgggcggcggagtgggggtctgtaaccggcggccaccaccacaatgggggggtggccaggccacgggacggggggaccaaacggcattacgaggagcggagacgcgcggagcactggggagggacacgaccaacgggaggaccgacagggagagccacgagggcgcaagacccggagagggccgagcgcgcgggttctcgcgcagagaaaaaaccacgagggggtcggagggcc

SEQ ID NO: 730386 - DNA, 1496 bp, Homo sapiens
ttaggctaggtacgaggctgggtttgaatcggcacgagggggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgcatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagtt

SEQ ID NO: 730387 - DNA, 974 bp, Homo sapiens
gcctggtggcgaattcggcacgagggaagtctgcttgaaaggaggtagtagtccagaaaaagattttgttttgctttatgaaaaggaagcaggaggagaaagtattattttttgtctttagatttaccatgagcatgtgatgcttaggctacggcagccatcttggtaccctgagaagagtcaccctaagagaagatgccagcattctaggaaaagcagggcggggatggagaaaaaatccagggcctggatgacattgctgagctgctgagttaacctagaactatcctaactcaagatttctctttataagaatctctcttgcaggagtaacacaggcatgtggagaatttctcagagtatttccgcagcaaccaactggcatgaagaatactttgctgaaacatggggttcaaaagcagcccacagctctctttcggacctctgaagtcacacccagtggtctagtcaacatttcctcttgcagagattgtaaaggtttcaatcttaacaccatgtgactaattcggtctctatgatcaaagccttataagaaagaatgactggttgacccgacatggaccaagtgaccgttcttgttcccagtgtgttgtgggctaagaagagatgggcacagaatgatgggaacgcagagcgaaagggcccaactctaccaggaggggaagataaaaactcctgaagaaattatacaaaaatagaatacttacaacagaattctcaacatcatttttccctgtttgaatccagcaagtcagccattggtcacttaagagcactaacccctccctggtttgaagatgttcttgactttaaatacaaacatctgatattccagcttagactcctccacaagaactagagtgtcatcctattttggcttccagctcagtccctctgctacaagtcttgactccagaactctgtgggataataaaatacaagatcatagcttg

SEQ ID NO: 730388 - DNA, 915 bp, Homo sapiens
agagggacgccccctcctcctccccgcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagcatggactacctgacgacgttcaccgagaagagtgggcgccttctgcggggcacggccaaccgcctgttggggttcgggggcggcggcgaagcccggcagacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggctgaatttgataagaccactaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatgtaagagtgatatttata

SEQ ID NO: 730389 - DNA, 1027 bp, Homo sapiens; identical to SEQ ID NO: 267499

SEQ ID NO: 730390 - DNA, 628 bp, Homo sapiens; identical to SEQ ID NO: 267500

SEQ ID NO: 730391 - DNA, 812 bp, Homo sapiens
agagggacgccccctcctcctccccgcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagcatggactacctgacgacgttcaccgagaagagtgggcgccttctgcggggcacggccaaccgcctgttggggttcgggggcggcggcgaagcccggcaggtgcgcttcgaagattacctgagggagccagcccagggggacctcgggtgcgggtccccgccccaccggcccccggcgccgtccagcccggagggacctgacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggctgaatttgataagaccactaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaag

SEQ ID NO: 730392 - DNA, 494 bp, Homo sapiens; identical to SEQ ID NO: 267502

SEQ ID NO: 730393 - DNA, 721 bp, Homo sapiens
ctttagttttggtccagaaagcattttcaaggagctggtcaagcatggctttagcagataagagacttgagaacttacagatctacaaagttcttcaatgtgtgcggaacaaagacaagaagcagatagagaagctgaccaagcttggataccctgaactaatcaattatacagaacccattaatggacttagtgcttggcacttagcctcagtttccaatgatattgatatggtcagctttctccttgaccttggtgctcaccctgatgtgcaagaccgaatgggctgtactcccacaatgagggctgcagaactgggccatgaattgtcaatggaaatattagcaaaggcaaaggctgatatgactatagttgataatgaaggaaaaggtaaaaatcccgacatcctctccagcagattgcaattcattttgtagccagaaagcaataacatggactctttttgttttccaactttagaagtgaattacttatggttttaagggaaaggctaaattctcactcctatacctaaacctactgtctcctcatactttgaaaatgagatagctatatcttagggaaatcatttatgagagcttgctcatatacttagattaatttgtgtttggtggtttcttttaaatgaggagaattttgaacattatacacactgattattcattataaattataaactcttctttaaaacaaagatgaa

SEQ ID NO: 730394 - DNA, 839 bp, Homo sapiens
ttccggggacccggggcccatggacacatacacccagccctgctgtcccgcgcgccagctcaccagccctacccaagggacatcattcacgcctgggcgcctccgccgggctccgggagcccaaggtcgcggctgggccagcgctgagcgtcagaggacgagagcaggggcctccccggtcgccccagcaggcccaggcacataggtgcccagagatccctggcttctgatcgcccggaagactaagagctttagttttggtccagaaagcattttcaaggagctggtcaagcatggctttagcagataagagacttgagaacttacagatctacaaagttcttcaatgtgtgcggaacaaagacaagaagcagatagagaagctgaccaagcttggataccctgaactaatcaattatacagaacccattaatggacttagtgcttggcacttagcctcagtttccaatgatattgatatggtcagctttctccttgaccttggtgctcaccctgatgtgcaagaccgaatgggctgtactcccacaatgagggctgcagaactgggccatgaattgtcaatggaaatattagcaaaggcaaaggctgatatgactatagttgataatgaaggaaaaggtgttttgttttactgcattttaccgactaagcggcattatcgctgtgctctgatcgcccttgaacatggtgcagatgtcaacaattctacctatgaaggaaagccaatattccttagagcttgtgaagatgcacatgatgttaaagatgtgtgcctgacatttttggaaaaaggagccaatcctaatgcaatcaactca

SEQ ID NO: 730395 - DNA, 903 bp, Homo sapiens
ttccggggacccggggcccatggacacatacacccagccctgctgtcccgcgcgccagctcaccagccctacccaagggacatcattcacgcctgggcgcctccgccgggctccgggagcccaaggtcgcggctgggccagcgctgagcgtcagaggacgagagcaggggcctccccggtcgccccagcaggcccaggcacataggtgcccagagatccctggcttctgatcgcccggaagactaagagtcccatgaagtgggcaccattgctattgccagttcacagatgcagaaactgaggtaaaaactagctttagttttggtccagaaagcattttcaaggagctggtcaagcatggctttagcagataagagacttgagaacttacagatctacaaagttcttcaatgtgtgcggaacaaagacaagaagcagatagagaagctgaccaagcttggataccctgaactaatcaattatacagaacccattaatggacttagtgcttggcacttagcctcagtttccaatgatattgatatggtcagctttctccttgaccttggtgctcaccctgatgtgcaagaccgaatgggctgtactcccacaatgagggctgcagaactgggccatgaattgtcaatggaaatattagcaaaggcaaaggctgatatgactatagttgataatgaaggaaaaggtgttttgttttactgcattttaccgactaagcggcattatcgctgtgctctgatcgcccttgaacatggtgcagatgtcaacaattctacctatgaaggaaagccaatattccttagagcttgtgaagatgcacatgatgttaaagatgtgtgcctgacatttttggaaaaaggagccaatcctaatgcaatcaactca

SEQ ID NO: 730396 - DNA, 1800 bp, Homo sapiens
tacttcctcacacagctgatttttgtgaatgatttagacatttctgccccgcagtggccaattattgcatttggtggtttagctggattactaggatcaattgtggactcatacttaggggctacaatgcagtatactgggttggatgaaagcactggcatggtggtcaacagcccaacaaataaggcaaggcacatagcagggaaacccattcttgataacaacgcagtgaatctgttttcttctgttcttattgccctcttgctcccaactgctgcttggggtttttggcccagggggtgaactttatttcatttccacaggttgaaactggtgagtccagctaaatttgcaattccaactttcatcctaagaataataactgtaatggcaaagcggaaatgccagttcctcctgtattccattgagatgggatttcacattttcctctcatcaactcccctgtaatagctagcgtctttctagcgaaagagaagaattcctagaacttatgcatttttttcctgctgaatggaagtcttgagcaatgaagctatattgtccctacatattactatatattgaactgaaagttcttacataatcaatgtcaagttttgtcttattttgttggttgtttaaaccagtgtaggaaataaaagtgatgatatttaaaatagttctcagttgaagcagagaaatgccactgtgctagttgcccaaatgttgtatctatttaaatagtttaagctgatgtgtatgggagcctaaacaagtgtagtatcctgaacttctcccattaattgctattcacacttgggaaaagtgtggacattggttcctaggaagttttgtgaccaactccacatttgttctttcttcctcagggttagtgatgaaaaaaagtaaatatctttttcatatgtccattagaatgtatgaaaaaaatcattttaactaaaagcaaaagaattttatcttatatctaaaaaatatataacttactatatgtttcagttgctctctgaacaaaaattatcttcaatttaatatgtggaatgtgttttctagctttctttgaattatgtatggcaacctggtttagcactggcatcctgaacagttaagagtcactgggaaattattgtatttctttataaatttactgtcatatcaattgctggaaaatgctatgatttttctattattaccttctaagttgtattctctcttacactgtagcctcaactaaggcaattctgctatgtttgttcttcactatgatttactgtgtgccaaaggagttttgacagggtacagagtattttactaaaagtatttttaaatgtttctcatgtgatttctgtaccttcttcctcctgccccttttgcttttttaaagaaactggggaaggatttatgaatacaccaccaccagagtggataatgcttagaattctttattggtggccctactatggtgatgatctagaactgacttacttcaggacagaagaaaaaacaatcacacccttaacctttaagccagttagatcagggggttgcaacaattgggttaaactttgggtatacattggaagcaccaggcatgtttgctttttttgtttatgtgtttgttttttgagacagagtctcacactgtggcccaggctggactccagcacagtggcatgatctcagctccgcctcctgggttcacgtgattctcatgcctcagcctcccgggtggctgggatcacaggcgtgcaccatcacgcccggctaattttgtattttcag

SEQ ID NO: 730397 - DNA, 405 bp, Homo sapiens; identical to SEQ ID NO: 255193

SEQ ID NO: 730398 - DNA, 755 bp, Homo sapiens
acggggaggcggttacctggcaaccgagagatgcggagcgcaaccacctagcggtcggaaagtgcatttttcagagccctaggaatccgagctgacggatccctgacaggggcgactgactcctagttatccccctaacccctaggggccttcagccccaaccccatcatgacatctcctctgtgcagggcggcctccgccaacgccctgcctcctcaggaccaggcttcgacgccctcttccagggtcaagggcagggaggcttcgggcaaacccagccacctccgaggcaagggcacagcccaggcgtggaccccaggccgttccaagggaggatccttccacagaggtgcagggaagccctctgtgcactctcaggtggctgagttacataaaaagatacaactgttagagggtgaccggaaggctttttttgagagctctcagtggaacatcaagaagaaccaggagaccatcagtcagctccgcaaggagactaaggcactggaactaaagctgctggacctgctcaagggagatgagaaagtggtccaggcagtgattcgcgaatggaagtgggagaagccatacctgaagaacaggacaggacaggtttgcccaccctcgccccacctcctccttcatttccagcctgggtcccctcaccactggactccaggctcaccctctccaatccttcctgcacactagctgccattcatgtgctcattcaattaaatctttattactcactt

SEQ ID NO: 730399 - DNA, 845 bp, Homo sapiens
agggtgaccggaaggctttttttgagagctctcagtggaacatcaagaagaaccaggagaccatcagtcagctccgcaaggagactaaggcactggaactaaagctgctggacctgctcaagggagatgagaaagtggtccaggcagtgattcgcgaatggaagtgggagaagccatacctgaagaacaggacaggacaggccctggagcacctagaccaccggctgagggagaaggtgaagcagcagaacgccctgcggcaccaggtggtgttgcggcagaggcggctggaggagctccagctgcagcacagcctgcgccttctggagatggcggaggcgcaaaacagacacacggaggtggccaagaccatgcggaacctggagaaccgcctggagaaggcccagatgaaggcgcaggaggccgagcacattaccagcgtgtacctgcagctcaaggcctatctaatggacgagagcctcaacttggagaaccggctggactccatggaggctgaggtggtgaggaccaaacatgagctggaggcactgcacgtggtgaaccaagaggccctcaatgcccgggacattgccaagaaccagctgcagtacctagaggagaccttggttcgagagcgcaagaagcgggaacgctacataagtgagtgcaagaagcgcgccgaggagaagaaactgggagaacgagcgcatggagcgcaagacccaccgcgagcacctgctgctacagtccgacgacaccatccaggacagcctgcatgccaaggaggaggagctgcggcagcgctggagcatgtaccagatggaggtgatctttggcaaggtcaa

SEQ ID NO: 730400 - DNA, 679 bp, Homo sapiens
acggggaggcggttacctggcaaccgagagatgcggagcgcaaccacctagcggtcggaaagtgcatttttcagagccctaggaatccgagctgacggatccctgacaggggcgactgactcctagttatccccctaacccctaggggccttcagccccaaccccatcatgacatctcctctgtgcagggcggcctccgccaacgccctgcctcctcaggaccaggcttcgacgccctcttccagggtcaagggcagggaggcttcgggcaaacccagccacctccgaggcaagggcacagcccaggcgtggaccccaggccgttccaagggaggatccttccacagaggtgcagggaagccctctgtgcactctcaggtggctgagttacataaaaagatacaactgttagaatctcactctgttgccaggtgggagtgcagtggaacgatttcggctcactgcaacctccgcctcccggaatctcttgaacccgggaggcggaggctgtggtgagccgagattgcaccattgcactgcagcctgggcaacaagagtgaaactccatctcaaaaaaaaaaaaaaagttgatgattgcaaaaaaggtctttcctctgggatgttgcacccatgcacccacccagtaactgtgtgtctgtccacctcacctgcctgccag

SEQ ID NO: 730401 - DNA, 1484 bp, Homo sapiens
  misc_feature (838)..(838): n is a, c, g, or t
gaggccgagggctgccgctaccaatttcgggtcgcgctgctgggggacgcggcggtgggcaagacgtcgctgctgcggagctacgtggcaggcgcgcctggcgccccggagccggagcccgagcccgagcccacggtgggcgccgagtgctaccgccgcgcgctgcagctgcgggccgggccgcgggtcaagctgcaactctgggacaccgcgggccacgagcgcttcaggtgcatcaccaggtccttttaccggaatgtggtgggtgtcctgctggtctttgatgtgacaaacaggaagtcctttgaacacatccaagactggcaccaggaggtcatggccactcagggcccggacaaggtcatcttcctgctggttggccacaagagtgacctgcagagcacccgctgtgtctcagcccaggaggccgaggagctagctgcctccctgggcatggccttcgtggagacctcggttaaaaacaactgcaatgtggacctggcctttgacaccctcgctgatgctatccagcaggccctgcagcagggggacatcaagctagaagagggctgggggggtgtccggctcatccacaagacccaaatccccaggtcccccagcaggaagcagcactcaggcccatgccagtgttgactctaggagagaaagggttaaagcagtcccagccttagcccacctggtgggatggggagtgttaatatctctctggaggacaaatgacagaagggttcatataaacagtatcctgacacagtcatgcttcctggattttggagtcgaggctttctacagaaaagaaagttctgatggccaggcntctcgaactccgcatctcaggtgatctgctcgccttggcctcccaaagtgatgggattgcaggcatgagccaccgtgcccggcttcacacccatttctttaaaaaggatcccgtagcaggcagaaaagccccttccatcctgctcctctgatactgtgcccccttggagatatttccgtcctccacccacgtgtctgtggctggaactgcccagcctgctcctggccccctggaagcctccccacagctggtaatctggacttaaggattgctgggccaccgcctctctgcctaccaccattccatatttaagtggagcccctacgtagaaaggccccggggctttattttagtctccttttcagggatgtcgtgggcgggggagggggttcttggtgctacagccctctccccacccctaaagggacgccgacgctgtttgctgccttcaccacatattagtgcttgaccctggcaggggaccccatggaaaagatggggaagagcaaaatacatggagacgacgcaccctccaggatgctcgctgggattcccacgcccaccactgtcccccaccccatggctgggaggggcctctgaacggaacagtgtccccacagagcgaataaagccaaggcttcttccc

SEQ ID NO: 730402 - DNA, 810 bp, Homo sapiens
  misc_feature (809)..(809): n is a, c, g, or t
gaagaaatgagtgaggtggatgcttcagcgctgttagtctcctccccatgcccctcctcacttcatctagtttagtccctttatcctgtgaagtaggggtcatcattagcccccttttacagaggagagaattgaggcttcgagagagagaaacttggccaggagtttccactcggtccgacgccctcggtgccccgccgggtgcatcaccaggtccttttaccggaatgtggtgggtgtcctgctggtctttgatgtgacaaacaggaagtcctttgaacacatccaagactggcaccaggaggtcatggccactcagggcccggacaaggtcatcttcctgctggttggccacaagagtgacctgcagagcacccgctgtgtctcagcccaggaggccgaggagctagctgcctccctgggcatggccttcgtggagacctcggttaaaaacaactgcaatgtggacctggcctttgacaccctcgctgatgctatccagcaggccctgcagcagggggacatcaagctagaagagggctgggggggtgtccggctcatccacaagacccaaatccccaggtcccccagcaggaagcagcactcaggcccatgccagtgttgactctaggagagaaagggttaaagcagtcccagccttagcccacctggtgggatggggagtgttaatatctctctggaggacaaatgacagaagggttcatataaacagtatcctgacacagtcatgcttcctggattttggagtcgaggctttctacagaaaagaaagttctgatggccaggcnt

SEQ ID NO: 730403 - DNA, 1452 bp, Homo sapiens
tagcactggaggtccagtaggcctggccggggccctgaggggcgagggtgcccgggcttcccacaccttccgcggcgactggagggagccgggccgaggaagcgaccgcgggtccgtgatggcttcttcgcggtctgtgtgttcacgagggccgggcagaggcctgcgagggttctcgtttgcgcttgcgggttagggctgtggtccggggaacccctgggcagcgcgggcagccctggctcgcggttaatcggggggtggagcgcggaagccacgccgcaggtccagctgctcggccggggcgagacggtgctttcgcggcgtgtgcttgcaggagcgcacagttcaggcgccgggacaagctgttggggtgtgagtgagctctccagaatggcacatggctccggggtgcccgggttaaaaggaaggatttgcacaccttccacttagggctcgggtaatcgcaaacttcctcccttaattggcttgcagtgctaaaaagcagatcgttctctctgaggttttcccaacagtacctcaagaaaataacatctgttttttgtaacgttccacggtattcggaattggctacagaacataataagtatttctacccatggcaaattccaccacaccgtcaaggctgagaatgggaagcttgtcatcaatggaaatcccatcaccatcttccaggagcaagatcctaccaaaatcaaatggggtgatgctgaagctgagtatgccgtggagtccactggcatcttcatgaccatagagaaggctggggctcacttaatgggggagccaaaagggtcatcatctctaccccctctgctgatgcccccatattcataatgggcatgatccctgagaagtctgaaaacagcctcaagatcatcagcaatgccttctgtaccaccaactgcttaatcccccggccaagcccatccatgacaactttggcattgtggaaggacttagggcccctcaagggcatcttgggctacactgaacaccaggttgtttcctctgactttaacagtgacactcactcttccactttcgatgctggggctgccattgccctcagtgaccactttgtcaagctcatttcctcgtacaacagtgaatttggctacagcaacagggtggtggcccatatggcctccaaggatgaatgccttcattttcattgtcattacttaagcatttatactgacttccagactccactgaaagacttgtttgaatgcatactttacgtttggaccatccattcacttaacagaaaagatacaggttgagcacttagtgtgtaatagggctttgtagcctgataatttatcctttattaaggattttggctgttgttttaaatacattgggctgccattgacatatttcagagaaggacactgaggcttggaagctttgcaaggcaagacagaagcc

SEQ ID NO: 730404 - DNA, 343 bp, Homo sapiens
agtatcccgtggttactgcttgacgttcccgtgaagacatcccctgcaccagggggtgggggagtgcgagctgaaagctgctggagagtgagcagccctagcagggatggacatgatgctgttggtgcagggtgcttgttgctcgaaccagtggctggcggcggtgctcctcagcctgtgctgcctgctaccctcctgcctcccggctggacagagtgtggacttcccctgggcggccgtggacaacatgatggtcagaaaaggggacacggcggtgcttaggtgttatttggaagatggagcttcaaagggtgcctggctgaaccagtcagcattaaccatt

SEQ ID NO: 730405 - DNA, 332 bp, Homo sapiens
ccgtgaagacatcccctgcaccagggggtgggggagtgcgagctgaaagctgctggagagtgagcagccctagcagggatggacatgatgctgttggtgcagggtgcttgttgctcgaaccagtggctggcggcggtgctcctcagcctgtgctgcctgctaccctcctgcctcccggctggacagagtgtggacttcccctgggcggccgtggacaacatgatggtcagaaaaggggacacggcggtgcttaggtaggaagaacggcgtgcttttcgtacttgtttcggtctatctttctgtctctctttgaaccctctttgccttcttta

SEQ ID NO: 730406 - DNA, 409 bp, Homo sapiens
  misc_feature (165)..(165): n is a, c, g, or t
aaatgtggggcatgagggaaaaggaggagccagcaacagttctgaggtatggtctgagcaggtggacggcagccgtttctggatcaggtggagttcagctctggcataagttcagaacacctatccgacatctatgtggaggccgggcacagtggctcacgcctntaatcccagctactcaggaggctgaggcaggagaatcgcttgaacctgggaggcagaggttgcagtgagccgagatcacgccactgcactctagcctgggcaacaagagcaagattcagtctcaaaaaaaaaaaaaaaaaaaagagctgcaacaaataacaaaaacacaagcagccagtggaagattaggcaaaggctgtgaacacttagttcctagaagaagagaaacacgtggctaatatgg

SEQ ID NO: 730407 - DNA, 404 bp, Homo sapiens
  misc_feature (165)..(165): n is a, c, g, or t
aaatgtggggcatgagggaaaaggaggagccagcaacagttctgaggtatggtctgagcaggtggacggcagccgtttctggatcaggtggagttcagctctggcataagttcagaacacctatccgacatctatgtggaggccgggcacagtggctcacgcctntaatcccagctactcaggaggctgaggcaggagaatcgcttgaacctgggaggcagaggttgcagtgagccgagatcacgccactgcactctagcctgggcaacaacagtgacttgtctcaaaaacaatagcaacaacaacaacaaaaaacaaaactgaaggtgggactgggaagacgtttgggaaagcagcctcgggtgaaggaggtggaatgagttctacgtcttgactttggggtg

SEQ ID NO: 730408 - DNA, 860 bp, Homo sapiens
attcttattccgtaccatacacaaaaaataactcatatttgattatagagctatatgtaaaaggtgagattagtaactaagatactaaaacatactacctgtacaactgcaagtaatataagtgggttaatcaaccataattccatctgtatatttctctacttagatcattatttctataataataataatcccctgcatagtaatctatcaatatctataatgctattttaaataaaactaaattagatggtgggtcaccgtcactctgatttagtggaaattcaagcaaaaatattattgatactccatctttctccttagatttttggtattattacttctttctatttttcattttttgagacacgttctcactctgtagccccaaatggagtgcagtggtttgagattggctcactgctgtctacagttccagcctcaagctatcctcccacattagcctcccaaatagctaggactacagatggatgccaccacacctggctaattgttgtatttttgctagagactgggcttcgccgttcttcccaggttggtctccactaattgcgctgaagaaatctgcctgcctaaacctcccaagctgctcaattacgggcttaagccagagcacccaccatcgtactattacttctaaatgtaaatttgacatttgaaggaaaaatatttacataatgtgctatataccaagatatgtgaataaataaacaatataaatggataatcacccttatgcctgtctgttgactgatttgactacattgtcagtaaggagaatacatgagatcaccaacacaacaggcatcattgtagagattgaagaattgagaccctgt

SEQ ID NO: 730409 - DNA, 465 bp, Homo sapiens; identical to SEQ ID NO: 346100

SEQ ID NO: 730410 - DNA, 263 bp, Homo sapiens
ggaagtcggtgtttggagaaaaggactcaggtttaatgagttaatctcacttggtgaatatgaaaaggcagcttgttatgcagcaaacagtcctagaagaattcttcgaaacattggtacaatgaatacatttaagggtaagcatttctctctgaaccttatatatgtatgaaaatttactactttttctctcataaaatagaaaaagcattaaactgggagactaaagatctaggccccagccctatctctaccatttactc

SEQ ID NO: 730411 - DNA, 579 bp, Homo sapiens
  misc_feature (353)..(353): n is a, c, g, or t
agaaaggcaaactttaaataggtggaaaagggcaaaagagcacataaaagataatgtgcaaaatctcaaagacagaaacgagcacagcactaacgaaagccagtgaaaaaacagccttgtcaaaaggtgtgatttctcaacagttagaaacaagccggctggagaggtaaaatgggactgagtcagagcaggctttgaaattagaatagtttggctcttatgtgataggaaacagtgagccatttcagagtctaggcaagtaaaagatgcaaaaaagagcttaagaacaatctaggggtgggcacggtctcctacttcgatccatcccagcactctgttctgcttacctccanaggcagctcaactgacgtgttaaaagcacttggggtccactgctcagaggtactgactttgacattgctaaatgtttttcgcgaagcacggagcaacgaataactacaaaatagagagaatacagatgaatgaatagcaaagagaaacagcattcaataaaatcacaggtataggcccatttcttttattcaattttattttatattattggtcgctagattccgg

SEQ ID NO: 730412 - DNA, 534 bp, Homo sapiens
  misc_feature (343)..(343): n is a, c, g, or t
gtatgtgtgttggctccgcttactgatgctccgttactgagctgcttactgatgctccgcttactcagtaagcgagcacagcactaacgaaagccagtgaaaaaacagccttgtcaaaaggtgtgatttctcaacagttagaaacaagccggctggagaggtaaaatgggactgagtcagagcaggctttgaaattagaatagtttggctcttatgtgataggaaacagtgagccatttcagagtctaggcaagtaaaagatgcaaaaaagagcttaagaacaatctaggggtgggcacggtctcctacttcgatccatcccagcactctgttctgcttactnagcggagcatcagtaagcggagcatcagtaagcggagcatcagtaagcggagcatcagtaagcggagcatcagtaagcggagcggtcacgcctgctgggggtatgttgtgttggctccgcttactgatgctccgcttactgatgctccgctactgatgccccttaccgcttactgaggctccgtactgaga

SEQ ID NO: 730413 - DNA, 226 bp, Homo sapiens
  misc_feature (2)..(2): n is a, c, g, or t
tnagcggagcatcagtaagcggagcatcagtaagcggagcatcagtaagcggagcatcagtaagcggagcatcagtaagcggagcggtcacgcctgctgggggtatgttgtgttggcaagaagaagaggaggcgaggaggtggcataggctccgcttactgatgctccgcttactgatgctccgctactgatgccccttaccgcttactgaggctccgtactgaga

SEQ ID NO: 730414 - DNA, 260 bp, Homo sapiens
  misc_feature (2)..(2): n is a, c, g, or t
tnagcggagcatcagtaagcggagcatcagtaagcggagcatcagtaagcggagcatcagtaagcggagcatcagtaagcggagcggtcacgcctgctgggggtatgttgtgttgtggttggcaggtaaataataatcttaccacctctatcaggtctatggataacactaatattatggatcaagacctaagtttagttttggtcttgtcattatcttagtttatgattccttgggactatttttttagtgtatattct

SEQ ID NO: 730415 - DNA, 193 bp, Homo sapiens
  misc_feature (2)..(2): n is a, c, g, or t
tnagcggagcatcagtaagcggagcatcagtaagcggagcatcagtaagcggagcatcagtaagcggagcatcagtaagcggagcggtcacgcctgctgggggtatgttgtgttgaatacataatgcttgtgtatcagacttacgttactgtcatcaccattaaaagaattgcagccttgtgccccttactga

SEQ ID NO: 730416 - DNA, 580 bp, Homo sapiens
ctccctgacctccagattagggtgtcaggcatgctttgtgttcctagacaccagtcagcatctcaagcttggcacatttaaaagcaaactccagatttgtccctgctacctccttcctcagtgtcctccttttcagaaaagggcaagtcctgcttttcatttgcttgggccacagtctttgggatcacctcctattcacaaccctcatccaatctatcggtgagttctgtaagctgtgccttcaaaatgttctcagaatgaccacttctcactgcctccaggctctgccttcaggttcaagccactgtcctccctactgagatcatggcagaggcctcctttctggcctcattcagccagagtgatccactgaaactagtcaggtgcctctacaactttgttcaaccctccagtggctttccatcatattcagggcaaatttcacagtcacagtctccacctgtgtctgcagatcatccacccctctctggcctcacttcccactacccttcccctcacccactcctcttcagcagtgcttgcttctctgctatcttttgaacaggctaagaccttttcc

SEQ ID NO: 730417 - DNA, 382 bp, Homo sapiens
agaggatggccactgaggggttgtctgggtcatgggaagaatccttcatgaataagattaatattctcatggaaatgaattctcactcttgtgggactggattagttcctgagagagtgagttgttgtaaagcaagcttcttcctagtgtttgccttcttttcactcattccctagcctttcagcttctccaccatgttgtcaggcagcacatggcccccaccaagagctgagcagatgctgatgccacattcttatactctcaagccaccacagtcgtgagccaaataagcttcttttctttataaattacctggactcaggtattctgttatggcgacataaaacagactaagataggaaagaaagaactagtcagctaa

SEQ ID NO: 730418 - DNA, 443 bp, Homo sapiens
acgttgacacttcaggagctggaagggtaggaatcccaaattctgttgcctaaggcagccagttgtcagaatggactttcctcattttctattatgaggcctgaggaaagacattcagttccaaaggctgtgcctatcctgttaaatagaagagagagggcccggcacggtggctcacgcctgtaatcccagcactttgggaggccgaagggggcgaatcacgaggtcaggagttccagaccagcctggccaacatagtgaaaccccgtgtctactaaagatacaaatattagccgggcgtaatggcgggcgcctgtattcccagctactcgggaggctgaggcaggagaatggcttgaatccgggaggcggaggttgcagtgaaccgaaccgagatcgcgtcgctggactccagcccgggcgacagagtgagactccgtccc

SEQ ID NO: 730419 - DNA, 457 bp, Homo sapiens
  misc_feature (39)..(39): n is a, c, g, or t
tgaaaatgtgggtgttacagtcatggacggtccgttctnttctatgatgccgtttcccacacgtggtacggtgtcgctatagcgacaccgtacacagacacacaaagacacacagtaacaaaccacagacacaaacacacagcaacacacagacacacacaatcacatacacagacactcaaatccatggaaatacacacactgctgagtagctaaggaacagagcttaattccaaggacctgggagtgccagcccctggaatccagcagaccccagcactccaggccagcccaccttggtgacgaagtctttctgggaacacagcttgtcaatgtagctcaggaggcccgggtctgggggcgtccagtcctcttcctgtggctgcttcactttgccctcttcccgttgtttctcgggctcccccgtggtacggtgtcgctatgggtaccgagctcg

SEQ ID NO: 730420 - DNA, 331 bp, Homo sapiens
gggactctagacgatccccatagcgacaccgtaccacgggggagcccgagaaacaacgggaagagggcaaagtgaagcagccacaggaagaggactggacgcccccagacccgggcctcctgagctacattgacaagctgtgttcccagaaagacttcgtcaccaaggtgggctggcctggagtgctggggtctgctggattccaggggctggcactcccaggtccttggaattaagctctgttctttagctactcagcagtgtgtgtatttccatggatttgagtgtctgtgtatgtgattgtgtgtgtctgtgtgttgctgtgtctgtg

SEQ ID NO: 730421 - DNA, 416 bp, Homo sapiens
acagagtgagactctgtcaaaaaaagaaagaaagaaaaagaaagaaagaaagggaaagaaaggaagaaagaatcaaataacaaaaagcacagtcagcattataagatatcagacatacccagcccagaggcagggtggagttggagatcatctagtccatcaaccaaatcaatttaggttgatttttttttaacaatttttttttttagccaagtcaaaaaaagtatttttagccttacttatatataactgtatcttttttggctcacttagaccattttatcaaaggagatcaaccacaaattcctgccggtttttagttgtaagaagctttttttattggcaggaaaactgggagaatgtgtaagttgttaagcagccaggccactctgtgcccagtattctggtaactattg

SEQ ID NO: 730422 - DNA, 452 bp, Homo sapiens; identical to SEQ ID NO: 188343

SEQ ID NO: 730423 - DNA, 2519 bp, Homo sapiens; identical to SEQ ID NO: 193771

SEQ ID NO: 730424 - DNA, 285 bp, Homo sapiens
aaatgaaggcatcctgacatgtgggaatgtcaagacacaagctctgtgcagttttccatgcatggggacagtgccctggcattccagaaatcctggcttacttatcaccacgctctaatcaactgcaaataacattttaaatctaagtgcaaagagaatgatcaggaatatcataaaatctgcatttatttaaaaaaaaaaggagctcacagtgaagtagtctcaagcaattgcttttttttttttcttttttttcttttattattatactttgtcagggggtac

SEQ ID NO: 730425 - DNA, 1405 bp, Homo sapiens
ttgccagtgtaagtggagtgaatccaccatcccttacgccacactgccattgcagacccaaatgggcacatggagaccagcaaccccatcccctctgtgccaacattgccaccattgtgaacacacatatgaatgccaaggcctggtgcctctctctgtgccaccactagcatgaacacatgtacagatgccaaaaactgccaccactgcaaacacacgctcagaggctggcagccctgtgcctgccagcagtgtgatatagtgccccacttctactggtgtgagtgtgagcaagaacactgaaacagcactctgatgatactgcaccccagccaacatgaatgcaccccagcacactgccactgctgctggcatgtgcaaatgaacacattccactgccaccatccctaaaagcgctttggctggcaccacctattgaaatattgtggttagtggtccaggaacacatcaacctctctggcacagctggtgtgaatgtaaattacttcagccagcatggaaagcagtttggtgatttctcaaagaacttaaaacagaattgccattcagctcagcaatcccattatttgttatctacccaaaggaatacaaatgtttctgccataaagacacatgcacgcatatgtttatcacagcactattcacagtagcaaagacatggaatcaacctaaatgcccatcaacagtagactggatgaagaaaatgtgccacatatataccatggaatactatgcagccataaaaaagaatgagatcatgtcctttgcagcaacatggatggagccagaggccattatcccaagcagagtaacacagaaacagagaaacaaatactgcatgttctcacttacaagtgggagccaaatattgagtgaagatggacacacagaaagaaacaacagacatgagttcttacctgagcgtggagggtgggaggatggtgatgatcaaataactaccaatcatgtagcatgcttcttacctgagtgacaaaatagtctgtacacaaaacacctgtgacatgcagtttaccaatataacaaacctatacatgtacccttaaaattaaaatacaggtttttaaaaaatcctcaatctaatggtctagaaactattggggaggggatttgttaaagattcctgaaatgttagcaaccaacagaccaagaacattgacactttgtaggtagttttagttcagattaatagatgcacatttgtttcacctggtaagtctgcagtcaggagctctgggagtcaatgctgtatgtttcaacaataaccggacggcaataacccggacgacaataacccggacgacaataacccggacgacaataacccggacgacaataacccggacgacaataactcggactacta

SEQ ID NO: 730426 - DNA, 551 bp, Homo sapiens
tgcacttagccacccctcccctttcctgtattcaaaggggctcagtagtgagcctgaaccatcaaccccaccacatgcccccgtcacccacttgggtggtgtcagagtagacctacgaaaacatgattcaaacaaggtccagcgtctcaaacccaaatgggcagaatagaacagagagttaacagacaccaacaccaagataacacagattttagaattatctgacaaggattttgaagcagccatcatttaaaaaaaagattcagtgagcaatcatgaacatgcttggaataaatgaaaaaaataggaagtcttagaagatggcagaatcaaatggaaattttagaattgagaagagtaaatgaaacaaaaatctcactggatgggttaaacagcagaatgaggagtaacgagaaaacaatcactgaatttaaagatgaaataaaaatctgagcggagaaaacagactgcaattggtacctgtgggcctctagctaaagacctaacatttgaatcatggctctaagaaagaggagagggagggtggggct

SEQ ID NO: 730427 - DNA, 570 bp, Homo sapiens
ccccgcattggcagcaacactccaatttttaaagcatgagagaagaaaagaggaaatagatggcataatactttcttcccacatcccaaagattgttggtatgtgcacctcactttggagatttaggtcatttaggtcaaaagaaacttgctattgaggaaagagaatctgtagaagtagggtttaagatttgcggggatggggaagggtttgggacactcactttggacatctaggttaatcagagttactgcataatggctccccttctattttgcttccctttatgtatgggtttgtttagacaaggagcagcatgactcttgtatgttgccatagcacatcaaataggaaaaaaaaatagcttgaagaagttggtgaggaaggagctatttaagtcagaactctcagagtgacaaactcaactaaaattaaatttcacaaaagtcaatttattagctttcataaacgataattgtaatctcctagggtgacagtggcctccggcatagctggatccagaagctcgagtgtgctgcctatgcgggtaccgaatcgatggtatcatgc

SEQ ID NO: 730428 - DNA, 619 bp, Homo sapiens
agaggaagtcaagctgtactgtttgatgatgatatgatcatatacctaggaaacctaaagactcctccaaaaagctcctagaactgataaatgaattcagcaaagtttcaggagacaaaattaatgtacacaaatcagtagctctgttataccccagaagcgaccaagcttagaatcaaaccaagaactcaaccccttttctgatagctgcaaaactaaactaaactaaaataaaatacttgggaatagacctaaccaaggaggtgaaagatgtctacaaggaaaacaactttagtatttttaatgggttaaaatgagaggcagcaggtacagcagaagaagtcagtgcgtgggcatccgcatccaatgggtactgcacctttgatggtaaggctttggttttgacttactaaattactaggtacgattattttctagtttttgtcattaaaccttaaaactactaagtaaccccttccatttcttgttaaatattgtaaaatttcatactctcatttatgctgcctgacgttagagtgtttgtttctattttgtgactaccttaaataatacctataaagagtaaactgttagtagtgtttttgctgtaattaaatgt

SEQ ID NO: 730429 - DNA, 571 bp, Homo sapiens
tgcaagcctccaagtgttctcttccaagtatggtcacacaggacatacctcatttctccaggaatgcattctgagaacacatatgaagtgttgtctactagggaagctcattagaggctcagtgaccatagcttttattgggggctggtcatgcaggcaccctttgcctagcacatagcaaaattccaggcttgcggaaggaaagcaggtgttcagcacaaaccccattgtttatacagtttagccacagtgagccattcttatcagggaatagtggcaactctcttgaaatccaggttctcagatgccagctaagggccatccttgaaggcaggcctttttaagtataacagtcttgggcctcaaatgtaaactctatatcaccttctcaaggcatttttctgttacttgctttttggtttcttatatgaatctcacttttttttaaaaaatacctcatactttttgctgaaacctacaaattttagataatatattgcagtgatttctggatactgctaccccctcctctactgtggggctcattggtattgtttacttctttgtttag

SEQ ID NO: 730430 - DNA, 402 bp, Homo sapiens
tttgtcccctcccccacagtgaggacatcggtgtatttacttgtttgcttcattttatgatacagaccttagaatttcagaattgccaaacccatgccctcccaaacaccaaaattaagtagaatttgacatttctttgtagttcttttatgtctttagactgaaagtatttattcaaaaagtattgtattcaaaagttgggtacatttcttttttcttcctgtgtagttattttaataagataaaatagaattcagtttatttgctttgtgtccaattttagtttttctcctacttctatttgattttactttatttcatgcataatatttaagttcccaaaagtcaaaacctctaaccctataaagaggtatactctgaatctcactccatcgcccaggc

SEQ ID NO: 730431 - DNA, 308 bp, Homo sapiens
  misc_feature (25)..(25): n is a, c, g, or t
ctagaggatccggttgtcgagatangatgaaaacagagcaggaaagccagattcataggaataggggacagggggaaggcattttgcttccattaaccatgtagtcatgaagatgactattagagttcaagagacaagggatctagcagagtgatgatcacaaagaccactatccaacatgagtaaagggatcctgtttgtagttcagaaggaaccatgccaccagggatatcttatgtgctgaacatggggggaaactcttccatccagaataatattgcagctaacactttaacacttattaagca

SEQ ID NO: 730432 - DNA, 158 bp, Homo sapiens; identical to SEQ ID NO: 198913

SEQ ID NO: 730433 - DNA, 755 bp, Homo sapiens
aggtagaggataggtctacggcctggaccctggttactccaatatttaaaagtcaggactggaaggaacgattgggacggattagccattgacgtagaagaaccaagaggtgtcccaaaagccaagtggagagagtttcaagaagagagagtgagcagttgtatcagaagctactgatagtccagtaaaatgaggagtgagaattgaccattgaaattagcaacaaagagattcctggagactttgaaaggaacaattttgatactgttgaggatgaaaatcggatcaaagagcaaaaaaggaagtggagacattacctataggtgacttgggagtttcactgtaagggagagctgagaaatggagtgggatctgaaggagaaagtggtgagatggtgggtttggtggtgagagcaagtgaagttctgttgcttctcttttcttagtggaaattgaaagcaaggacattagctaagtgaagaaataggagggggttttgggagcctaaggagagaggagaaggtctaagtcaccttagagagtgggagagtgaactgattagagaaatgaagtggaattgccaggcagtcctaaaggagcttcaggaaagaagtaggtacagagagttgaatggaaccagggtgtgggttttgctggatttgtaaatgaaagacgagaggaacagggagttgtggttatgtgcagagtattaccagtgacccttgggcttaagcaccttggggtccgccctgcac

SEQ ID NO: 730434 - DNA, 1010 bp, Homo sapiens
cccaaagatgctgtctggaagaggtagggagggaaaaacacatagccttacagaatggacatctggtccccaacgttatgtgagcatcttgagttatgacccactccagaaaatctgttgttcgtctggacactgacaaacctctccacagccccagggacaggaaaccctgcttgctaattaatatgcgactcaactccctttcctgtgatctgctgactcatgcaggagcatcctggcagtctgtggagcccttaggctgtgatgtgactcatctgcgagtctaacagacctggtttatctcagttatggctgagcaaaatcaagcagcgtccttaagctctcctgactacagttccatatctgaaaggtggggataatagcatctaccttgcatttgaaacgccgggcatgcatgctcagatgaataactaccacagcggtgctctctctgtgccaggaactgtcaggcgtgtttcattcatatttcatcttccccagtggggcaattctcaacccctaaagtcagaaataccatccgacccagcaatcccattactggctatatacccaaaggaatacaagttgttccgccatgaagacacatgcacgcgtatgttcattgcagcactactcacaatagcaaagacatggaatcaacccaaatgcccatcaatgatagactggataaagaaaatgtggtacatacacaccatggaatactatacagccatgaaaaggaatgagatcctatcctttgcagggacatagaaggagctggaggccattatcctcagcaaactaatgcaggaacagaaaaccagataccacatgttcttacatttaagtgggagctaaataatgagaacacatggacacatagaggggaacaccacacactggggcctatcagagggtggtgggtgggaggagggagaggatcaggaaaaatagaggtgtatctgtcaccagagttcctcccttcctttttctgtatttcctttactgtt

SEQ ID NO: 730435 - DNA, 796 bp, Homo sapiens
  misc_feature (166)..(166): n is a, c, g, or t
ctcacaatagcaaagacatggaatcaacccaaatgcccatcaatgatagactggataaagaaaatgtggtacatacacaccatggaatactatacagccatgaaaaggaatgagatcctatcctttgcagggacatagaaggagctggaggccattatcctcagcnaactaatgcaggaacagaaaaccagataccacatgttcttacatttaagtgggagctaaataatgagaacacatggacacatagaggggaacaccacacactggggcctatcagagggtggtgggtgggaggagggagaggatcaggaaaaatagaggtgtatctgtcaccagagttgcctcccttcctttttctgtatttcctttagtgagggatgatggtgggtgtggcaccagcagtcctaaagagctgctttgagatcacacttgtctgagacacctgtgccttttcaatatagagtcagctactgtagacagctaacaaaagatgaactaaaactcaattcagaaaaaaacaaaacagcattctcagagtaaaaatattagacctggaagcaaccttagaaatcatcatgctttagcagtggattttagaaataggaaactttttattaggtgagatgatttgcctgggattatgcagtagcaaaagcatttaagaatctggatttctgcctcagtctcagaatttcttgttacatgggtatattttatttttatttttatttatttatttatttatttatttgagatggagttttgctcttgttgcttaagctggagtgcaatg

SEQ ID NO: 730436 - DNA, 314 bp, Homo sapiens
aggatcccccctgcgcacagagttgtgctcagaaaaaaacaaaacagcattctcagagtaaaaatattagacctggaagcaaccttagaaatcatcatgctttagcagtggattttagaaataggaaactttttattaggtgagatgatttgcctgggattatgcagtagcaaaagcatttaagaatctggatttctgcctcagtctcagaatttcttgttacatgggtatattttatttttatttttatttatttatttatttatttatttgagatggagttttgctcttgttgcttaagctggagtgcaatg

SEQ ID NO: 730437 - DNA, 1068 bp, Homo sapiens; identical to SEQ ID NO: 202718

SEQ ID NO: 730438 - DNA, 347 bp, Homo sapiens
ccaggagttttaggctacggtgagccatcatcacaccactgtactccctgtactctagcctgggcagcctcgttctttagagtaagacactgtctctttaaaaaaaaaaaaaaagaaaaaagaaaaaaagaaaaggcttttagtgaatatatttttagggtagcaagtgtaatttttataaattgcattatttgaatctaataaataccctcaaagctgaagtcgaattctgattttgattgaaaatattttttacttaaaggaagagggatagaataaatgacacgattaaggaaaagacttcttgtataaggccggggttttttaaatgatttttgaatagttag

SEQ ID NO: 730439 - DNA, 372 bp, Homo sapiens
tctagcctgggcagcctcgttctttagagtaagacactgtctctttaaaaaaaaaaaaaaagaaaaaagaaaaaaagaaaaggcttttagtgaatatatttttagggtagcaagtgtaatttttataaattgcattatttgaatctaataaataccctcaaagctgaagtcgaattctgattttgattgaaaatattttttacttaaaggaagagggatagaataaatgacacgattaaggaaaagacttcttgtataaggccggggttttttaaatgatttttgaatagttagatggacaatacggaattaaaaaggtggtgtaaaaagttatacggggctgggcacagtgactcacgcctgcaatcccag

SEQ ID NO: 730440 - DNA, 582 bp, Homo sapiens
gcggcagcctcagcctctttgagcccctggaccactcgcccttcctatgtcctctctcttgccttgcagtgtttcttctatggttttcctgtcctgcccccacagggtgaatttcagctttctcttagaggcccagctcaaacatcacctcttccacaaggcaccccccgattcctggccctctccaggggcagtttcctgctgccaagggtggacgaaagcgatgatagccccagggcaggacaggctggctcacaagctcactatcaatgcgtctgaccggtgtctgcattctttgtgtgcctagaggatatcagagtgcaggcatcaaaacccagatctggccacccgatggctcacgcctgtaatcacagcactttgggaggtaggcgatcacttgaggtcaggagttcaagaccatcctggccaacatggtgaaacactgtctctactaaaaatacaaaaatttggcctggcgtggaggcttatgcctgtaatcttagcatttttggagggcaaggtggttggatcacgaggtaaggagttcaagaccagcctggccaagatggtgaaaccctgtct

SEQ ID NO: 730441 - DNA, 647 bp, Homo sapiens
cagactctcccatcagtatgtgaactaattttctctaatttattcggagtgactaagaaggacaagctgatgaagagaagaatcagctactagttggccctgatgggcccagtcttctcccatcaggatgtggcattgtgttctgtgcacagtagggcctcagcaaacactgacttgggaggagtattcaagctttaatatattcaaaagttgtccttggaaacacacctgatatctctggatggaaaatcccccccaggtttcaagcagtgggcgatgcatacacactttggcctctgctgcaaagagggaagaggatgcccttaaacgaaaggctttttctttcattctcagtatcaagaaacagacctataaaaagtgcccttcctaatggatatctgctcctcactctgagggcactgacttagtttttcgtgaaacttgagagaccacagggcttccgacatttgctggctgtcatgcagaagaggcaaatcacaggctacatgttctcgccttctgatttaataaggtgcaaactcatgggggaggctctaactgcagctttgtcctcaaggaagtctggggcttatcaggtgcaatgatccctctctaaggatgtgcaatactgatggggcgaagatggg

SEQ ID NO: 730442 - DNA, 365 bp, Homo sapiens
  misc_feature (21)..(21): n is a, c, g, or t
  misc_feature (24)..(24): n is a, c, g, or t
  misc_feature (31)..(32): n is a, c, g, or t
  misc_feature (38)..(38): n is a, c, g, or t
  misc_feature (42)..(42): n is a, c, g, or t
  misc_feature (44)..(44): n is a, c, g, or t
  misc_feature (48)..(48): n is a, c, g, or t
  misc_feature (55)..(55): n is a, c, g, or t
  misc_feature (61)..(61): n is a, c, g, or t
  misc_feature (66)..(66): n is a, c, g, or t
  misc_feature (68)..(68): n is a, c, g, or t
  misc_feature (70)..(71): n is a, c, g, or t
  misc_feature (75)..(75): n is a, c, g, or t
  misc_feature (220)..(220): n is a, c, g, or t
gctccagcagcctaacaaccnttnactgccnntgtacnagtncnagcnctagttncagccntgggnangnntatnctgacttcctctgatttggcatgtggagacactcctataaggagagtcaagcctgtgggagtagaataatctcattcccagagtcagaggagaagagacatgtaccttgaccatcgtccttcctctcaagctagccagagggtgngagcctaaggaagcgtggggtagcagatggagtaatggtcacgaggatccatgacccactcccaaagctcagactatgccaggctccctttctctctcttccccaggtccttcctttgggtctggttgttgcaccatctgcttgg

SEQ ID NO: 730443 - DNA, 390 bp, Homo sapiens
tggcggtcgagcggacccacccattctttgatctgcaggcaggcccttcgtttgtgctgctctgcgctgctgcttatctgtgtgtgctaaaaggggagggagtgtttctgtgcccattcccaggcaccttcgtgcagctgcaggcatctcccccacgcgcttccagcttcccttagtgtgcctaaagaaagggaaaggaatgtgctttaggcccactgttttcactggggcccatctatgtatgtggcttggtgattacccaggaacctcccaagtctgtgcccgagttgcttatctgtgttttacagcctgaaagatcaggctgctctttgttaggagaagtgatttctttgaactgcgtggtgtggtgagaaagggagcaatttctaa

SEQ ID NO: 730444 - DNA, 780 bp, Homo sapiens
cccaggctgccattgcaaaatgttgtgaaaatttcgggactgaaattgtaccctctgaggcttcagagactcatgcgttgactgagttcctaagataacaagagaaggaagaacattgaacgttgcttggagcactgctgttcccagcagtagttttcagtggaatacctgcatcaggattccctaaagtagttgctctaagtgcagatagtagaggtggagcccagaaatcaacattttgaatcttcaatgcaatgattttgatgcacgctaaagtctcagaataatgagttccagatcataaacatgtacgtgataccttcccaccctatttcccaggctgtgggggaagtaaattgcagtaaaaaaaatattgctcttattttattcccaaatagtgatggaatataatgactgagatgaaagacccacactaagaccaccaaccatcttcttaggaatcactatattggtactactcaagcaaaatttgctagtgaccacttctgggctccaggacctcagcccagcactcagtccctcctttcgcaggttcttgctcaatctctgggtcctgcttccaggtaggtctgcctttgctgtcccactcctgaatggctgtatttacctgcctgcatcctggctccaagtatccaagcataatccctcagatgaaatggtcatgctaatgaggaaaactgcccaagaccctgctggggggtagtgtttctgagactaatcatggcatggcatgggataattttgcactggcatgacttg

SEQ ID NO: 730445 - DNA, 1438 bp, Homo sapiens
  misc_feature (366)..(366): n is a, c, g, or t
tagagaggccttgagacatacaggtcttttaaaatacagtagaaacaccactgtttacgattatacgatggacattcataaaaagcataatttcttaccctattcattttttggtgaaacctgattcattgattttatatcattgccgatgtttagttcatttctttgccaattgatctaagcatagcctgaattatgatgttcctcagagaagtgaggtgggaaatatgaccaggtcaggcagttggaggggcttccccagccaccatcggggagtacttgctgcctcaggtggagacctgaagctgtaactagatgcagagcaagatatgactatagcccacaacccaaagaagcaaaaattcntttttatcttttgaaatccagtttcttttgtattgagtcaagggtgtcagtaggaatcaaaagttgggggtgggttgcaaaatgttctttcagtttttagaacctccattttataaaagaattatcctatcaatggattctttagtggaaggatttatgcttctttgaaaaccagtgtgtgactcactgtagagccatgtttactgtttgactgtgtggcacaggggggcatttggcacagcaaaaagcccacccaggacttagcctcagttgacgatagtaacaatggccttaacatctaccttaacagctacctattacagccgtattctgctgtccgtggagacggtaagatcttaggttccaagattttacttcaaattacaccttcaaaactggagcagcatatagccgaaaaggagcacaactgagcactttaatagtaatttaaaagttttcaagggtcagcaatatgatgactgaaagggaaaagtggaggaaacgcagctgcaactgaagcggagactctaaacccagcttgcaggtaagagctttcacctttggtaaaagaacagctggggaggttcaaggggtttcagcatctctggagttcctttgtatctgacaatctcaggactccaaggtgcaaagcctgctgcatttgcgtgatctcaagacctccagccagaagtcccttccaaatataagagtactcatgtttatttatttccaactgagcagcaacctcctttgtttcacttatgttttttccagtatctgagataatataaagctgggtaattttttatgtaattttttggtatagcaaaactgtgaaaaagccaaattaggcatacaaggagtatgatttaacagtatgacatgatgaaaaaaatacagttgtttttgaaatttaacttttgtttgtaccttcaatgtgtaagtacatgcatgttttattgtcagaggaagaacatgttttttgtattctttttttggagaggtgtgttaggataattgtccagttaatttgaaaaggccccagatgaatcaataaatataattttatagt

SEQ ID NO: 730446 - DNA, 1163 bp, Homo sapiens; identical to SEQ ID NO: 398426

SEQ ID NO: 730447 - DNA, 1012 bp, Homo sapiens
gaaaatagaggatcccgtgctgcacaaaggatgcctggaatctcttcttacgggccacccctcagccacagctgtggggccagcgaagtgagagcctgcccagaggggccaagtccctgtcaggttacaaaattgttaagccaacccctcaccaaacacagggcattattagtaaacaggtgaggaaaatcctctaggtcggctagctggacgtgcaggactgagggttcaacttcacagcctgtctacagcaccagccctaccatcactgtggattaatcacccaccaaatcctacccatcccaattatgaaaaaaatgacgagcgtccagtgcaatgcccatctccaacctctgtgcagaggaagcctggcctctccctggagcaggtccttgttcagaggattgctccaggagaacctcgtccctcacccaggtcagcatttcagaaggagacacctgatctgcctctatcgctgccacacaccatgctatgcaggcttggactgctcagaaatctcttgtgggagccacattatttttcctgcagaacagaattatctagaagggggtaaataatagtttctaaggtggtatctgatcacagaataaaatatgaagtgagatgaagtatacagacgggctcagagacagcctgtattcactgcagcactggctctgaaggctgctgggtaggaacgtgagcaggagctggggtcccctgtgctgtttctgcctctgctcatgattctctttgggaggttcagctggtaatgtcatctctgctcactcaggtccttgatctagagaactatttcagtatttgccacccaccacaagcccacatcctggggatgctgtgaacattcctgaacctgtgaagtttcccaaatctctcagaactagagggcctacacagggaggggccatatgccttttcctggtagacagaataaacaactgttaagaggcatcctttgtgcagcacgggatccatgcctataatcccagca

SEQ ID NO: 730448 - DNA, 895 bp, Homo sapiens; identical to SEQ ID NO: 176748

SEQ ID NO: 730449 - DNA, 422 bp, Homo sapiens; identical to SEQ ID NO: 180148

SEQ ID NO: 730450 - DNA, 262 bp, Homo sapiens; identical to SEQ ID NO: 180149
  misc_feature (135)..(135): n is a, c, g, or t

SEQ ID NO: 730451 - DNA, 295 bp, Homo sapiens
tcgtgaggggtcaaacataggtacatagaataattacagtataagtctgaaagtgaaaacgccagaagatggattttttttttaatgcaatggcgattcagaggaaggaaagattctttcttgctgagggaaatcaaggaagtcttcctgtaggaggtagtttctaaaccttatattgaaagatgtagatcctggagagacggaaaaaggcattccaggcagatcactgtgagctggaaagccagtgatgctgtggcaaaatgtattttttacagaaaatagatgggtatctccc

SEQ ID NO: 730452 - DNA, 523 bp, Homo sapiens; identical to SEQ ID NO: 300843

SEQ ID NO: 730453 - DNA, 513 bp, Homo sapiens
  misc_feature (471)..(471): n is a, c, g, or t
caggcgtgctattaggtgagaggctattattatatcctatatacagggaggacaaggaggtctcactaatactctgctagctgagtagacatgaagggaataaggcataacatattttgaggattagcattccaagcaaagtgtaaaactacaaaaatcctaaggtagaagcacagttgatatattcaaagagaaataaggaagacaacatggatagactagggagcatatttgatgctgaggtcagaaagttaaggggtagggatagggataggggctagagaaggtagggccttgcacatcattgaaagaacaggggatttcctttgaaagagatgcaaaaaatcagccgggcatggtggcgggcgcccgtagtcccagctacttgggaggctgaggcaggacaatcgcttgaacctgagaggcggaggttgcagtgagctgagatcgcgccattgcactccagcctgngcaacaagagcgacactctgtctcagggggaaaaaaaaaaaa

SEQ ID NO: 730454 - DNA, 117 bp, Homo sapiens
tttcaatgtcctcgcaaaggtttaagcaaaagccttagctttgccactagcattcctacaaagtgttaaaagcacacttcaggccgggcgtagcagctcacaactgtaatcccagca

SEQ ID NO: 730455 - DNA, 536 bp, Homo sapiens; identical to SEQ ID NO: 183308

SEQ ID NO: 730456 - DNA, 511 bp, Homo sapiens
  misc_feature (477)..(477): n is a, c, g, or t
tgctgggattataggtgtgacccaccgcgcccggccagctccatattttctgctgcctgaattgtaattattctattcctgattttatttgctgattccattgtttttactagttcatattaaatgctaatgacagatatctttacctaaaacattctatttctcttgtcatgagcattatgaaacaaacctacaattgttctccattacctagtttatgacaattaaactcttctttcaaagaaataaacaacatggccaaaatactttccagcacagttgtagcaattcccacctcctccatcagcagtatgagagttcttgcaccatattctcttcaacacttggtattatcagtctttttcatttaagactttctaggggttgatgtaatgctatcctttgtggttttaatttgtattccctggctactaagaaggttaaacctttttttatgtttattaaagctgattcctncttttgtaaaatgatgctctcccatttctattct

SEQ ID NO: 730457 - DNA, 667 bp, Homo sapiens
attctaaactggaaaagatttctcccccttaataccatggaccttatagcatgagctaacactatatgaattttaatattaggttcattttaccacctaaaatgttttgagtattgaaggtatatgatttcagcattttacagtccaactatgacacagtcatgtggtatggatcttgaggacagccttctcatgaagctccaatgtactaaaatattcaagtcagtaagaaccatttctttctggatgtgaatataatttaacaattactgccttgcaaagtatataatcctagagtcaaaccgttatataaaaaaatttccctgtagatatggcaaaattcaaagatgaaaaacagcccctaaaacaaattgctataaactctcttaagaactcattgtgataaaatatataacacctcactcaagaaaaaaaattaacacattcacaggatgatctctatcaggacttaagaagtgaaaaatttgttataacattggagggctgatttgaaaagaatgtttccttacccttctgaaccctgttttgcaaaactatacatcatttctaagtagagctttaccaatagaagacattagtccttgagaaccctcagcaaagggtattttgtctttcaggagtaattttgtcatcacattctatgctt

SEQ ID NO: 730458 - DNA, 701 bp, Homo sapiens
ccccttcaccttctgccatgattgtaagtttcctaagacctccccagaagctgagcagatgtcagaatcatgcgtcctgtacagcccatggaatggtaagccaattaaaactcttttcttggctgggtgtggtggctcacacctgtaatcccagcactttgggaggctaaggcagacagatcacctgaggtcagaagttcgagaccagcctggccaacattgtgaaactccatctttactaaaaatacaaaaattagccgggtgtggtggcatgcacctgtaatcccagctacttgggaggctgaggcgggagaattgcttgaacctgggaggcagaggttgcagtgagccaagattgcaccactgcactccagcatagacaatgaagcaagaaaaaaaagaaaagaccttgtctctaaaaagagagagagagaaaccctgcatggacctccattcatatggccgttctgttactagaagggtccagaccaacacaagagcactaggagccaaagatgaaattcacaaaagagcaattatgagaaatgggagaaagatggagggactgcaacatagggctaatggaagttttagaaaaacagcagaaaatcacagagaagcaatatatgatggacaatcaatgagaattttcaaaaactaggctgggcgttttggctcatgcctataaacccagcactttg

SEQ ID NO: 730459 - DNA, 590 bp, Homo sapiens
ttgctgtcccagagtatctccatcaaccctaaattattatggaactcctaacaattaataagaaaaatatggaaattttaggagaagaaaatgcttcttgaaaacatatgaatcagcataaatcagagaggaaatctgaatagttaacaagaatgcattataataagaaaaataaacagttaaaacatccgtatatcattttatgtccatattgttggcaaaattagaatgatgaatagtaacacgtattggtaaagatactgagaaaaagaatgcttatatatcgccattgggagccttaactaatgaaacaattccagaagacaatttgttaatatctactttgcttaaatatctatatacctgacaacccagttattttactcttggtatatatattgcaaataattctcataagacataagtgaatatgaataaggacatttatttgggttactggctagctgaatataagctgggttcctcttactaagagaatacaccattaaaagttggtggatgcagtctagggaaaactgtgaagcactgaagcaacataataaatttagggttgatggaagaggaagatg

SEQ ID NO: 730460 - DNA, 570 bp, Homo sapiens
tgtgtctgtgtgtacatgtattgtgtatgtttgagcgtgtgtctgtgtgtatctatgtgtttaagcatttctgcacatgtctgtgtgtgtacacatatttgtgtgtttgagcaattctctgtgcgtgtatctgtatgtgtttaagcatttctgcgtgtgtgtgtacacatatttgtgtgtgtgagagcagttctgtgtgtgtgtgagtgtatctgtgtgtgtttgagcctttctgtgtgtgcacatgtgttgtatgtgtctgttttacgtgtctatctgtacatgcacatatgtttcagctgaaaagagtgcggaggggtaaaggtgactgtgagaatgagtgtgtactaggagagctgtgtgtgggacgctgcgtgtggctgttggaaagtaggtgtgaaagagtgtgggtgtgtttgtgagcctgtgtgtagatggtgggggtctgtgagggtagcgggacaggctgactgtgtgtgtgcttgagccaacgctggtatgactgtgattgaaagtacactcgttgatgtggctatgtttgtgttggcataactgtgtatcagggtgatg

SEQ ID NO: 730461 - DNA, 177 bp, Homo sapiens
tttcaagatcctcagcacacacacagtcagcctgtgtgtagatggtgggggtctgtgagggtagcgggacaggctgactgtgtgtgtgcttgagccaacgctggtatgactgtgattgaaagtacactcgttgatgtggctatgtttgtgttggcataactgtgtatcagggtgatg

SEQ ID NO: 730462 - DNA, 428 bp, Homo sapiens
tcactcagtgaagtaaaacccacacaaatttacctttgggaaaggtgttgggcgataacatcactatgttatccccaacaccataccccaaagtcagttaggtgatctgcaggtgctttcgcagtttcagaggaaaaatcaatgcagtcattttattcttacgtattttattaattaaaaatcgtgtgaatcattattgttgtaggaatcctgttattaatcatctttaagattatatatatgccaaaaagagtgttaatcactttgtcttggctagtatttggtcagctgagtgcagttcacctcagctgatatatttttccattatctgccattcttattcacaaattttcattgattataggtattctacgccaattccaaaaaatagctcaatggctcagtgttgggcgataaaagcagagata

SEQ ID NO: 730463 - DNA, 628 bp, Homo sapiens
gttcttcctgtagggctgaagcagtgcctactcgatagaatcagtcatcatgcaaataaaagccacctgagtcaaaggcaaagccagagtgcagcttggagcaaagaagttaaaagcatattggcagaggaagagccctggcattccagcaggagctaacaggaaaaagaaaatcaatggcagtagccctgacacattcacttctggtggttaccactcacctggggatgtgagtctcggcgggccaggctcctggggacagggggcccaaggggcagtagagggttcgcacatctaaggaggagaagaagcatgagatacatctggtacagaagcttgggaggagcttgttcaaactcaaaaaccagacggctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacg

SEQ ID NO: 730464 - DNA, 545 bp, Homo sapiens
ttaaaagcatattggcagaggaagagccctggcattccagcaggagctaacaggaaaaagaaaatcaatggcagtagccctgacacattcacttctggtggttaccactcacctggggatagccagtaccaagaactagcagtagccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacg

SEQ ID NO: 730465 - DNA, 583 bp, Homo sapiens
aggaagagccctggcattccagcaggagctaacaggaaaaagaaaatcaatggcagtagccctgacacattcacttctggtggttaccactcacctggggatcaacaggtatctacggggagggccgtgcatcctctactaccctgcaggatctggagagccagtaccaagaactagcagtagccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacg

SEQ ID NO: 730466 - DNA, 355 bp, Homo sapiens
gaaatggaactacagttagtggggcagtagagccatgggaagggctgtattcactccgagaccaggacattctgtgtagacacagaagaacaaacactaaggacaccttagagaccagtgcaagaagtgacattatggtgtgtgtcggggagagacagaaagataacttggctctagaaatggaatgaaataaaccctcctttaacacaggaagaaaaggagagagaggaggtgaaaaagagagaagcagtgataaaaagagtatacaaaaacaacttaggaggttaaacaagaaatcacaagattaggaataaacaacttggcagagccgaggaattcagtcatagctggtctt

SEQ ID NO: 730467 - DNA, 338 bp, Homo sapiens
gtggagcaagctctcaacgatctgttcccttttagttacaggaaacttgataatgaagatctccaccctggtcaagaacagaggaaagacctaagtaagtcttattatatttttaattatttaaaatatgctttcatttatgattgaagactattttacaagtttgtctgtttctcataaactatttaataccagaattataattgcctgccaatttgtctccatgtctgcttctcccacaaaacctagagctccttgaggataagaactatgtatatatcatatatctttgtatcaccagtgttttacatagtacctggccacacgttgagaagctt

SEQ ID NO: 730468 - DNA, 312 bp, Homo sapiens
gtggagcaagctctcaacgatctgttcccttttagttacaggaaacttgataatgaagatctccaccctggtcaagaacagaggaaagacctaagtaagtcttattatatttttaattatttaaaatatgctttcttgtataaggggggccgggtcatcgcgacggggcttttacatgaattggacgactgtaacaggaggatatccgtcgcgcgatgcgacgcagtgatcggttcgcctggcacaacattggagcttcgtcttgccgagagatatccggtgaggactagagatatattgcgtccagcagta

SEQ ID NO: 730469 - DNA, 1971 bp, Homo sapiens; identical to SEQ ID NO: 197315
  misc_feature (1409)..(1409): n is a, c, g, or t
  misc_feature (1625)..(1625): n is a, c, g, or t

SEQ ID NO: 730470 - DNA, 326 bp, Homo sapiens
gcactccctaaggtcaactgttttgagattggaaaagctcttaagcatagaagaggccaggcacagtggctcatgcctgtaatcccagcactttgggagactgaggcaggtgtaagccactgtgcctggcctcagattaatacattttaacctaacattccacctttaacaaataagctaccaacaatttagtatgatcctaaaggtatactattggaaaagtctagcatataaagtaacatcttttttttttgttcggagacacagtctcgctctatcccccaggatggagtgtagcgcgcaatctcggctcactgcaacctctg

SEQ ID NO: 730471 - DNA, 255 bp, Homo sapiens; identical to SEQ ID NO: 209222

SEQ ID NO: 730472 - DNA, 413 bp, Homo sapiens
gtggggggtgtataatgaaattactctgtttaggaggatgaactgatatttattttaacagcaacattgaggtatcacatttattacatggacctgagcttcaatcgtagtaaggaaaccagcccaggaaagtcgttccatcactagccagaagttacagggcaaaattatagcttaacttttggaaggcaaaatggagtctctgtcgcccaggctggagtgcagtggtgagatcttggctcactgcatcttctgcctcctgagttttagcagttctctgcctcagcctcccaagtagctgggactacagccacgcaccaccacgtctggctaatttttgtatttttagtagagacggggtttcaccatcttggctaggctggtcttgaactcctgacctcgtgatccacccg

SEQ ID NO: 730473 - DNA, 829 bp, Homo sapiens
ctgcccaaacctccctcactctccaaagtctcatttcaaatgttgcctttccctgaagcttctcccggaatgacccatctctccctcctcattctgatcatttcctctttgaattcccgtagtgttaggtatgccctcctcttccagcactgaatccagccttgcctcgcattagagtcatttgtacacctgaccttaatccccctgagggcagggatagtttgtgtttatcccaaagtcctgaaacaactagtacagaacctgagacacaggaaggccccagaattgcctgccgaatagaacagtgatagtgctgaatttggttcctcctttaacctgtgtgaccccagacgtttgttttctatgaagcctcaaaacatggttatgtttcctaatttacaacgaacacatggaaacccatgttttgaaaacgggggtggggaggatgaactgaaggcagcctcttcagccaagttccaaaggccaggtggcccactgtgaaccttgtttaaccacacagaacatatgaatagctacaacaagggatctaacagttaccagaatgttttcagaaaggtgacttcagaagtgccaagcttcaggaagacctggactgagaagggatcagacaactttaggaaagcaggtaccaaacagcccttttacagtttacacacaggccttggtgtcagaaaaatactggtttgagtactggttatgcatcagagatgccactctggacaagctccttatgctctctgggactctgctttctcatctaaaaaatggggatcacctgaggtcaggagtttgagaccagcctggccaa

SEQ ID NO: 730474 - DNA, 667 bp, Homo sapiens
gaggctgaggcaggagaatcatttgaacctgggaaacaatggttgcagtgagccgagatttgccactgcactccagcccgggagacagagtgagattccatctcaaaaaaataaaaaaaaaaaagctacttgggaaccatttgatgcattcaagtcttgctgttatgccctgttaggtgggtattaggcagtgtgcaatctaaggctaattttcccctctaatgaggcaagaccttgcttagtcctctacccaatgacctgtgaattctgaacaggcattgttcttggccctgtctgagtgtcaagcactattccaatgcattcagatggttctttccctagaagcaagtgattatgtcacacgtgtatgctgatgtactctgctacatactccaggggttcctctgcagatctccggggttctctctctgtgcaaaactctctctctggtacccttccttataagctgcagttaccttgttctttctggacttagctctgttacaaccaaggaagtcagctggtctcttgtcttagttctccttccctgtgtgatgacctgataaactctcaagtctgtaagctaagcaattgcagggctcacctcacgtttaccatctctcgaacactatcttttgtcacctgatgtctagtgtcttgaaaaaaa

SEQ ID NO: 730475 - DNA, 2724 bp, Homo sapiens; identical to SEQ ID NO: 412753

SEQ ID NO: 730476 - DNA, 412 bp, Homo sapiens; identical to SEQ ID NO: 395745

SEQ ID NO: 730477 - DNA, 656 bp, Homo sapiens
ttatgccatttcaagttatcttttagctcttctaataccttttcaactaattccatcagtagaatcacccaatgggggttttgttttcttgactggaccctgactaatacagtcccaaggaaagcaatctatagcctataccaaagacataaaagagagcaaaccataaaagaggaattgataataatgaagataaagtgaaaatctctaacatatttaatcaactttctagaagcatataatagactagatgatgacaatacagtatataaagagaaatggttcagcatttttcagaattactgaattctatcaattctcaaactcaggaagtccaatgaatcccaagcagaataaataacaatttctaaaaatccacacctaggcacatcctagggaagctgaaaatcacaaaacaattttaaaagcaatcagagagaaaatacaatacccctgtaaatgagctgcaattagcatgataacagactgatcaataggaatagtggaaactaaagacagtgcaacaacatcacaataggccaagagaaaaatactactggcataaaattctgtatacacagcagaataatcttttcagaatgagggtgaaataaagccattttcagacaaaaagaaagaaactgaatctgcacact

SEQ ID NO: 730478 - DNA, 1006 bp, Homo sapiens; identical to SEQ ID NO: 337544

SEQ ID NO: 730479 - DNA, 361 bp, Homo sapiens
taccattagtgcggaatgcctgcctgtgcgacctcgacagtctcagcgctggtttatatcatggccagccccttctccatcacctccaagacttatcctcctgatctcaccagtgtcttcatctgggagacactcatggcagcctatccttctcttcattctctcatattgatcatggggattcctagggtgaagcagacttgtcagaagatcctgtggaagacagtgtgtgctcggagatgctggggcccatgatctgggaagaaaagtgtggtcaggacactcttgggacgctcttttgatagctctctataagggagctgctttccatgtcttttaagattttccttcttttacacca

SEQ ID NO: 730480 - DNA, 279 bp, Homo sapiens
gttcactctagagtatccccatctatactgacgcggaggtaggattggtgctgtgggtgaaagagtatgatggggaagggacagacgaggtcagtaggtcagtatagataggtcagtatagatacagtatagataggtcagtatagataagtagtatagatagcgtcagtatagataggtcagtatagataggtcagtatagataggtcagtatagataggtagtatagataggtcagtatagatagagtatagataggtggtatagataggtcagtat

SEQ ID NO: 730481 - DNA, 778 bp, Homo sapiens; identical to SEQ ID NO: 360188

SEQ ID NO: 730482 - DNA, 348 bp, Homo sapiens
tcaaaagagctgctgcagaagaatccaattttcctgaacgaagttcttctgaagtctttcttgtagatgagactctaaaatgtgacatttcactgttacctgaaagagcaatattacagattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatctgtca

SEQ ID NO: 730483 - DNA, 964 bp, Homo sapiens
  misc_feature (26)..(26): n is a, c, g, or t
ggtcaccctcttctcaaccctggcgnacgttagactctcttgaggagcctctcatttagagtctaatttaattgattcaggtagtgtattttttttaacgctctgaggttgattccaacaagctaccacagttgagaactactaggctgtagacagtgtttccaataaccattgaagatgtttggtttttgagcagaagtggaccgagacgtccctgaaaggggtgtatgactctgtgtgttggtctttcgccttagcaagagggatatcaagctggcagttgcctactattgctattatctgtccccaccgccaggccttctttctcattggtgaggaccaagctttctcttttcccggcatgctccgataccctctccctgaagacaggaggtcagtggaattgcctcattttgattggtggaatcatgatttacacagttgtagatgaagctggcatgagacttgatacaggactgccatctctaggtctgggacatgtgccccggagactggtggtctagaggctaactgtgagactgtgtgtgctttggctttgcccggtggggtgtgggagcttggagaccaggtgcttctgggactgtcctctctgcaggcctccaggatcatgtggtatgtcagcaccaggggcgtagccccacgggtcaactttgaggggggcctcttctctgggtatgcacctgacgggggctctttatgcctgaagagctcccacagttggcagagagaccctgtgccagtggagcacactctcctatctggcttggtgaagagctgtgtgcctccccaatggctccgagctccctccaaagatgattttggtctggtcgccggccttagaatccggccaaagagggccctggcccggtggaaaggcaacttggcccgggagggccaattttaggggccgttgcggaaagccgggtctcggaaggaacttttg

SEQ ID NO: 730484 - DNA, 318 bp, Homo sapiens
cgacgagcatagaatgtagagagaggaatgcatcacctacgcctccctaagaatggtagtactttcagtaacaatagggaggtcaagattataagggaaattaatgacatctgttttcaggtatcagtacctcaagagattaaacatgataattaaagtgagagccaaaagggttttgaaaaagttgggcaacatgatttgtgagtagtggagaggcatgtcctagttacgcagtgataaatagtcttgcatacagttcgtgctgttcaattctgctcacccatgggcatgttcggaagtttgtgttgaaacatgcat

SEQ ID NO: 730485 - DNA, 280 bp, Homo sapiens
cgaaggctttatgcccagcctgtccccttatttgagtgagttggaggtttgtgcaagattttatccaagtggaggtttttccatctgtgtagccacgggcatgtctccaggcacaacgccacgtgctagttcccttactggttcctgcagcctgatttccccccaccccaggctgctttctattttacgtggggataaggctctgaccttgggccgggggctctccaggggctcttcccttgctgtctacctaaggcaagctaactcctttcgtcccccg

SEQ ID NO: 730486 - DNA, 280 bp, Homo sapiens; identical to SEQ ID NO: 673252

SEQ ID NO: 730487 - DNA, 319 bp, Homo sapiens; identical to SEQ ID NO: 673255
  misc_feature (57)..(58): n is a, c, g, or t

SEQ ID NO: 730488 - DNA, 232 bp, Homo sapiens; identical to SEQ ID NO: 673258

SEQ ID NO: 730489 - DNA, 306 bp, Homo sapiens; identical to SEQ ID NO: 673260
  misc_feature (33)..(33): n is a, c, g, or t
  misc_feature (93)..(93): n is a, c, g, or t

SEQ ID NO: 730490 - DNA, 129 bp, Homo sapiens; identical to SEQ ID NO: 673262

SEQ ID NO: 730491 - DNA, 403 bp, Homo sapiens; identical to SEQ ID NO: 673264

SEQ ID NO: 730492 - DNA, 201 bp, Homo sapiens
ctaaatggctgttacctaaatggctgtacctaaatggcaactcgtgatcgccaaatccagcagccatttaggtaacagccatttaggtaacagccatttaggtaacagccatttaggtaacagccatttaggtaacagccatttaggtaacagaatctaggtgacagccatttaggttcagccatttattacacattatac

SEQ ID NO: 730493 - DNA, 396 bp, Homo sapiens; identical to SEQ ID NO: 673266

SEQ ID NO: 730494 - DNA, 317 bp, Homo sapiens
agatgcatacaccacatgaaacgtcctattatctgtaggctcattcatttctctaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagaatctaggtgacagccatttaggttcagccatttattacacattatac

SEQ ID NO: 730495 - DNA, 324 bp, Homo sapiens; identical to SEQ ID NO: 673268

SEQ ID NO: 730496 - DNA, 344 bp, Homo sapiens; identical to SEQ ID NO: 673269
  misc_feature (1)..(1): n is a, c, g, or t

SEQ ID NO: 730497 - DNA, 265 bp, Homo sapiens
  misc_feature (1)..(1): n is a, c, g, or t
ntcccaagagcacaagcaacagcgcaaaggagagaagccccggtctgcagtcatttaggtaacagccatgttaggtaacagccatttaggtgacagccatctaggtaacttccagtttaggtaacagccatttaggtaacagccatttaggtaacagccatttaggtaacagccatttaggtaacagccatttaggtaacagccatttaggtaacagaatctaggtgacagccatttaggttcagccatttattacacattatac

SEQ ID NO: 730498 - DNA, 347 bp, Homo sapiens; identical to SEQ ID NO: 673271

SEQ ID NO: 730499 - DNA, 268 bp, Homo sapiens
gagagacctctagaggagcctgttctgtaatcgataaaccccgatcaacctcaccacctcttgcacagccatgttaggtaacagccatttaggtgacagccatctaggtaacttccagtttaggtaacagccatttaggtaacagccatttaggtaacagccatttaggtaacagccatttaggtaacagccatttaggtaacagccatttaggtaacagaatctaggtgacagccatttaggttcagccatttattacacattatac

SEQ ID NO: 730500 - DNA, 577 bp, Homo sapiens
atgttagaagataagctaagtggacgtgattgtacgatacttgaataaactacgcttacacagaaaacatttctattgtgtttctatctacagtatttagcacagtgcctctaacattatagatactctctaaataggtgtagatcaaatagatgtgtttaacttatgaaatttgataaagatagcctgaaagtgtaggaatgttcttctcagttatagtttaagtagtcaggataacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccattaggtaacagccatttagggtacagcctgtgag

SEQ ID NO: 730501 - DNA, 498 bp, Homo sapiens
atgttagaagataagctaagtggacgtgattgtacgatacttgaataaactacgcttacacagaaaacatttctattgtgtttctatctacagtatttagcacagtgcctctaacattatagatactctctaaataggtgtagatcaaatagatgtgtttaacttatgaaatttgataaagatagcctgaaagtgtaggaatgttcttctcagttatagtttaagtagtcaggataacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagaatctaggtgacagccatttaggttcagccatttattacacattatac

SEQ ID NO: 730502 - DNA, 737 bp, Homo sapiens
atgtaaaagacacatgtacacaggcaatgtatttctcttactttctttaaaaaacattttgttatttaagacaatctgtaacaaagtataaagaatgaatacatgttctgacagcaactggataccttgctagtagaatacaaaatggtagagccactctggtaaacaatttgacagtttcttacaatgttaaacatataattaccatcttactcagcaaaactattcctgagtatttccccactggaaatgaaaacatgttcacatgaagacttgtaattcactgttcagagcaactttattcacattagctgaaaactggaaacccaaatttccaacagtaatgtgaatggataaactgtggtatatctaaaaaatggaagaccgttcaataataaattaggaagaactaacctgatacatgcaacaatatgcatgaatctccaaaacattaggcaagagaaaaaagtcatatacccagccatgtgaataatcactgatgccagactccattgataggtaattctagaaaaggcaaactattgtgacagaaagtaaatcagtgtttgctaatggcctatggtaggaggaagggattgactgcacaggggtatgtgggaatttgggggtgatggaaatgttttgtattatgaatgtgatagttgctagaagactatatagttatcaaaactcatgattggatacttaaaatgggtgatttgctaaatgtaatttat

SEQ ID NO: 730503 - DNA, 400 bp, Homo sapiens
  misc_feature (164)..(164): n is a, c, g, or t
  misc_feature (171)..(171): n is a, c, g, or t
tagctgttccaggggatcccgcataagtggatgctccggagggaagagtgggggaaacaagaagagcgatggtgtgaaggaatcctcagagagcaccaacaccaccatcgaggatgaagacaccaaagtgcggaaacaggaaattataaaagtgacagagcagntgattgnagccataagcaatggagactaagagtcctacacgaagatgtgcgaccctggcatgacagcattcgaacctgaggccctggggaacctggtcgagggcctggacttccatcgattcaattttgaaaaccttgtgatcccggcacagcaagcccgatgacaacaaacaatcctgaatccccaaatccacctgatgggcgatgagtcagcctggattgcataccatccgcat

SEQ ID NO: 730504 - DNA, 433 bp, Homo sapiens
  misc_feature (197)..(197): n is a, c, g, or t
  misc_feature (204)..(204): n is a, c, g, or t
tagctgttccaggggatcccgcataagtggatgctccggagggaagagtgggggaaacaagaagagcgatggtgtgaagaaaagaaagtccagttccagcgttcagttaatggaatcctcagagagcaccaacaccaccatcgaggatgaagacaccaaagtgcggaaacaggaaattataaaagtgacagagcagntgattgnagccataagcaatggagactaagagtcctacacgaagatgtgcgaccctggcatgacagcattcgaacctgaggccctggggaacctggtcgagggcctggacttccatcgattcaattttgaaaaccttgtgatcccggcacagcaagcccgatgacaacaaacaatcctgaatccccaaatccacctgatgggcgatgagtcagcctggattgcataccatccgcat

SEQ ID NO: 730505 - DNA, 507 bp, Homo sapiens
  misc_feature (426)..(426): n is a, c, g, or t
tagtcgactcctagagcgatccccgtatctctaacattaaacaaacatacataagtaaacctttaattagtatacactcaaggtacatacattgttttcctttctccttctaaagcatggaagagattttttttttaaataagctgacaaaatatgaaaattaaaagaacacaaccgcatgcagaagtagcacagaggacttcctagaaattgtattctttctccagggagcaacaagaatcgttattcccaaaagggactctattcacttcacagcctggaaggtaatacctacctctgacagaacagaaactggcgtctggatcctagaatcacctagcagtagtcacaaatacctttttttttttttttggggtaataccccatttaaagaaatttatggttaccttgcaacaaggtaattcnttaaaaagaaaaagaaaagccccaccatccctattgttagagattcttttctctacctttaaaaccaaagggttctgcccc

SEQ ID NO: 730506 - DNA, 494 bp, Homo sapiens
atcaacagaaagttagttctttgagaagataaacaaaatcaacaaaacgttagtgaaactcagaaaaaaagaaaaaaagagactcaaatttgaaaaaatcataaacggaagaggatatgtcacaatggacaccatagaaatataaaggatcattagagagtactatgaacaacaatatgccaataaatttgaaaatttaaaggaaatgaataaattcctggacacatacaacctataaagattgaacccagaaggaaaagaaaacacaaatagaccaattacaagtcatgagagagaatcagtagtaaaaggtctttcaacaacaaaaaaatccaaaaccagacggctttactgctgaattctaccaaacctttaaagaagaattaataccaattctttccaaactatcccagaaaataaaagaggagggaattcttcctaattcattctacaaggccagcagaaccctgataccaaaactagtttgatcgaac

SEQ ID NO: 730507 - DNA, 1321 bp, Homo sapiens
gagatctgatggttttataaagaggagttcccctgcacaagctccctctcttgcctgccaccatgtaagaagtccctttggtcttcctttgtcttctgccgtgattgtgaggcctccccagccatgtggaacttataaaataataagatggctgatcctgcaaagaggcgcggtgacatcaacagtgactcagtctctatgatggtattagtaactggcagctgactctcctatttatcatcaagttatgttccaaataagactttcaagtctgagaaaaatgacaaatcccttccaggcatggttcaagttaaagctgaaactgtgtcttcgtttcagctcaagagaggttttgattgtgtcgtggcttttccttgtgtattggttgaggaactgtgccttggaggggcggggagtcttgagaatgggtcaactgatggagggggagtggaagacattggttgcccaagaaaatatgtcaacatctgtccatcactgcaactccggcctgattatcattttttctgcttctgtaagcaccaatgagacaatgccactgaaccacattctttgttgcctgcagtatttcccaccactgcgccacctctgatatgctaatgaggaagcccagggttttgtgtggctgaaaagcctttcaggcacaatcagtgggtcaacaatctcaactctgtacagcggctcagcctgctctgtgagaggctcctctttcggaggggtccttcctcacaccttttctgtgaagtgcgtctgtgcttaaggaggcaattaacatctggctgttgtccctggagaaattgacgaacatcaaagaataaatcataccttgaaactgccagtggacatgactgtccggtcactgtggggggaagccctaaccaatggtctgaatctaaaaatgacccagtggcaccggtttgtagtaaaactttgaagatagaactccatgcaaattctgactccatagtgctggttcttgatgtaaatctcccaatgtaactgtcaaggtttaaaaatatcttacgtaggtgttcagaatcataaggtcatagaattataaaatgttaaccggcagaagtattttcatctttgtcatacgaaaaagagtaatttgctcataataagccttcaatatttatgtattggattgcaattaacaggaatcaaaggaatcttataaggatcatttatctagaataatctctattttctagaattacttaatgatcattgtctttattcagcctaagtaacattgaaatttttcttcattcaaataaattcatactcatgaagcctttcc

SEQ ID NO: 730508 - DNA, 1457 bp, Homo sapiens
gagatctgatggttttataaagaggagttcccctgcacaagctccctctcttgcctgccaccatgtaagaagtccctttggtcttcctttgtcttctgccgtgattgtgaggcctccccagccatgtggaactgtactcaaactgtggcccaagtgctggtagcattagcatcaactggaagcttgttagaaatgtagaatctcagatctcaccccagaatggactatggactcagaatctgcattttaataagattcacaattcacagtataaaataataagatggctgatcctgcaaagaggcgcggtgacatcaacagtgactcagtctctatgatggtattagtaactggcagctgactctcctatttatcatcaagttatgttccaaataagactttcaagtctgagaaaaatgacaaatcccttccaggcatggttcaagttaaagctgaaactgtgtcttcgtttcagctcaagagaggttttgattgtgtcgtggcttttccttgtgtattggttgaggaactgtgccttggaggggcggggagtcttgagaatgggtcaactgatggagggggagtggaagacattggttgcccaagaaaatatgtcaacatctgtccatcactgcaactccggcctgattatcattttttctgcttctgtaagcaccaatgagacaatgccactgaaccacattctttgttgcctgcagtatttcccaccactgcgccacctctgatatgctaatgaggaagcccagggttttgtgtggctgaaaagcctttcaggcacaatcagtgggtcaacaatctcaactctgtacagcggctcagcctgctctgtgagaggctcctctttcggaggggtccttcctcacaccttttctgtgaagtgcgtctgtgcttaaggaggcaattaacatctggctgttgtccctggagaaattgacgaacatcaaagaataaatcataccttgaaactgccagtggacatgactgtccggtcactgtggggggaagccctaaccaatggtctgaatctaaaaatgacccagtggcaccggtttgtagtaaaactttgaagatagaactccatgcaaattctgactccatagtgctggttcttgatgtaaatctcccaatgtaactgtcaaggtttaaaaatatcttacgtaggtgttcagaatcataaggtcatagaattataaaatgttaaccggcagaagtattttcatctttgtcatacgaaaaagagtaatttgctcataataagccttcaatatttatgtattggattgcaattaacaggaatcaaaggaatcttataaggatcatttatctagaataatctctattttctagaattacttaatgatcattgtctttattcagcctaagtaacattgaaatttttcttcattcaaataaattcatactcatgaagcctttcc

SEQ ID NO: 730509 - DNA, 447 bp, Homo sapiens
gtcggtacttctcgcggctgtactctcggaccctgtctcaaacagcaaaagagtagatctcctttggttctaacaagaggggatgtgagattcaagatcagagcccactgtccactctgcacagaccacatgctcaggtgcacccaggggctgggcaggaagccagatgaaggaaagaggttggctgtgagactgtacatagagatgctgatggtgttaactgcaggatacacagcccatttgaggctggcactctaagtgcctcagctgatggtggcaggtgaggatgtgtgcccagtgtcaccagaacttgccctctttagagacaagttagaagttctgacttttatataaaatctcctgatttaaaaatgttgctaacgaatcccaaattaaagaaaaatactgtgcaagccaaagagcacagtctgcattttgtttgggctc

SEQ ID NO: 730510 - DNA, 330 bp, Homo sapiens
atttattgtctgtctcctctatcagaatataagctccttgagggcaaggatctttgtcttattctctgatgcatcttaagcacctggcacatagtaggcgctcaataaaagtaactggatgaatgaatacatgaacacattaggtatactgtacagcatactgttcaaggaaatgctatataactgtatctttttgaaaatgttacctgttgccctacaagataacttatccaagttagtgacaaattatttttcttttctcttttatctgcttagtagttcagacattctcatttttagacatttctactagtggtctgaggctatggg

SEQ ID NO: 730511 - DNA, 257 bp, Homo sapiens
  misc_feature (92)..(92): n is a, c, g, or t
  misc_feature (102)..(102): n is a, c, g, or t
ctgctatcaaccaacctttttcagcacggtagtgaaatatttcaaaccatattcaaacatctaatatagatttataataaaacaggaaaaanggcttgccanattaaagtgctatgagctattacattcaagaggttatcttgattttattttttgaggtggagtctcgctctgtcgcccaggctggagtgcagtggcatgatctcagctcactgcaacctccactcctgggttcaagcaattctccctgcctcagc

SEQ ID NO: 730512 - DNA, 370 bp, Homo sapiens
tcatcaacaaccttccttacacatcagataagctttgaaatactttatcggaaaaacagggagaagaggagcaaggtctgcagtcttgagtactgagtgggagctccaccttccactacaagtctcctggaggctgttcatgaacaattactgttatgttaatttcaggtatttgttttttttttttgttttttgagacggagtctcgctctgtcgcccaggctggagtgcaatggcacgatctcggctcactgagacctctgcctttcgggttcaagcgattctcctacctcagcctcccacatagctaggattatgattacaggcatgcgccatcacgcccagctaatttttgtatttttagtacaga

SEQ ID NO: 730513 - DNA, 339 bp, Homo sapiens
gatactacttcaacacaccaaatcaactgcatttctatacagtaacaatgaacaatctgcaaaggaaataaaacaattccatttacaatagcatcaaaaagaataaaatccttagggatagacctaatcaaggaagggaaaaatctgtatactaaaacaataaaacactgctgaaaaaaattaaagaagacaggctgggcgtggtggctcacgcctataatcctataatcccagcactttgggaggccaaggcaggcagatcacttgaggttaggtgttcaagatcagcctgggcaacatggcgaagccctgtctctactaaaaatacaaaattagctg

SEQ ID NO: 730514 - DNA, 92 bp, Homo sapiens
gccagcaccaaccagacatctatgtacctctgtgccagcagtttcctaacaccggggagctgttttttggagaaggctctaggctgaccgta

SEQ ID NO: 730515 - DNA, 81 bp, Homo sapiens
gacagcagcttctacatctgcagtgctagtccgacgaacaccggggagctgttttttggagaaggctctaggctgaccgta

SEQ ID NO: 730516 - DNA, 603 bp, Homo sapiens
ccctcccttccttccttccttcctcccttcctccttccttccctccctccattctttcctttcttcctttcttcttttctttttctttgtctctcatgctctctctttttctttcctttttgttctacttttttaaatagaccacactgcactgaaatctacattacttaccaaaacctctggagctgcttctgtcttgtaggcagggagctcgtcctgtagcccttaggtcctcccagcctcctcctcctctgatttgtgggtgccactggggcagctgctgagtctcagtggttcctagtcatcaccaagttctgcccacctagatggtttgcacctgtccttaccagaaccctgcactgtctagatgactgaggctgcttctgcctaactgatctgctatctgtgttctgggggcaccccagggttagaggtaaatggcacaggcattgaaatctccaactgctctgactccaggttggtgcacttcaatgccaagtactaaccacacaataacaggatgccaccaaaaccttggtatggggctgctgcatcctaattaaaaagtaatagatgttattttttaggttctaggtttacaga

SEQ ID NO: 730517 - DNA, 572 bp, Homo sapiens
tctttttctttgtctctcatgctctctctttttctttcctttttgttctacttttttaaatagaccacactgcactgaaatctacattacttaccaaaacctctggagctgcttctgtcttgtaggcagggagctcgtcctgtagcccttaggtcctcccagcctcctcctcctctgatttgtgggtgccactggggcagctgctgagtctcagtggttcctagtcatcaccaagttctgcccacctagatggtttgcacctgtccttaccagaaccctgcactgtctagatgactgaggctgcttctgcctaactgatctgctatctgtgttctgggggcaccccagggttagaggtaaatggcacaggcattgaaatctccaactgctctgactccaggttggtgcacttcaatgccaagtactaaccacacaataacaggatgccaccaaaaccttggtatggggctgctgcatcctaattaaaaagtaatagatgttattttttaggttctaggtttacagaaaaaatggagtggatagtacagagagttctcctaggctcccctgtc

SEQ ID NO: 730518 - DNA, 595 bp, Homo sapiens
ccctcccttccttccttccttcctcccttcctccttccttccctccctccattctttcctttcttcctttcttcttttctttttctttgtctctcatgctctctctttttctttcctttttgttctacttttttaaatagaccacactgcactgaaatctacattacttacctaggtcctcccagcctcctcctcctctgatttgtgggtgccactggggcagctgctgagtctcagtggttcctagtcatcaccaagttctgcccacctagatggtttgcacctgtccttaccagaaccctgcactgtctagatgactgaggctgcttctgcctaactgatctgctatctgtgttctgggggcaccccagggttagaggtaaatggcacaggcattgaaatctccaactgctctgactccaggttggtgcacttcaatgccaagtactaaccacacaataacaggatgccaccaaaaccttggtatggggctgctgcatcctaattaaaaagtaatagatgttattttttaggttctaggtttacagaaaaaatggagtggatagtacagagagttctcctaggctcccctgtc

SEQ ID NO: 730519 - DNA, 340 bp, Homo sapiens; identical to SEQ ID NO: 728562

SEQ ID NO: 730520 - DNA, 333 bp, Homo sapiens; identical to SEQ ID NO: 728563

SEQ ID NO: 730521 - DNA, 578 bp, Homo sapiens
  misc_feature (255)..(255): n is a, c, g, or t
  misc_feature (367)..(367): n is a, c, g, or t
  misc_feature (527)..(527): n is a, c, g, or t
  misc_feature (536)..(536): n is a, c, g, or t
  misc_feature (563)..(563): n is a, c, g, or t
  misc_feature (572)..(573): n is a, c, g, or t
  misc_feature (575)..(575): n is a, c, g, or t
ccggttgggcgccgcgcggtgaggttgtctagtccacgctcggagccatgccgtccaagggtccgctgcagtcggtgcaggtcttcggacgcaagaagacagcgacagctgtggcgcactgcaaacgcggcaatggtctcatcaaggtgaacgggcggcccctggagatgattgagccgcgcacgctacagtacaagctgctggaagccagttctgcttctcggccaaggagcgatttgctggtgtagacatccntgtccgtgtaaagggtggtggtcacgttgcccagatttatgctatccgtcagtccatctccaaagccctggtggcctattaccagaaatatgtggatgaggcttccaagaangagcaatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataanacagttttntgagggatttcatcacgtttcaagaanagaaaagannanaag

SEQ ID NO: 730522 - DNA, 593 bp, Homo sapiens
  misc_feature (255)..(255): n is a, c, g, or t
  misc_feature (542)..(542): n is a, c, g, or t
  misc_feature (551)..(551): n is a, c, g, or t
  misc_feature (578)..(578): n is a, c, g, or t
  misc_feature (587)..(588): n is a, c, g, or t
  misc_feature (590)..(590): n is a, c, g, or t
ccggttgggcgccgcgcggtgaggttgtctagtccacgctcggagccatgccgtccaagggtccgctgcagtcggtgcaggtcttcggacgcaagaagacagcgacagctgtggcgcactgcaaacgcggcaatggtctcatcaaggtgaacgggcggcccctggagatgattgagccgcgcacgctacagtacaagctgctggaagccagttctgcttctcggccaaggagcgatttgctggtgtagacatccntgtccgtgtaaagggtggtggtcacgttgcccagatttatgctatccgtcagtccatctccaaagccctggtggcctattaccagaacatatgtgtgccatgacggtcttccacagcaacgggagcatcaaggaggatcgatgcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataanacagttttntgagggatttcatcacgtttcaagaanagaaaagannanaag

SEQ ID NO: 730523 - DNA, 638 bp, Homo sapiens
actccagcctgggtgacaggtgagactccatctcagaaacaaacaaacaaacaaaaactctccagaaagcaatacagagaacaagcaaatggaaaatataaaaggttaaaagacggggttaaaataaagactgaagtcctagaaggaaagaaaaaagaaaataaaggagagccaaagtgcttagagacctaagagctgagaatttttgaagctaagaaatgaaaccacagttatgggaagcacaacatataccaaacagaataaataaattcatgcacagtcatgttatagtaaaactgcaaaacaccaaaagagaagatcttaaaggaccaaagaaaagatacaccacctacaaaaaaaccacaatcaataagaaagatagatttctcactgctatattagaagctggaagaagagggcatactatcttcaatgtgataacctggaatgatcaacctggaattttatgtccagagaaactatctttcaaggatgatggtgaaatacaaagacatttcagataagcaaaatagaaactgcctccaacagactttcacttaaggaaattctactttaggaagaagaaaaatggtgccagaaaggaagtctgagatacaggaaggaacggtgagcaaaga

SEQ ID NO: 730524 - DNA, 170 bp, Homo sapiens
cggatgttatcgcccaacacagttgccaggctgtttaacagtcatttttgatatgggttaacttggttatttcagatttgccttgactatccttatcaagaaatctgagtggaatttagacaggaaaagagatttcttaattctgactccagtgttggggataacatcac

SEQ ID NO: 730525 - DNA, 1049 bp, Homo sapiens
ataggtaggtaacttcatcaaatgtacataatctgtatcaggctagtccacctctgaaaatctaaggaaaggatttaaaggaagagccaagcttgtgcctaaagatgtttactgtaacctggtctctcagaaaaggtagaaacagtctaaatagccagaaataggggaatagtgagcacattcaggtgacaaaactcctagaactcatgtcacatagaaatatgtaatgctgtcattctaatctggaataattctggtataaaatatatataaatgttacttaaaatcaagcatgtgaggctggacatgttggtgcacacttgtagtcctagctactcgagttcttggcactcagaaattcgagaccagtctgagtcgatggtgaaataggtaggtatatttctctcccactggatcacatctccttgaagacagcaaccacagttcgtccgagtgtacagagtagcaaccacagttcgtccgagtgtacagagcagcaaacactgttcactgttgcctttcatttctctccctctaaagattctgaacaataataccctgtcaattagcaaacttttacctggagacagaaggcttatgcaaccagtgcacttaagtactggtcataccttgctaaagactttcttaagacttaaacaaaaattttggggggaagaagaggaggatatgcttcatgtttataaactaaccaaagacagatttttaattttttaaaaaagttatgtcttaaaagcttgctttcattatttcattcaaaaaaaccatggtgcttttaatataaaaatacagaagcataatttctgcatatgtcaagtctaacctaatcataacttgccaatctgctgattttaatgtaatcctaaggatgctagacaacaatatgcttgcttgattcacctgacactatttacataaaataaaagcattttaacaatacatcgagatgcaaatctttctggctctgattggtgccctttctccctcttaacaaaaagtggcacacacacacaaaagagcctccaacttat

SEQ ID NO: 730526 - DNA, 575 bp, Homo sapiens
cacattttctatggtatttatttgggtaggtatatttctctcccactggatcacatctccttgaagacagcaaccacagttcgtccgagtgtacagagtagcaaccacagttcgtccgagtgtacagagcagcaaacactgttcactgttgcctttcatttctctccctctaaagattctgaacaataataccctgtcaattagcaaacttttacctggagacagaaggcttatgcaaccagtgcacttaagtactggtcataccttgctaaagactttcttaagacttaaacaaaaattttggggggaagaagaggaggatatgcttcatgtttataaactaaccaaagacagattttcaaccccaccactctactgaaaactgtacctgtcacgactacgaagtttatttcttatttgacctattagctgtgtaaggcacaaataggtgcttccttaagtgaaaaactttctgctttggttactaggatacaagattgctggtttaactacctacttggattcatagtctctataatggatcttccttattacacctacctatttcacaatcg

SEQ ID NO: 730527 - DNA, 684 bp, Homo sapiens
cacattttctatggtatttatttgggtaggtatatttctctcccactggatcacatctccttgaagacagcaaccacagttcgtccgagtgtacagagtagcaaccacagttcgtccgagtgtacagagcagcaaacactgttcactgttgcctttcatttctctccctctaaagattctgaacaataataccctgtcaattagcaaacttttacctggagacagaaggcttatgcaaccagtgcacttaagtactggtcataccttgctaaagactttcttaagacttaaacaaaaattttggggggaagaagaggaggatatgcttcatgtttataaactaaccaaagacagatttttaattttttaaaaaagttatgtcttaaaagcttgctttcattatttcattcaaaaaaaccatggtgcttttaatataaaaatacagaagcataatttctgcatatgtcaagtctaacctaatcataacttgccaatctgctgattttaatgtaatcctaaggatgctagacaacaatatgcttgcttgattcacctgacactatttacataaaataaaagcattttaacaatacatcgagatgcaaatctttctggctctgattggtgccctttctccctcttaacaaaaagtggcacacacacacaaaagagcctccaacttat

SEQ ID NO: 730528 - DNA, 263 bp, Homo sapiens
ctggctgcatttgtttcaaaaggaggcctctgtaactatgattcaattatctctatagttgatggaactgatatgagactgcaaaggaatcaagaggactgaattatactaaatgaggctagtaaaaatcagccacttattcacaggaattagaaaatcaagacatctgaaagggcagcagtatcaagtgagttgtgttctatgtgggaggcttataaatgtgtgaaaacaagaaggagctagtggagagattggagatattg

SEQ ID NO: 730529 - DNA, 289 bp, Homo sapiens
tatccacaatcttccgctcccaagatgtgacctctccctctctgtgtcctttctctccatcagtatctcctggctatggtcatagcgtatttcagccgggccggcctcccctcctggcaataccaacgcattcatttcttcctggctctgtgagtggtttgctgcctcctatccgtcaatatccaatgccctgggacagcgggggaagtgggattccagcctttcatttattctttcacctatttgtcctctttactctgtgtacaaaaaagacaggattatagtctcg

SEQ ID NO: 730530 - DNA, 187 bp, Homo sapiens
ctcagccggtaccattgctcaccgctcctgggctgtgcacaaacccactcacgcacacagcactcagtaagccgggactgacccactcagacacgcacacaggcgcacatcacacacaggctcagccccccaaacccagacccaggagctggagcgtacgggtccacgtggctagaaaatgcaggtt

SEQ ID NO: 730531 - DNA, 619 bp, Homo sapiens
agacggagggctggggctgacgtcccccgtgcagtgtgactcgtgcagacggagggctggggctgacgtcccccatgcagtgtgactcgtgcagacgaagggctggggctgacgttccccgtgcagtgtgactcgtgcagacggagggctggggctgacgttccccgtgcagtgtgacacgtgtccctggcctctcaagagagacaacggcacaggagggtgggtagaagcctcggaggctctgggtgaggaaccctgagccctgtgtgtctcctgcctgggtcccctggactccctcccagggtgaagagccaaaggcccagttctctccctagtcccagcttgggtttgtggaaatgaccagtgctgactcccaggcagaccgtggtgttgaccccactggatgtgtggtatgtaggcacggggtggcaccgtcacctgcccctcacagacacactggcggcctgtgcacaaacccactcacgcacacagcactcagtaagccgggactgacccactcagacacgcacacaggcgcacatcacacacaggctcagccccccaaacccagacccaggagctggagcgtacgggtccacgtggctagaaaatgcaggtt

SEQ ID NO: 730532 - DNA, 230 bp, Homo sapiens
caccgctcccttgagtaattcataaaatccactctttaacctctgaatcatcccttcatttcttgctctaagtaaaatctagctccctgaggatgccttttcctttcgcagccatctcaaatgataggtgtttcctcttttctcctccacacacttcatatcactgtacctactggagatgtggggaagaaatcttccctgctctggctgagcgtgggcaatcctgtaat

SEQ ID NO: 730533 - DNA, 217 bp, Homo sapiens
tacaaccggccaagcgatcgctgggtgtttggctgttgcattagatgatcgctgggtgtttggctgttgcattagatgatcgctgggtgtttggctgttgcattagatgatcgctgggtgtttggctgttgccttagataatcacttgtctgtttggctgttgcattagatgatcactgggtgtttggctgttgcattagatgatctccttggcgtt

SEQ ID NO: 730534 - DNA, 423 bp, Homo sapiens
cctaagcaaagagaacaaagctgacttcaaactatactacagggctacagtaattaaaacagcatggtgctggtacaaaaacagggacataaaccaatagaacagaacagagagcctattttaaaaatcaggggttttaaaatcgtaggccacacacctatgataacctgatctttgacaaagctgacaaaaacaagcaatggggaaaagactccctattcagtaagtggttctgggataactggctagccataagcagaagactgaagctacatagtacccctcctttacatcatatacaaaaatcaactcaagatgcgttaaagacttaaacgtaaaactatgaaaaccctggaagacaacctaagcagtaccatcctggacacaggaatgggcagatttcatgacaaagacaccaaaagc

SEQ ID NO: 730535 - DNA, 2264 bp, Homo sapiens; identical to SEQ ID NO: 187544

SEQ ID NO: 730536 - DNA, 2174 bp, Homo sapiens; identical to SEQ ID NO: 187545

SEQ ID NO: 730537 - DNA, 329 bp, Homo sapiens
  misc_feature (57)..(57): n is a, c, g, or t
  misc_feature (70)..(70): n is a, c, g, or t
agcaactgctccttcgcagctcctaaatagctaagattacaggcgctgccaccacanccggctaattttngtattttagtagagacgggatttcaccatgtggtcagactggtctcgatctcctgacctcaggtgatccgcccacctcgaccttccaaagagctgggattacagacgtgagccactgtgcccagcccgagaccctgtctcttaaaaaaaatccatctccacttctggttgactgtgttactcagtctctgtctgcttcagtttaattttcgtacttaataatggtattttcttgcagagtgtttgtaaagaataaatat

SEQ ID NO: 730538 - DNA, 477 bp, Homo sapiens
cctgcttctgatgaaagctctggtatcgagactttagtggaggagctctgctccagactgaaagaccttcagagtaagcaagaagagaagattcacaaaaagttagaggggtctccctctccagaggcagaagcaggaagcgcttcctgcttctgccaccaggaataagggaaaagacgagcaggaggctctcaagagggatccaagagaagaggctgcttttttgacctctgactcatgtgtctgccgcaggggttttgaacctaaattgccaccgaattatagcaaaccggcagctcaaacatttaagcttcaaaaggagctaaaaacaaaggttctttccttttttgagatggggaaattaaagacaggaaggtcagtgtcgctgtgaatcagggccaagaccagcacaaacccccatttctcagttcctgccgcttccagagaacactgcccttctccaccagcctcttcagc

SEQ ID NO: 730539 - DNA, 532 bp, Homo sapiens
ccaacgctgctcacagaaactgtgagctaataaatgttgttgtgagttggtaagttcaggagtaatttgttacacagcattagataacacatacaacaagtaaagcactaagaatagcacctggcacacagcaggcattgaaatagctgctgaatgaggtggggtataaattaataactctataagtaatgacctctccaccagatctgaacaactcccaacattaggaccagcctgcctggctgcttccaccctagttagattttcagcctctctacgctgctacggtagcctctaactggtctccagccttctcctcactcctcatccccaatcttctcttacataccgtgggtaagtaaatctctcccaaatcctcctgtccatagctttgttggtgcctcctaaaaccagcaacatcaaagccaaaaccataactcagcatagagggctctcccaacaccacccccaatccctgcctagccttaagcagaagctgagcctaagaatctacttttgtgagcagcgttgg

SEQ ID NO: 730540 - DNA, 605 bp, Homo sapiens
ccaacgctgctcacagaaactgtgagctaataaatgttgttgtgagttggtaagttcaggagtaatttgttacacagcattagataacacatacaacaagtaaagcactaagaatagcacctggcacacagcaggcattgaaatagctgctgaatgagtaaataaaaaggaaaacagaacattaaattctaaagtgatggcttactgctttgaatctctttgcaattaagggtggggtataaattaataactctataagtaatgacctctccaccagatctgaacaactcccaacattaggaccagcctgcctggctgcttccaccctagttagattttcagcctctctacgctgctacggtagcctctaactggtctccagccttctcctcactcctcatccccaatcttctcttacataccgtgggtaagtaaatctctcccaaatcctcctgtccatagctttgttggtgcctcctaaaaccagcaacatcaaagccaaaaccataactcagcatagagggctctcccaacaccacccccaatccctgcctagccttaagcagaagctgagcctaagaatctacttttgtgagcagcgttgg

SEQ ID NO: 730541 - DNA, 472 bp, Homo sapiens
gagccggcagcccctctccgtttccttagacacttactgatgctgctcctcccagcctgatgagtgacggatgaagatattagatttctattatccctaagtctctcgtttgtttcctgaggcaagtctacataaggccgggttcccttgtttccaaggcccgcctatcgtgtttgcactgactgagctcctccctggtgggcccctagaagctgttgtacttatcaagtattcttcagccctctattcttttacctactcaggaaattgccctcttattatcaagaagacctcatcaaacaagtttcttatctgactcctctctaacgagaaacccataaacctccagacaggcaccaccggacaggcagcctggtgtggggacctgggagtcccagacagaggttttcagtcctagctctaccacttgctagcaggagaagtttgctatcctagttgggttcttcctgaa

SEQ ID NO: 730542 - DNA, 414 bp, Homo sapiens; identical to SEQ ID NO: 214182
  misc_feature (359)..(359): n is a, c, g, or t
  misc_feature (361)..(361): n is a, c, g, or t

SEQ ID NO: 730543 - DNA, 891 bp, Homo sapiens
tggccccagctgagtgcctcctagcactgaggaaagcagaaccaagctttgcaacaatgaactctccttgctggaagagaccgcccacctctaacagaattttgtagctggaggaaacttcagacacaagtcctgttacagaagaggaaactggcacagagaggaaatggtgcttgcataaggtctctggacagagtcttgccctgttgcccaggctggagtatagtagtgcagtggtgtgatcatagctcactgtaacttcgaccacctgggctcaaacaatccttcttcctctgcctcccaagtagctgggactacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccagaagcatcctcagcagcagcatcctcagcagcagcatccccagcagcagctccagcagcagcagccccagcagcagccccagcagcagcagccccagcagcagccacagcagcagcagccccagcagcagcagctccaccagcagccccagtagcagctctagcagcagcagcagcagccccagcagcagcaactccagtagcagctccagcagcagcagccccagcagtagctccagcagcagcagcagcagccccagtagcagctccagcagccccagtagcagctccag

SEQ ID NO: 730544 - DNA, 1015 bp, Homo sapiens
gcctccctgcctgtcgagtctgcacacgggtttcacgccctcccctgtgttctggccaggagactttgcgttcggttggaattgttacagagttcagctggaggtttccttctccctgtggccttttcccagttcctctggcagccctcctcaaggacccctgtgagataagtcagaggtgactttcctggggacccagagaacccacaaggcttttcccactgcttactgtattttgctcggctctctaaattgaatcaattgcaggtaagtcagggatttcttcttggtttggatccactgctggtgagcagacagagtcttgccctgttgcccaggctggagtatagtagtgcagtggtgtgatcatagctcactgtaacttcgaccacctgggctcaaacaatccttcttcctctgcctcccaagtagctgggactacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccagaagcatcctcagcagcagcatcctcagcagcagcatccccagcagcagctccagcagcagcagccccagcagcagccccagcagcagcagccccagcagcagccacagcagcagcagccccagcagcagcagctccaccagcagccccagtagcagctctagcagcagcagcagcagccccagcagcagcaactccagtagcagctccagcagcagcagccccagcagtagctccagcagcagcagcagcagccccagtagcagctccagcagccccagtagcagctccag

SEQ ID NO: 730545 - DNA, 889 bp, Homo sapiens
tctgttttctggttttggctgtgccataaacgattatttatgaaaactgcaatagtcatcatttaaagttatggaactgtgtccggaattggtgggttcttggtctcactgacttcaagaatgaagccgcggacccttgcggtaagtcagggatttcttcttggtttggatccactgctggtgagcagacagagtcttgccctgttgcccaggctggagtatagtagtgcagtggtgtgatcatagctcactgtaacttcgaccacctgggctcaaacaatccttcttcctctgcctcccaagtagctgggactacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccagaagcatcctcagcagcagcatcctcagcagcagcatccccagcagcagctccagcagcagcagccccagcagcagccccagcagcagcagccccagcagcagccacagcagcagcagccccagcagcagcagctccaccagcagccccagtagcagctctagcagcagcagcagcagccccagcagcagcaactccagtagcagctccagcagcagcagccccagcagtagctccagcagcagcagcagcagccccagtagcagctccagcagccccagtagcagctccag

SEQ ID NO: 730546 - DNA, 968 bp, Homo sapiens
gcctccctgcctgtcgagtctgcacacgggtttcacgccctcccctgtgttctggccaggagactttgcgttcggttggaattgttacagagttcagctggaggtttccttctccctgtggccttttcccagttcctctggcagccctcctcaaggacccctgtgagataagtcagaggtgactttcctggggacccagagaacccacaaggcttttcccactgcttactgtattttgctcggctctctaaattgaatcaattgcagacagagtcttgccctgttgcccaggctggagtatagtagtgcagtggtgtgatcatagctcactgtaacttcgaccacctgggctcaaacaatccttcttcctctgcctcccaagtagctgggactacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccagaagcatcctcagcagcagcatcctcagcagcagcatccccagcagcagctccagcagcagcagccccagcagcagccccagcagcagcagccccagcagcagccacagcagcagcagccccagcagcagcagctccaccagcagccccagtagcagctctagcagcagcagcagcagccccagcagcagcaactccagtagcagctccagcagcagcagccccagcagtagctccagcagcagcagcagcagccccagtagcagctccagcagccccagtagcagctccag

SEQ ID NO: 730547 - DNA, 418 bp, Homo sapiens; identical to SEQ ID NO: 209747

SEQ ID NO: 730548 - DNA, 1444 bp, Homo sapiens
ggcaagatttatgcaactggaggtattgtcagcagtgaagggcccgcgctgggtaacatggaggcctacgagcccacaaccaacacatggaccctcctcccccacatgccctgccctgtgttcagacacggctgcgtcgtgataaagaaatatattcaaagcggctgacatcagcagaaagcccacgataagactgtggacaagtctggtgaggcaagtgccacgcaatgataattttccagcgacaccaacaagaggccaacaaaacacaatcaaggaactcactgcgctcaacatgttgaatattctctacattgaatgtagaaaatcatcctcgcctttggatgaaacggaggcaccgcgcttggagccgcaggaaccacgatcccgccatggggctggctgcctcctgaacaggggcgctcgctctgccaggtgcaatagagtttcacgtatttttcaactgggagagagaagctgttttttccttcctgcagagcaagcttgatccctaaacaaccatagatcagttatcttatgacaacattaggcatcaggctctcttggaataagatcaaagtgtccttatcactttgattcctactttgttttttaaccgatctacactttcagtggccgacagaaaacgagggacaatactgtgcatcacaaggcctaggaggctgctggtccccactggggctgaagagaagcccagctgcccacgcggagccaggggtggcagctgtgggacagccggggagcagggacagcggtctgtccttcacaggtttttctactgtgttttgctggagaaggacagtgattgcgctagctttctcttacccggtatgaattatttagatttctgaggcattttcttgataaacaaaaggctatttttaagtactgagaggaggagcaggccacaagagggataatgtgtgggaattcccaaagctctttgtaggtagtgccagaggggggctttgctctcatttttctatgtgcagaatagaggatctctcctggggtgggcgatgcccccattttatttttagaaaaagtaactcccagacagccccataaaagctgtgcccaaggaagaagagtctgtctagaaggagcccggttctggctcaggacaccggccaagtccctccatgaggtcaagctgaggaccaggccagtgggaagggaaggagggagaattagcgtctataaagcacaggagactatttttgatattcatagctatatattaaggcacctgccacaagagctctcaggatggggacagccttcttagtggagccatggcagcaaggcctgagggcatgaacagaaccactcttcttgtcacatacgaacctgagaaaagggaagccaggagggaggtcacaccatggctcaaaagggaaaggccttcccacttgtccttagc

SEQ ID NO: 730549 - DNA, 541 bp, Homo sapiens
aacatactcagaaaaagtaacatgcaaggtaatttgaaatcagactttaaagcatgtttgaaaagatggcaagcatttccattggttttcatagttttttttaatgacttgactccaaataagaaggatgtcttattatttagcttgacaacatctatgttaaagagactaggatctaaaccccgaagagaaattcagaaactagaaaaaaagaaaatgaacccggggtgttaagctgggaaccaaaaagagcacatttcaattcttttccaccgtaatgccacaaaaccgtaccttaaaacttctaagattacaatcttaggtaagaaaaggaaatattttcagttacaaatagacatgtctttgcgccttcattctagactttttttttggagacggagtctccccgtcccccaggctggagtgcagtagctctatctcggctcactgcaacctccgcctcccgggttcaagcaattctcctgcctcagcctcccaagtagctgggattacaggcacctgccaccacgcccggctaatt

SEQ ID NO: 730550 - DNA, 710 bp, Homo sapiens
ggaggcccccagacctttctcctccaactgggagtctagaagtgtgtctgacatgtgaaaaggaagattgaagagtgagaatggaggagtgtgtgttcagggtaaggatgcccaggatatgtaaaggtttttttgcagaggggctagggtagagcatgctgggagggatctgtaggtttttcatcaccaataaggtagaacctagaatcctcaactagtatcctaagcttggcatggtccacactggtagcttcttctctttcccccactctgcctttgacttcaaacagtttagcaattttgagatcctgcactcagaccactaggctctcaccccaaagcctctttgtttcatctctgcctgctaaaaaaaattctacttttctttcgtggccctgctagactgccccactaggaagcctctctagatcctaccaggcataataaactggatcatcatctacactcccatgggcatgctggaactttcccatggcacaaactctggtttccccagtagctgtaactaaaatcaggtttccctgacaacaggaaccttgtttcatccatccatgttcctggtgcccagccgagagtaagaaacaataactatgtgctgaatatattggatggaataagaaagagggggtctgggggtctgagggaccacctctctaatagtggagggcagctggacatggatgggagtt

SEQ ID NO: 730551 - DNA, 648 bp, Homo sapiens
ggaggcccccagacctttctcctccaactgggagtctagaagtgtgtctgacatgtgaaaaggaagattgaagagtgagaatggaggagtgtgtgttcagggtaaggatgcccaggatatgtaaaggtttttttgcagaggggctagggtagagcatgctgggagggatctgtaggtttttcatcaccaataaggtagaacctagaatcctcaactagtatcctaagcttggcatggtccacactggtagcttcttctctttcccccactctgcctttgacttcaaacagtttagcaattttgagatcctgcactcagaccactaggctctcaccccaaagcctctttgtttcatctctgcctgctaaaaaaaattctacttttctttcgtggccctgctagactgccccactaggaagcctctctagatcctaccaggcataataaactggatcatcatctacactcccatgggcatgctggaactttcccatggcacaaactctggtttccccagtagctgtaactaaaatcaggtttccctgacaacaggaaccttgtttcatccatccatgttcctggtgcccagccgagagtaagaaacaataactatgtgctgaatatattggatggaataagaaagagggg

SEQ ID NO: 730552 - DNA, 454 bp, Homo sapiens
agacaattaacagggtgccggcttttactgtagtgccccagttgacagaatcatgcatcagaagcttttatgtgaaagtggaatctttgttctggagaaaatcaaagtgtgactgtatttgaaagccagctcgttgaaggattccttcttctaatgagctgcgccagtagtaactgaggtgtggtgattagcgaaaggtcactcctgccgtgccaccttccgtgccgatttccctacctaacacggggccagggaaggcagcgagcgcaataaatcagaacacaggtgcccattaacctgccgtgaggaacggtcagagagccttttccttgtttcattccaaaaaggtggggggagagagcaaggagaacaggtttttggcatattagaaccaagcacggtttgtgttaatcaaggacaccctgaatcagtgcaatgaaacctacatgtacag

SEQ ID NO: 730553 - DNA, 484 bp, Homo sapiens
agacaattaacagggtgccggcttttactgtagtgccccagttgacagaatcatgcatcagaagcttttatgtgaaagtggaatctttgttctggagaaaatcaaagtgtgactgtatttgaaagccagctcgttgaaggattccttcttctaatgagctgcgccagtagtaactgaggtgtggtgattagcgaaaggtcactcctgccgtgccaccttccgtgccgatttccctacctaacacggggccagggaaggcagcgagcgcaataaatcagaacacaggtgcccattaacctgccgtgaggaacggtcagagagccttttccttgtttcattccaaaaaggtggggggagagagcaaggagaacaggtttttggcatattagaaccaagcacggtttgtgttaatcaaggacaccctgaatcagtgcaatgaaacctacatgtacagtaaaagccggtaccgagctcgattcgtatc

SEQ ID NO: 730554 - DNA, 718 bp, Homo sapiens
agacaattaacagggtgccggcttttactgtagtgccccagttgacagaatcatgcatcagaagcttttatgtgaaagtggaatctttgttctggagaaaatcaaagtgtgactgtatttgaaagccagctcgttgaaggattccttcttctaatgagctgcgccagtagtaactgaggtgtggtgattagcgaaaggtcactcctgccgtgccaccttccgtgccgatttccctacctaacacggggccagggaaggcagcgagcgcaataaatcagaacacaggtgcccattaacctgccgtgaggaacggtcagagagccttttccttgtttcattccaaaaaggtggggggagagagcaaggagaacaggtttttggcatattagaaccaagcacggtttgtgttaatcaaggacaccctgaatcagtgcaatgaaacctacatgtacagaatgaagcgttttttctttgtcatcatgaaaactcctttttttctacctttctgtttctttttttaaatatgtatccttggggtttgtttattttttttttcttgtttcacttcaaatgaatctggaaaaactttccagggggcttctccctgggtgtggtgtgtgatcggcagccccgccgttgtggcccgaggctcctggaagctcatcagctgatggtcttccttggcctgtagtaaaaatactgctgaattcctcgttgg

SEQ ID NO: 730555 - DNA, 405 bp, Homo sapiens
ttgccctactccctccgctactccctgacgccccctgcagcccccagcccccctgcaggccccagccccagtaagtttggagaggggaacaaatgctgagcctaggtagggaccaccttggggaggaagccaaaatcacactgctcacccgagagcccctgccccgcgctggcacgcccccgcctggagtgcactcgtggccccgggcgctgtcaggtacccgaattggggtaagcgagttggtaactggacctccaaagccttcccctggggttgactttggaattgttcctacagcccggggactggtggttggggtgggaagaggaccaccaccaccaagggtgactttgagggagactagagcgcggccccccgacagctgtgggggagcgggggtgtgga

SEQ ID NO: 730556 - DNA, 483 bp, Homo sapiens
cagaatttttatggaagcttcattatgtaggcatgactgattaaatcactggccattggtgatgaacttaatcttcagcctgtctcccctctccggaggttgagaggtgaggctgaaagtcccaaccctcttatgcctgccttggcctttcctgtcaccagcccccatcctgaagctacctaggggctgctggccagcatacaaaaaggcatcactctggaaagtccaaagattttagaagttgtatgccaagaaatgagacaagaccaaatatatatttcacaatatcacagtactgaatactataggcaactgtaacacaatggaatttgtgtatctaaacacagacaaggtacagtaaaaatatgggaccaccatccttcatgtggtctggtctgtcattgacggaaacatcactgtgtggcacatgattatatatctttaaaagaaaaaatgaaaaatatatgctgatataaaacttgc

SEQ ID NO: 730557 - DNA, 500 bp, Homo sapiens
gcccattgggcggccaagtcagcattccattccagtacagtgtgggggtgcagagatgggggccaagagtacaaatagagtgggacagttgtcattgcccagcctgtgagttgaagtctgtgcagtcagccagtgggtctgacaaagagggcagtgctggcactgcctcatgcttccgcagaggtgatgaggttcaggctgaggtggagaccacgctgcactcgccatgcattcaatggtgccccatctcttgttctctaggaagcattcccgctacctgtgtgatgcagttggttccacctattcccagagactccaccctggccctccttgccctggcccccagcactgagcccctagggccatttagctggccagcatgatctaagacagctttctgcaggcattcctcttgtaggagtcatgaagcagcaatgtgtattttgcttctttttgttgttgttatattaaaaaatatttttatattctagtccaatcct

SEQ ID NO: 730558 - DNA, 755 bp, Homo sapiens
atgcactcccagcttcatctcacttcaatccactggttgatagaagtgcagtcaaagactgtcccctcctctgcaagcttttatgttctctctcctctctccctagccacgtcctgttctgttatcaacacacttactcacctcctggccttctccttctattgtctctcatccctcttccctcacaaaaacagaagcaaagagccagagccttcagtttggaggaactgaaaacattctcttctgctttctcattttgtagatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccctccatagggaaacctttcttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacttcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatctg

SEQ ID NO: 730559 - DNA, 989 bp, Homo sapiens; identical to SEQ ID NO: 338124

SEQ ID NO: 730560 - DNA, 456 bp, Homo sapiens; identical to SEQ ID NO: 338125

SEQ ID NO: 730561 - DNA, 1614 bp, Homo sapiens
agtcaccgagacccccttcccgggctgcacaggcgggagcggggacccgggtggggagaggggtgtgggaggggagtttccgggtcggaaaagggagcgccctactgggttcgtggccgtgcttgcctagaggctgggcccaggtagggaagcgaagtggactcgtggtttttctccgagggacccaggctttgggatcccgggctccggggctctctgccccccttcccattctctttccggaatccaggccttccgtcttcctgcttgctccccacccccctatctgagcgccgcacgaggctccccagcgcccctcttttcccctccaccaaaaaaatcagttctcctgaattctgatttttcacttactaagctagtacagtgccacacacccagggattccaagcctgggcatgtccatgaatagaagagctactgggggaaggagaagactccaggatgtggcccagaccccccggaactgggaagctggggtacactgggcagtgagggttctgtcttccatcccacttgacccagcttgctgtctgttctgcagacattcttttaggggaaccccctgggtggcggggccctaactgagggaaattggtcacctggtgtctggggaggagtgggcgcttagcaggaggcaccctaaaaggaagaaaagttaaagagaaatgtcgaagaccaaatgcctgggtgcctgcagagaggaagataggatttgggcatctgcataccctgtgtggtgttggagatacatactacagaggaggatacccctgggcataggcctggcactggaggatgatatgtttgggagatcattaagatcttatggctatgatggggtggaaaattgaggtagcttctccagggacaaaataccagatttcagcatggtgatggatagagagagggtggaagagaacaggcatttctttggcgtcggttactgtcgtcttgtcactgtgctaggcattttacttacctttagaaagcagaccagaaagcaagaggtcagggaatcatggtaataatagtaataactaacggccgggcgcagtggctcatgccttaatgccagcactttgggaggcctaggtgggtggatcacctgaggtcgggagttcgagaccagggcctggccaacatggtgaaaccacatctctactaaaaatacaaatattagccgggcgtggtggcacgtgactgtaatcccagctactcaggaggctgaggcaggagaatcgctggaacttgggaggcggagattgcactgaacagtgattgcgccactgcactccagcctgggcgacagagagagactctgtctcaaaaataataataataatagctaacatgttatactgcctgcctgtgctagggacttgcatgtatcaaatcatttagtctcacctaacaactgtgcaaggcaggtacaatgtccattttacacataaggaaactgaggcccagagacttacagtagtaattgggccaaggccttgcataactagtagagccaggatttgaacccagctgacagactcagaagctctgacttccccctgctggtggaaacacccagccttgagagcaagg

SEQ ID NO: 730562 - DNA, 1937 bp, Homo sapiens
  misc_feature (1084)..(1084): n is a, c, g, or t
gggagtgtgggaagtctggcggttggaggggtgggtggggggcagtgggggctggggggggagttctggggtaggaagtggtcccgggagattttggatggaaaagtcaggaggattgacagcagacttgcagaattacatagagaaattaggaacccccaaatttcatgtcaattgatctattccccctcttgtttcttggggcatttttccttttttttttttttttggtttttttttataccccttcctttagcttatagtgcgcctcagaaaaccaaatttaaaccccccccccgatgttaacgggggggcagtgacaaaaagcaagaaacgcagagaagccagctggggagaccaccaggttcggtgcccccggcacatatatcgcccggagtgggactggggtttacacatctcggtgctcccgtggtggcatggggctgagagctggagggggtggacgccctcgcgggggggaccgggcgccagggaggccccctgtgggaaaacctcaaggggagagtgggaaaagcgccactggatccgggccgggcttcctggggggacaagggcgcgggtccccaagaacgtccgagaagggccggaccggcgagcagggttcaggaccacgggatccccccacaagggtgcacaagacaggggctgtctagagagggcccccaggacggggggccaccgagtggtgtcccctgaagtcctggcccgcatggtaccacgcggcacccccggtgtgttacccgggggggctccccctcgggggtgcgccacctattgcccgacatcctgccaccttttgaggagccccctgcgtcttttctcctggtgctctttgtgtccgccccatcgaacccgtctggtccacagggcctcgcgtttgaggaacgtctggcgcaagagaggatacactcgaaaacaagcgctagcgactcacccaaaacgaaaacggtgactacccaacgtagtggctgcgaccagctggtgactcaccacaccaaacggggagcacgaaacaccactcgtacccaacacgaagttgtggtcctgcggtcaagatcacatncatccaacgtcagtgccactagccaccgacactgatcaccgaagacactccactagtccaactaacactaccagctagccactccgggccgggcgagggcgcgacgagccgccggcgacgggcgagcgggacgggcgggtggcgccggagcggcggggggcggggcgggtcgcgagcgagggcccgcagctacggggggtggggagggagcggcggcgtcgagggggtgatacgggcggggtgggggatggtgcgagcggggtgcatggagggggggggagggtcgaggacagcggccggggagagcagggatgcgcgagtcgctggggagggcgcgtagagcggacgcgagccgggccggggcggggcggcagtgctggcgggggcggggggcgcgcggccgaggagaggcgagaggcgggtcgggggacacgcggaggaggcggtctgagggaggaaggcaggggggagggggagagggacgggaggggcgcggatcgggcggggactccgccacgcgagggaccgacgatagatcagggcgcagggcgcgaggggaggcaggacgagcgccggtagacagcgcagggtcgatgccaggcgaggagacagtgcgggtggcgccaggcgtgcgaggcgatgagccgcagaccccacgagtgaggccggcaggcgggtacggacgggacggggcaccgtaagggagcggcggtcggacgcacgacgaagatggcggcgggctgcggtggcgtgggcacgagcgatgagggcgggcgaggggcacggacgcgcgcggcggaccgcgacgcaccaaaggcgaaggacgagacagcacgggcgagagctggagcag

SEQ ID NO: 730563 - DNA, 1031 bp, Homo sapiens
  misc_feature (367)..(367): n is a, c, g, or t
  misc_feature (395)..(395): n is a, c, g, or t
  misc_feature (397)..(397): n is a, c, g, or t
  misc_feature (414)..(415): n is a, c, g, or t
  misc_feature (420)..(420): n is a, c, g, or t
  misc_feature (437)..(437): n is a, c, g, or t
  misc_feature (439)..(440): n is a, c, g, or t
  misc_feature (442)..(442): n is a, c, g, or t
  misc_feature (456)..(457): n is a, c, g, or t
  misc_feature (476)..(476): n is a, c, g, or t
  misc_feature (479)..(481): n is a, c, g, or t
  misc_feature (488)..(488): n is a, c, g, or t
  misc_feature (514)..(514): n is a, c, g, or t
  misc_feature (518)..(518): n is a, c, g, or t
  misc_feature (655)..(655): n is a, c, g, or t
  misc_feature (676)..(676): n is a, c, g, or t
  misc_feature (684)..(684): n is a, c, g, or t
  misc_feature (698)..(698): n is a, c, g, or t
  misc_feature (701)..(701): n is a, c, g, or t
  misc_feature (703)..(703): n is a, c, g, or t
  misc_feature (707)..(707): n is a, c, g, or t
  misc_feature (709)..(709): n is a, c, g, or t
  misc_feature (712)..(712): n is a, c, g, or t
  misc_feature (715)..(715): n is a, c, g, or t
  misc_feature (719)..(719): n is a, c, g, or t
  misc_feature (725)..(726): n is a, c, g, or t
  misc_feature (730)..(730): n is a, c, g, or t
  misc_feature (732)..(733): n is a, c, g, or t
  misc_feature (736)..(736): n is a, c, g, or t
  misc_feature (740)..(740): n is a, c, g, or t
  misc_feature (754)..(756): n is a, c, g, or t
  misc_feature (766)..(766): n is a, c, g, or t
gggagtgtgggaagtctggcggttggaggggtgggtggggggcagtgggggctggggggggagttctggggtaggaagtggtcccgggagattttggatggaaaagtcaggaggattgacagcagacttgcagaattacatagagaaattaggaacccccaaatttcatgtcaattgatctattccccctcttgtttcttggggcatttttccttttttttttttttttggtttttttttataccccttcctttagcttatagtgcgcctcagaaaaccaaatttaaaccccccccccgatgttaacgggggggcagtgacaaaaagcaagaacgccacgaacccagcctgtggaagaccaccacgntccttgccccccgccatttatcgccctngntgggatttggtttttcnntctgntccctgtggctgggttngnntngaggttggacgccnnctgggggggcactggccantgnnnccccttnggagaagttcagaggggattggaganaggncatcttgtccggccgggtttcgggggacaggggttgtgtccccagaaattcctgagggcggaggggggggtggggcagggtctcctcaggtgtcaggagggtgctcgggaggccacaggagggggctccgtggctgncctgaggttgcccggaggggnaggggctncccggttttgtaanccngngggntnccntcnggcnggggcnngggngnnccncctnccgacacttgaggnnngcctcccctntccctcggggaccttttgtgcccgcccttaagagccctgcttgtgttctcccgggaggctccgaagcttctgggggccctctggggggacagggggggtgagcccggggaatagggacggtccagcggttcagcccccaaaaacaggaaatttgccgggtttgccctcgacctgttgtttggcctcggagccccggtctgggtgtgtctttggcccccggggccttggttggctgtgtttcgcttgtgtttctcgccccttgtgc

SEQ ID NO: 730564 - DNA, 941 bp, Homo sapiens
  misc_feature (367)..(367): n is a, c, g, or t
gggagtgtgggaagtctggcggttggaggggtgggtggggggcagtgggggctggggggggagttctggggtaggaagtggtcccgggagattttggatggaaaagtcaggaggattgacagcagacttgcagaattacatagagaaattaggaacccccaaatttcatgtcaattgatctattccccctcttgtttcttggggcatttttccttttttttttttttttggtttttttttataccccttcctttagcttatagtgcgcctcagaaaaccaaatttaaaccccccccccgatgttaacgggggggcagtgacaaaaagcaagaacgccacgaacccagcctgtggaagaccaccacgntccttgccccccgccatttatcgcccagaagtccatgagggcaggagggaagggggctagggacagggtcaaccccaagggtgtacagaggagggtgcctcggaagagccaacagggaagggggactccgggacgggcacctgaaggctgtccgacaggggaaaggggctaccggggtgtaaccagagggtcccacaaggcgggagacaaggagggaccgcataccgcacccactgtgaaaagaaacccttcaccaatataccatcagagaacaaatcttagacacggccccattccagacaccccgtgcgatagatctacagggagaggtcccgaagagccacgcgggggagaccactctgagggggggacaaaggagggggattacaggcccgagaaaagtatgggagagagacaagacacgggccattgaacacccagaaaacgataaagcatggcagagtttggtcccaatcgaccaggtgtctttgggccccggaccccagggctctggttgagccatacaacacacacgcgagcaataggattgcacagagaatggcaacggaagaac

SEQ ID NO: 730565 - DNA, 678 bp, Homo sapiens
ggtgcctgcttctccttctgccatgattataagtttcctgaggcttccccagccatgcgtaactctccttcccatttatgagagagccacatgacatcagcccatagactgtggagagtattccagatctatcacattctgcgattctgcgattcccagaaggctggtcatgaaaaaattccctcttcagtttacatatatggcagtgctccagtgccatgacagttttaatcttctggttccatctgcatagatttcagtctctaattgaggaaaatcatctgtttttctcaggagccccttgattcaagtttacacaaaatgtgcctttggagactatcctgttaatttaaacagttcagatcccacttgtatgtgagacagatgcttctctggccatcagccaggtaccactaaaggaggtacaggcacttctagatatctgttgaggcctggaaggggcaaaacaattcaggaagcagttgaagataaaggggtttaccatggaagagaagatccaggtgccttcatggaaatgcttgtggttgaaaagagatgaagatgagggtccctggaaagaggaagaaccagccaggaaaattataccattagcaagactggcatcagcaagtagttcgcagtgttggttgttcttggtttcgcaggattttataggag

SEQ ID NO: 730566 - DNA, 531 bp, Homo sapiens; identical to SEQ ID NO: 174251

SEQ ID NO: 730567 - DNA, 647 bp, Homo sapiens
ggtgcctgcttctccttctgccatgattataagtttcctgaggcttccccagccatgcgtaactctccttcccatttatgagagagccacatgacatcagcccatagactgtggagagtattccagatctatcacattctgcgattctgcgattcccagaaggctggtcatgaaaaaattccctcttcagtttacatatatggcagtggcacttctagatatctgttgaggcctggaaggggcaaaacaattcaggaagcagttgaagataaaggggtttaccatggaagagaagatccaggtgccttcatggaaatgcttgtggttgaaaagagatgaagatgagggtccctggaaagaggaagaaccagccaggaaaattataccattagcaagactggcatcagcaagtagttcgcagtgttggttgttcttggtttcgcaggattttataggagttctgaacactgggaagtccaagagcaaggcaacaacagattcaacatctggtgagagctactctctgcttacaagatggcactttcttactgcattctcacacagaagaagagaccagtactgtgtcctaccatggtggaaaggcaaaaaggagccaaacaggctccctcaagaccttttcttttctt

SEQ ID NO: 730568 - DNA, 797 bp, Homo sapiens
tgaaaaaggtgcctgcttctccttctgccatgattataagtttcctgaggcttccccagccatgcgtaactctccttcccatttatgagagagccacatgacatcagcccatagactgtggagagtattccagatctatcacattctgcgattctgcgattcccagaaggctggtcatgaaaaaattccctcttcagtttacatatatggcagtgaaaagacaagaggaatcttggcctcaaaaactgatatccatcataagatcatggtgaaatacagtctgaagcaggtccagagtgagaagagaaaagaatcacagaaatggggctggagtttcaactgtattaagccagaagactacctgcctccaaactttcaagaagccaacaaagttcctgactgtttaaactaatttgagttggatttctattgcttgtatctaaaagaatcctaactggaaaaaagaagttattgccagaagaagaaagaagaggagaagaaagaggtgtcataaactttctaagacagtgccttgcctgaagactatgagtttctgtgcatcctaggacctttatggaaattagataatttttgatgaagttaaacaattatattataagaaactcctcaaatcaagaataaataaaaacaagagtagcattaaaatttactgcagagtacattaatacagttcaaatctaaatgtctgctcttgcatttctgtgacttttcatgccatgctgaaaatctggaatggaaactctcatccatcttggtgatttcctagtgccctgagg

SEQ ID NO: 730569 - DNA, 409 bp, Homo sapiens
aaaagacaagaggaatcttggcctcaaaaactgatatccatcataagatcatggtgaaatacagtctgaagcaggtccagagtgagaagagaaaagaatcacagaaatggggctggagtttcaactgtattaagccagaagactacctgcctccaaactttcaagaagccaacaaagttcctgactgtttaaactaatttgagttggatttctattgcttgtatctaaaagaatcctaactggcacttctagatatctgttgaggcctggaaggggcaaaacaattcaggaagcagttgaagataaaggggtttaccatggaagagaagatccaggtgccttcatggaaatgcttgtggttgaaaagagatgaagatgagggtccctggaaagaggaagaaccagccag

SEQ ID NO: 730570 - DNA, 1187 bp, Homo sapiens
accagttgctaagaagttgttaccaagtttggtgaataattaaactcttggacatgacaggggaggagaattattgattcaaaggaccttagagctcaaaaggtcctgagagaccatcataaccaccctctttattttacagatacagcttctgaggatcacggggatgaaaggcgtgaactgggctcacacagctaatgcattaggacaccagaaaaggaagaaaagacagtggcagctgaagacatttcaggaatgcttcactgagaacctaagtcttgttctgggccataaagaaaaggggagggtgtggtttctataccagagataagaaaggagaaaattggacgtggaggaaagatatgagtaccaatccgagcgaacaaggaagagtgagtaaatctgtccagctggagttggagtgaaaaaggtgcctgcttctccttctgccatgattataagtttcctgaggcttccccagccatgcgtaactgagtgaggacctagaattttaatgtctaatatgcggtgtgaattaaagaagcggccttgctatgctgaccttttcaatattctaatctttgctttgctgacctctcaggcctcttcctggcaacagttaggcttttgagaggagagagagctgagactgttggctccttcccatttatgagagagccacatgacatcagcccatagactgtggagagtattccagatctatcacattctgcgattctgcgattcccagaaggctggtcatgaaaaaattccctcttcagtttacatatatggcagtgctccagtgccatgacagttttaatcttctggttccatctgcatagatttcagtctctaattgaggaaaatcatctgtttttctcaggagccccttgattcaagtttacacaaaatgtgcctttggagactatcctgttaatttaaacagttcagatcccacttgtatgtgagacagatgcttctctggccatcagccaggtaccactaaaggaggtacaggcacttctagatatctgttgaggcctggaaggggcaaaacaattcaggaagcagttgaagataaaggggtttaccatggaagagaagatccaggtgccttcatggaaatgcttgtggttgaaaagagatgaagatgagggtccctggaaagaggaagaaccagccag

SEQ ID NO: 730571 - DNA, 863 bp, Homo sapiens
  misc_feature (8)..(8): n is a, c, g, or t
  misc_feature (221)..(221): n is a, c, g, or t
atcccagncacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctgtgagttcctgggaggtgcagtgaggaatacatcaanagatgagcaacaatgaacctggagaaaaggaaatttctccagtgccccaggaggaggtgaagcgaatccaaagcatcccgctggtcatctggacaatttcttggaggctgtggatcagaatacaagccatctgtgggctctaccacaggctccaactattatgtgcgcatcctgagcaccatcgatcgggagctgctcaagcccaacgcctcagtggccctccacaagcacagcaatgcatctggtggacgtgctgtcccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtctcatgtatggcccacctggctgtgggaagacctgttggcaaaggcggtggcacatcacacaacagtgattcatccgggtcgtgggctcggagttgtacagaagtatctgggtgagggccccgatggtcgggatttgttcgcctggcaaggaaaatggcctgcatcatcttatagacgaattgatgcttgcaacaaaagattaatgtcaa

SEQ ID NO: 730572 - DNA, 759 bp, Homo sapiens
  misc_feature (8)..(8): n is a, c, g, or t
atcccagncacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaaggaggaggtgaagcgaatccaaagcatcccgctggtcatctggacaatttcttggaggctgtggatcagaatacaagccatctgtgggctctaccacaggctccaactattatgtgcgcatcctgagcaccatcgatcgggagctgctcaagcccaacgcctcagtggccctccacaagcacagcaatgcatctggtggacgtgctgtcccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtctcatgtatggcccacctggctgtgggaagacctgttggcaaaggcggtggcacatcacacaacagtgattcatccgggtcgtgggctcggagttgtacagaagtatctgggtgagggccccgatggtcgggatttgttcgcctggcaaggaaaatggcctgcatcatcttatagacgaattgatgcttgcaacaaaagattaatgtcaa

SEQ ID NO: 730573 - DNA, 662 bp, Homo sapiens
  misc_feature (17)..(17): n is a, c, g, or t
cgcaagcatctcttctnttttccacctcgccttccgcggattcccagcttgagaaacacctctttgccccgtcatgccaaagaggaaagtgaccttccaaggcgtgggagatgaggaggatgaggatgaaatcattgtccccaagaagaagctggtggaccctgtggctgggtcagggggtcctgggagccgctttaaaggcaaacactctttggatagcgatgaggaggaggatgatgatgatggggggtccagcaaatatgacatcttggcctcagaggatgtagaaggtcaggaggcagccacactccccagcgaggggggtgttcggatcacaccctttaacctgcaggaggagatggaggaaggccactttgatgccgatggcaactacttcctgaaccgggatgctcagatccgagacagctggctggacaacattgactgggtgaagatccgggagcggccacctggccagcgccaggcctcagactcggaggaggaggacagcttgggccagacctcaatgagtgcccaagccctcttggagggacttttggagctcctattgcctagagagacagtggctggggcactgaggcgtctgggggcccgaggaggaggcaaagggagaaaggggcctgggcaacccagttccccgc

SEQ ID NO: 730574 - DNA, 2047 bp, Homo sapiens; identical to SEQ ID NO: 398446

SEQ ID NO: 730575 - DNA, 2406 bp, Homo sapiens; identical to SEQ ID NO: 398447

SEQ ID NO: 730576 - DNA, 863 bp, Homo sapiens
ttcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgtttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagccagcccgctgagggaagggctgtcaccaatgagcctgaggaggaggagctgggtaccctatctgaggaggagattgctatgggtggtactgttggggagaagggctagaaaagttgccccggtggggcccagcagaatccagtgttgctgtggttggagaaggatgtgtcatcacacagtggcctccttacgtacaatgtcccccttgggagtcactggttgtggcccgca

SEQ ID NO: 730577 - DNA, 691 bp, Homo sapiens
ttcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacatgtcagcgagctgcagagactgtactgaaacagcaaggtgtcctggctctccggccttacctccaaaagcagccccagccagcccgctgagggaagggctgtcaccaatgagcctgaggaggaggagctgggtaccctatctgaggaggagattgctatgggtggtactgttggggagaagggctagaaaagttgccccggtggggcccagcagaatccagtgttgctgtggttggagaaggatgtgtcatcacacagtggcctccttacgtacaatgtcccccttgggagtcactggttgtggcccgca

SEQ ID NO: 730578 - DNA, 997 bp, Homo sapiens
  misc_feature (6)..(6): n is a, c, g, or t
  misc_feature (404)..(404): n is a, c, g, or t
  misc_feature (406)..(406): n is a, c, g, or t
  misc_feature (408)..(409): n is a, c, g, or t
  misc_feature (413)..(414): n is a, c, g, or t
  misc_feature (420)..(420): n is a, c, g, or t
  misc_feature (430)..(430): n is a, c, g, or t
  misc_feature (464)..(464): n is a, c, g, or t
  misc_feature (470)..(471): n is a, c, g, or t
  misc_feature (474)..(474): n is a, c, g, or t
  misc_feature (479)..(479): n is a, c, g, or t
  misc_feature (497)..(497): n is a, c, g, or t
  misc_feature (503)..(503): n is a, c, g, or t
  misc_feature (510)..(510): n is a, c, g, or t
  misc_feature (512)..(512): n is a, c, g, or t
  misc_feature (519)..(519): n is a, c, g, or t
  misc_feature (522)..(522): n is a, c, g, or t
  misc_feature (530)..(530): n is a, c, g, or t
  misc_feature (548)..(548): n is a, c, g, or t
  misc_feature (555)..(555): n is a, c, g, or t
  misc_feature (579)..(579): n is a, c, g, or t
  misc_feature (594)..(594): n is a, c, g, or t
  misc_feature (604)..(604): n is a, c, g, or t
  misc_feature (612)..(612): n is a, c, g, or t
  misc_feature (618)..(618): n is a, c, g, or t
  misc_feature (624)..(624): n is a, c, g, or t
  misc_feature (637)..(637): n is a, c, g, or t
  misc_feature (641)..(642): n is a, c, g, or t
  misc_feature (644)..(645): n is a, c, g, or t
  misc_feature (650)..(650): n is a, c, g, or t
  misc_feature (729)..(730): n is a, c, g, or t
  misc_feature (743)..(743): n is a, c, g, or t
  misc_feature (964)..(964): n is a, c, g, or t
gttagngctgagagtgcggagtgtgtgctccgggctcggaacacacatttattattaaaaaatccaaaaaaaatctaaaaaaaatcttttaaaaaaccccaaaaaaatttacaaaaaatccgcgtctcccccgccggagacttttattttttttcttcctcttttataaaataaccctggtgaagcagccgagacctgaccctgccctgcccggtggcccctgctagcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgcttggttcccgctcncntnncccnngctaangcccccagcnccggcactcgctctcctcctctcacggaaaggtngcggcnngtngcccngcgggcagccgtgccganatgaancccagtncncccaacnacnccatggcntcgctctacgtggggganctccacnccgacgtgaccaaagcgatgctcnacgagaagttcagcncggccgggcncatcctcnccatcngggtcnacaaggacataancacnngnngctcnttgggctacgcgtatgtgaacttccagcagccggcggacgcggagtgcctttgggacaccatgaattttgatgttatanngggcaagccagtncgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtggtttgtgatgaaaatggttccaagggctatggatttgtacactttgagacgcaggaagcagctgaaaatctattganaaatgaatggaatgctcctaaatgatcgcaaag

SEQ ID NO: 730579 - DNA, 937 bp, Homo sapiens
  misc_feature (6)..(6): n is a, c, g, or t
  misc_feature (344)..(344): n is a, c, g, or t
  misc_feature (346)..(346): n is a, c, g, or t
  misc_feature (348)..(349): n is a, c, g, or t
  misc_feature (353)..(354): n is a, c, g, or t
  misc_feature (360)..(360): n is a, c, g, or t
  misc_feature (370)..(370): n is a, c, g, or t
  misc_feature (404)..(404): n is a, c, g, or t
  misc_feature (410)..(411): n is a, c, g, or t
  misc_feature (414)..(414): n is a, c, g, or t
  misc_feature (419)..(419): n is a, c, g, or t
  misc_feature (437)..(437): n is a, c, g, or t
  misc_feature (443)..(443): n is a, c, g, or t
  misc_feature (450)..(450): n is a, c, g, or t
  misc_feature (452)..(452): n is a, c, g, or t
  misc_feature (459)..(459): n is a, c, g, or t
  misc_feature (462)..(462): n is a, c, g, or t
  misc_feature (470)..(470): n is a, c, g, or t
  misc_feature (488)..(488): n is a, c, g, or t
  misc_feature (495)..(495): n is a, c, g, or t
  misc_feature (519)..(519): n is a, c, g, or t
  misc_feature (534)..(534): n is a, c, g, or t
  misc_feature (544)..(544): n is a, c, g, or t
  misc_feature (552)..(552): n is a, c, g, or t
  misc_feature (558)..(558): n is a, c, g, or t
  misc_feature (564)..(564): n is a, c, g, or t
  misc_feature (577)..(577): n is a, c, g, or t
  misc_feature (581)..(582): n is a, c, g, or t
  misc_feature (584)..(585): n is a, c, g, or t
  misc_feature (590)..(590): n is a, c, g, or t
  misc_feature (669)..(670): n is a, c, g, or t
  misc_feature (683)..(683): n is a, c, g, or t
  misc_feature (904)..(904): n is a, c, g, or t
gttagngctgagagtgcggagtgtgtgctccgggctcggaacacacatttattattaaaaaatccaaaaaaaatctaaaaaaaatcttttaaaaaaccccaaaaaaatttacaaaaaatccgcgtctcccccgccggagacttttattttttttcttcctcttttatcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgcttggttcccgctcncntnncccnngctaangcccccagcnccggcactcgctctcctcctctcacggaaaggtngcggcnngtngcccngcgggcagccgtgccganatgaancccagtncncccaacnacnccatggcntcgctctacgtggggganctccacnccgacgtgaccaaagcgatgctcnacgagaagttcagcncggccgggcncatcctcnccatcngggtcnacaaggacataancacnngnngctcnttgggctacgcgtatgtgaacttccagcagccggcggacgcggagtgcctttgggacaccatgaattttgatgttatanngggcaagccagtncgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtggtttgtgatgaaaatggttccaagggctatggatttgtacactttgagacgcaggaagcagctgaaaatctattganaaatgaatggaatgctcctaaatgatcgcaaag

SEQ ID NO: 730580 - DNA, 1274 bp, Homo sapiens; identical to SEQ ID NO: 728593

SEQ ID NO: 730581 - DNA, 1571 bp, Homo sapiens; identical to SEQ ID NO: 728594

SEQ ID NO: 730582 - DNA, 972 bp, Homo sapiens
tatttttgtatttttagtagagatgaggtttcactatgttggccaggctggtcttgaactcctgacctcgtgatccccctgctgcagcctcccaaagtgctaggattacaggcgtgagccaccacacctggcccccttcaaatcttaacagagaagccaccaaagtctccttgggtccatcacatggatgggcctcctgggcccctcagaccctgggcttcccttgaggtcctggagctatgtgggctccagctctgggaaggtggacccccatgcatgtgtcctgccgtcactgtctctatggagtctggctcacactaagtgagccataaggccttcttcaaggtcatctgtcccactgatttcagactcagggcggagtgtgaaatcatctgtcccccacagtgcactcagaaccctgtctggactagggcacacacacatgcatgcgcatatgaacacacatatgcatatgcacgcacacatgcaaggctgcaagtctcatgcacacacacatgcacacacatgcacatgcatgctcacatgcacaggcactcaggcacctagagccttctcatcctgcactttgagtcccccctccccttgcccatccttgcccatccttcaaggcctcagtcaaaagccatcttttacaaattgtctctggttgactttcctttttttccctcttagaagaagcgatgctgtcctcagtcatcaagcgttcactaggcgcttggtgtgtgccaggccccgatgtgggtcttgggcatgttccagttctcacgtcctcagggctccttggtgagtcgagggtgaggaggacacagaggccaggaggcctggggccggtctgggtggccctcaggctccagagctcagcctccctgctgagtcaaggcgagcaggatacacctgtccggagctcgcggggagtgggcccttcggggtcccccgggtgggcacacaagg

SEQ ID NO: 730583 - DNA, 667 bp, Homo sapiens
ttggtggattcctcagtccctgccgccgcggggcgccctgggatagcggcggggcctcctgaacagatctcggcccctttccaaacactcctgatgcctcatttgcctctcgcttcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggctactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaag

SEQ ID NO: 730584 - DNA, 1196 bp, Homo sapiens; identical to SEQ ID NO: 728595

SEQ ID NO: 730585 - DNA, 790 bp, Homo sapiens
gaatgcagatgtgaggctggaggcagtagagccatctcgcaatcatgcagcaacaagcaaggcagagctggcatgttgttgactgataacatcgagaagctgctatattaatcctggactgccaatctctgaacttcttgagatgggtcttgctctgtcacccaggctggagtgcagtggcaggattgcagctcactggagcctccaaatcctggcctcaagcgatcctcccgcctcagcctcctgagtatctgggactacaggtgtgcaccaccacactaggctatttattatttttgttattattttgtaaagatagggtctcaccatcttgctcaggctggtcttaaactcctgggctcaagcgatgctccccctgtggcccctcaaagtgcaaagaaaacttaacagctttatccacagtgttattttcttttctcttgatgctgtgaattatccccttgatgtcagtgaagctggggttgttttgaaagacttaaatcaatacttccattgagaaaattggaccttgctggctaaagatgaaaagctggaaccctttccaacagctcacttctgtgggctgagatcaggggcagatggctcagtgtcccttgaggtgatttgattacccgtcacggccggacgcctggtctgggtacgtgaagagaagcacagacaggcagctgtagttacactgtttaaaaaagcagaggtactttttcaattcaatgacaggaaggcaaaatacccctacaggtttgaaggaaaaataatttttttcaaaatg

SEQ ID NO: 730586 - DNA, 718 bp, Homo sapiens
  misc_feature (327)..(327): n is a, c, g, or t
  misc_feature (330)..(330): n is a, c, g, or t
  misc_feature (336)..(336): n is a, c, g, or t
  misc_feature (350)..(350): n is a, c, g, or t
  misc_feature (354)..(354): n is a, c, g, or t
  misc_feature (356)..(356): n is a, c, g, or t
  misc_feature (366)..(366): n is a, c, g, or t
  misc_feature (389)..(389): n is a, c, g, or t
ggcctctctctccaccccacccctctttctggcgtcatcccctccccaacaccacctctgctgctgcctctggctgtggacctgcacctcttccccatccccgccaggcccggggagcggggtgagcctggatgagagcccccccaacctggggctctcccaggccatggcccgtgtgctcccagggaggagccccggaccctgagcatctgctggaggcttggcagaggccccgcggggaccgtgtcttctgaggacaaaaggcggcggccagcaggcagacggagggggggggtggggggtggggggggtagggggaccggcagncanggcagncagacgggtagcangggncnagcactggcncccctcccagcttggcagtggcntgaagatgggagtgggagtgctatagtggcggaagcaccttgccgggacccccaccttgccagctagttggacaccccagggctgtgtgctggcccacctggttgtcccccaggcacccccgaggcctacccaggtgcacccttccggtgcctgctttccctgatgcctgcgatttggaccagctcgggctgtttctccggccactgaaggcgggagtgtccctggccgccgatcacctagggtcccccatgtgccccgggtgtggttacctggggttagccgcttgaccccctcggggtttcaagaatcctgttagagccggtgattc

SEQ ID NO: 730587 - DNA, 1028 bp, Homo sapiens
  misc_feature (261)..(261): n is a, c, g, or t
  misc_feature (338)..(339): n is a, c, g, or t
  misc_feature (345)..(345): n is a, c, g, or t
  misc_feature (402)..(402): n is a, c, g, or t
  misc_feature (436)..(436): n is a, c, g, or t
  misc_feature (438)..(438): n is a, c, g, or t
  misc_feature (446)..(446): n is a, c, g, or t
  misc_feature (459)..(459): n is a, c, g, or t
  misc_feature (463)..(463): n is a, c, g, or t
  misc_feature (518)..(518): n is a, c, g, or t
  misc_feature (546)..(546): n is a, c, g, or t
  misc_feature (564)..(564): n is a, c, g, or t
  misc_feature (595)..(595): n is a, c, g, or t
  misc_feature (913)..(913): n is a, c, g, or t
  misc_feature (977)..(977): n is a, c, g, or t
  misc_feature (1003)..(1003): n is a, c, g, or t
tgctgggtgttaatcggccgagggggaaggcatgatggctggcgcccatggaggtggccgtgtgtcggactcggcggccccgatgtggagctgcatcgtgtgggaacttcactcgggcgccaacctgctcacctaccgcggcggccaggcgggaccccgcggcctggcgctgctcaatggcgagtatctgctggcggcgcagtgggcaagaactacatcagcgcctgggagctgcagcggaaggaccagctccagcagaanatcatgtgccccgggcctgtcacctgtctgactgcatcacccaatggtctctacgtcctggcaggagttgcagaaannatccanctgtgggaggtctccaccgggaaccttctggtcatcatgagtcgaaaataccaggangtctcctgccttcagttcacaggggaaagcagcnanttcatctnatggggcaaggantgcntggtgctggtttggagcctctgcagcgtgctgcaggccgacccctccaggattcnggcgcccaggcacgtctggtctcaccanacgctccccatcacgganctgcattgcggctttgggggccccctggccngggtggccacctcctcactggaccagacggtgaagctatgggaggtctcctcgggggagctgctgctctccgtcctctttgacgtgtccatcatggcagtgaccatggacctggctgagcaccatatgttctgcgggggcagtgagggctccatcttccaggtcgacctcttcacctggcccggacagagggagaggagcttccacccagagcaggacgccgggaaggtcttcaaagggcacaggaaccaggtgacttgcctgtcagtgtccactgacggcagcgtgctgctctcaggctcccacgacgagaccgtgngcctctgggacgtgcagagcaagcagtgcatccggacggtggccctcaaaggccagtcaccaangccgccatcctgctggcgcccgtcancatgctgagctcagacttcagccca

SEQ ID NO: 730588 - DNA, 838 bp, Homo sapiens
gaggcatggacgctttcatgggtggttacgcgacagttgccaggaccgagggcgaaaccggctgcaaggcattgtgggacattggaggacttggaatatgcgctagaaggctcaatccaagcccattggaagaggaagacgtacgcagcggagacagctgatccggagtcggggcggcctgccaggtgcccaacctctcccagagcatggcgtcttgggcacgcccctgccggcggacagtgcgtcctctagggccgggagctgcgggccgagttcgcgtgggccctgcgctttcatccctgccggggacgccggggttgcgggataaaccgctcgacacaccctgcctccctgactgcgcctgtgtgacacatacgttcactggtggggcacgcatcagatacggatggcagtggttttgaagtgggaggccctgtataaatgtaaacggttattactgtaaatgctctaacagagctgcctggggggcgcttccagggaagcgtggcaatctcaggccgggagaggagaggcgtcctgggccagggcgctgcaggaatacaggtctggcgatgtgcaagtacacagattcaccaggcaacagcattgcggcaagggtgggatggggaagccagacctaaggccagaaaaggagattgcgaccagagcatgcctgctgtgactgtcagagtaagtggtttcaactttattagagacttctaaggaatgacttggtcagctctgtgctttcttgccttcaagagtgtgtgctgggcgctggcactgcgctcaagcagatgataatcaagacacatacctggtgtgcgaggagcttatg

SEQ ID NO: 730589 - DNA, 916 bp, Homo sapiens
  misc_feature (687)..(687): n is a, c, g, or t
  misc_feature (693)..(693): n is a, c, g, or t
  misc_feature (702)..(702): n is a, c, g, or t
  misc_feature (713)..(713): n is a, c, g, or t
  misc_feature (722)..(724): n is a, c, g, or t
  misc_feature (734)..(734): n is a, c, g, or t
  misc_feature (746)..(746): n is a, c, g, or t
  misc_feature (751)..(751): n is a, c, g, or t
  misc_feature (765)..(766): n is a, c, g, or t
  misc_feature (768)..(769): n is a, c, g, or t
  misc_feature (771)..(771): n is a, c, g, or t
  misc_feature (786)..(786): n is a, c, g, or t
  misc_feature (795)..(795): n is a, c, g, or t
  misc_feature (815)..(815): n is a, c, g, or t
  misc_feature (818)..(818): n is a, c, g, or t
  misc_feature (820)..(820): n is a, c, g, or t
  misc_feature (831)..(833): n is a, c, g, or t
  misc_feature (841)..(841): n is a, c, g, or t
  misc_feature (843)..(843): n is a, c, g, or t
ccgcgccagtgtcccgccgcctcccgcaagcggaaatagttcccggaacgcctgcggtcccgggccgcctcccagactccaggggagccgtccctccaactcccgggagctgccgagggaggggcggatccgggccagctcctctgccagagcccagcccagagagggtgaccgggggacgcagggccgggtttccagccccacgagagggatggtgtagggaccggggcgtcgcggcgagacgcctttcctcgggggggggtgcgggggggcgcccacctcctccgtgtcggccggagggtctgcaacagcgggtggaatttttagcacaagcgagggaggaggttggagcgacgagaggcgggagcggaaagggcgcggaggccggggctgcagcgcgctccaccgcccagctgcaggtggcgcctctcgccacccgcaccccgctgcgcccagggaagggccgatggcgcgccgtcctccctcctcccttcgggaagcctgcgacgtcccatcccctccgacgcaggcccgggaaaggctcaaaaggttcgaggtcgcgttcctgctatcccgcgggcttctctcactcttagatcccgcaccagaggaagcggatctccttgagtgggcaaagcaggggtgaggggctgggggcagttccactgacaacgggacgggggcganaggggnttacccagntacatacaganacagcagannngaaatctatntttaatggcttnggctntatagcacgaagcnngnncncctctcgttcaaggnacacagtcntctctactgcccactcctgnggncnttaaaatcgannncctgagtncnagaggggtcacgtgccagggcagcagtgaagggagaagggtcacagttcacttctgtgacgtatcggacaccc

SEQ ID NO: 730590 - DNA, 857 bp, Homo sapiens; identical to SEQ ID NO: 724096

SEQ ID NO: 730591 - DNA, 1048 bp, Homo sapiens
  misc_feature (829)..(829): n is a, c, g, or t
  misc_feature (831)..(831): n is a, c, g, or t
agtttcccagaccctcgtgtggaggcttggtcaaaaggcgaaacctgaagaaatactttagcacaggatgaaggaggaagtggcagaagggtaaaaccaacccctgtcaaacttcaccaagtggctctgccccggactcagctccaccacatcctactcttattgggagccaagcaagaaggactaaggtgactgggacctgggcagtgggagaatgggcagtgggagaaagatcatgaggaagcagaaggggctttgttttggtccagggaaccaaatccagcactataaccgccaccagtcctgggagtcactggcagaaaaaatcagaacagggaatgcaaaggtgctgctctgcctctactgagcacccctccccatctctaagcctcattcttatattctataaaatggggattatgacatccacctgtgtgtcctgttgacctgtttgtaaaggtagaataaggtaagtgagtatgaaagcactttaaacatgtaaagcactatattacaggctttttctcactcaactgaccctagtcattaggatgggtagacatgacaagaaggaagaagaatgcagatgccggggagcagagactgtgaacatctcaattttgcataacagaactatggtgatggtcttatggagcagctagtccaggttctcatttgacaaggaagctaaagcccaaagaggggaatgaatgttccatggtcaagagatgatcagaggacaaacctggtccacggatgccaggccagtcctttatcaacccaaactctggttgcccaggtgaaggctctagaggagaacgcaggccanancaagggggcacaccggaaacgcgggaaagaccacaagaggacagagctcaggggggtagtagctacatggaaaaaagtgaagcacgaagaccaaaaaaacatataaaagaagaacaagacgcatacacagtaatgtcaacaagcgaacaaatactaaagcgactaaataaatatttatatattgctgttttttttttttcttcttttaggagacgga

SEQ ID NO: 730592 - DNA, 643 bp, Homo sapiens
taactgggaagctgtgccccaaaaggagcttcaaagaagagccccctccacatcctcaggagaaggactcttggttggaaaaggcctggaagtgaccagtatctatggtgcttcgtctctttctcaggcccataaggacagaatttacatttgaaaagaagaacaacacagaaacttttgcaaagggctgccaatactttttctctgaggaacgtgcaatgtgatgaacaaaatttttttcccagaaagccagaggctgggcaaaggcagaggggcctggaggctgctcccaggttgggatttccagttccttgatgaagagaagttacgagactgggcatccttgctttgttcctaaacaggaggtgaaaacattcagtcttctgccattaggtctgccttattattttcgtcagtgttgtgcaggagaatccacttagaagcctgggtaaaattgtattacatgatcttgggtttggtccctgagaaagagccagattaacgctggcaggacaagaaagcaggagtgcccttcaaacacgctgctgaagggcaactggaggttccggggaaatgtgaagaaagaaacgcaaacacccctaggaaccaggttggtcttgtgaattgatttccagaggaaggc

SEQ ID NO: 730593 - DNA, 921 bp, Homo sapiens
  misc_feature (18)..(19): n is a, c, g, or t
  misc_feature (26)..(26): n is a, c, g, or t
  misc_feature (34)..(34): n is a, c, g, or t
  misc_feature (698)..(698): n is a, c, g, or t
gaagccaagccgcagctnngaagccngagcggcngaactcggcagctccaacccaactcggcttaactccgcctcaccgagcccagtccaagactctgtgctccctaggtttgcaacagctctctggatgccgtggcaagcatttcgcagatttggtcaaaagctggtacgcagacgtacactggagtcaggcatggctgagactcgccttgccagatgcctaagcaccctggatttagtggccctgggtgtgggcagcacattgggtgcaggcgtgtatgtcctagctggcgaggtggccaaagataaagcagggccatccattgtgatctgctttttggtggctgccctgtcttctgtgttggctgggctgtgctatgcggagtttggtgcccgggttccccgttctggttcggcatatctctacagctatgtcactgtgggtgaactctgggccttcaccactggctggaacctcatcctctcctatgtcattggtacagccagtgtggcccgggcctggagctctgcttttgacaacctgattgggaaccacatctctaagactctgcaggggtccattgcactgcacgtgccccatgtccttgcagaatatccagatttctttgctttgggcctcgtgttgctgctcactggattgtgggtctcggggctagtgagtcggccctggttacccnaagtgttcacaggcgtgaaccctttggttcttgggttcgccatgatctctggcttcgtacaggggacgtgcccaccttgggagctccgaagaggcctaccaattggtcttggtgaacctcatggaccctattgctggggcccgggcccggcggttgtgcctcggctcgaggaatctccgggcgcgccggttatcctcggggccctgctgccccgggacgccac

SEQ ID NO: 730594 - DNA, 945 bp, Homo sapiens
  misc_feature (18)..(19): n is a, c, g, or t
  misc_feature (26)..(26): n is a, c, g, or t
  misc_feature (34)..(34): n is a, c, g, or t
  misc_feature (722)..(722): n is a, c, g, or t
gaagccaagccgcagctnngaagccngagcggcngaactcggcagctccaacccaactcggcttaactccgcctcaccgagcccagtccaagactctgtgctccctaggtttgcaacagctctctgatcatcttcttcaattcctgctaggatgccgtggcaagcatttcgcagatttggtcaaaagctggtacgcagacgtacactggagtcaggcatggctgagactcgccttgccagatgcctaagcaccctggatttagtggccctgggtgtgggcagcacattgggtgcaggcgtgtatgtcctagctggcgaggtggccaaagataaagcagggccatccattgtgatctgctttttggtggctgccctgtcttctgtgttggctgggctgtgctatgcggagtttggtgcccgggttccccgttctggttcggcatatctctacagctatgtcactgtgggtgaactctgggccttcaccactggctggaacctcatcctctcctatgtcattggtacagccagtgtggcccgggcctggagctctgcttttgacaacctgattgggaaccacatctctaagactctgcaggggtccattgcactgcacgtgccccatgtccttgcagaatatccagatttctttgctttgggcctcgtgttgctgctcactggattgtgggtctcggggctagtgagtcggccctggttacccnaagtgttcacaggcgtgaaccctttggttcttgggttcgccatgatctctggcttcgtacaggggacgtgcccaccttgggagctccgaagaggcctaccaattggtcttggtgaacctcatggaccctattgctggggcccgggcccggcggttgtgcctcggctcgaggaatctccgggcgcgccggttatcctcggggccctgctgccccgggacgccac

SEQ ID NO: 730595 - DNA, 764 bp, Homo sapiens
ggaacagagcttgtcatgaagcgggaggggagggtatgcgtcagaaaagaaatgacaggtttgaaatctgcagaagctcgtctttcctctccgcctctcctccccagccggccccgcccccacctggcttcctaaataaagaccttcctctgcatggagaccgcctcactcaaactcaccccctcgtgcatatgcagagtctcaaaagacacggccccgcccccgccacagcgagggtctgaatgggaggttggaggagagcatctgtgtcccagacccggcggtggggggcccagggtgctgggcacatcttctggaacccgggctcgccgaggcaggcgagagctgtcccctcgcctctgttggggatgcctgccaaggttagccatgggcgaggccagggacagcgcctgggtggtgccaaggggactgtgagtcacctgtggataggagggctgagtgaggaggggacacgggccctgggcctcaagggcaccatctgaagatcccataaggatgaggacaggggaggccagagggcagaaattcaaggcaacggaacagctctagatgggggatgcccctggcatggggtgggtggaggccagggacgctgctcggctccccgcagtgcccaggacagcccaacccagagaatgatccggcccaatgccacagtgccgagggggagaccctacattcatctggaaaaaaatagacttcgatcccttctcactccagacaccaggataaactcctgatgg

SEQ ID NO: 730596 - DNA, 366 bp, Homo sapiens
cggggtgaggtcgccaggccctgcggtgggctgtatgtgtgttgtctggatggtgcaggtccggggtgagttcgccaggccctgcggtgagctggatgtgtggtgtctggatgctgcaggtccggggtgagttcgccaggccctcggtgagctggatatgcggtgtccccgtgtccgaatggtgcaggtccagggtgaggtcgccaggcccttggtgggctggatgtgccgtgtccggatggtgcaggtctggggtgaggtcgccaggcccttggtgagctggatgtgcggtgtccggatggtgcaggtccggggtgaggtcaccaggccctcggtgatctggatgtggcatgtccttctcgttta

SEQ ID NO: 730597 - DNA, 814 bp, Homo sapiens
gggggggggggagaacccaaacctacggctaggtacgaggctgggtggccccaaggaccttgagtggagacaagtcacaggttcttttcctgacttaggcacaggctgggcagctggaagggctgcagaaggggcactggcagccactcagtccccccgcgtgccttgcccagcccctcagctgtgcatttttctgggctaagaagacaaaacagacagatgctaggctgccaagtgatctggacaggacagtcttgtgggggagtgtgtggaggggtgtttttctgttcttgaaccctcagccaaagtgggaagtgcctttaggggctaggtgcccacacagatgctgagaaatgcccagactgccctccatgaggctgcctgctcaacaacactccttactttgcttgacccaggtcactgtgacctgcccatttttcccctgcatccagggctgaggtggagaggggcagtgtactcctgcagcacaggtatgggaggaggcagctgtgggagggagggagagaaggacacaggcactgctcctgtgcaaggaagactccctctcactcttcagctggcagtggggtggctgcccagaaccaggctgtctggatcaaacccagcttttgcacttgtgaccttcaacaagtttctgaacctctccgatctgtttcttcaagggagatcatcatataacctgtgtgataggctgagattgaatgaataattgatatgaaatgtgaatagtgcctgagcaggcgtggtggtcacacctgttatcccaacactttgggaggctgaggtgagcaga

SEQ ID NO: 730598 - DNA, 1569 bp, Homo sapiens
  misc_feature (599)..(599): n is a, c, g, or t
  misc_feature (1042)..(1042): n is a, c, g, or t
  misc_feature (1145)..(1145): n is a, c, g, or t
  misc_feature (1148)..(1148): n is a, c, g, or t
  misc_feature (1163)..(1164): n is a, c, g, or t
  misc_feature (1216)..(1216): n is a, c, g, or t
  misc_feature (1238)..(1238): n is a, c, g, or t
  misc_feature (1244)..(1244): n is a, c, g, or t
  misc_feature (1253)..(1253): n is a, c, g, or t
  misc_feature (1263)..(1263): n is a, c, g, or t
  misc_feature (1276)..(1276): n is a, c, g, or t
  misc_feature (1282)..(1282): n is a, c, g, or t
  misc_feature (1285)..(1285): n is a, c, g, or t
  misc_feature (1292)..(1292): n is a, c, g, or t
ggactcgcgggcttggctggtctcggctcgattagcacgctcgcgacgtccgcttcgtccatgtctgtgggttagtcaccaaccggctatcggacttagacgagtccgagtagtgctagtgctggtgcattggagctcgtcgagcaaagcggtctgatgacaagctatggacagatggctcatggtggcgtagagctgaggaatgatatgaacgatacccaaagagcatggattgtccagcaagatgaccaatgggatccggcatgaaaggttttgaagggtaggcttgagacgcaccctttatttccggatcctaatccagtaatgctccggtgtaatttattccaggtagtattgtcgacctatatgtgcctgggaaagagatttattgaagcatccatgaggagagagagcatatgggaaggcctaaagcgtttgtggacaatagaaggtgtcccccggttctagtatccgctagtcctggcttgacctaaggactatcttaatgagcttgggaagataaggaagggaagaagaaagatgaacaagaggcatgcgcaaggctctgagcaccttgcgtcagaagatccgaaaatacnacgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggcatgaggaggaggcaggacanatgaaggcggggagtgggaaacgggtccggggcggagctgcccgtcggttaaggagaagccaagaaatgtttgccaagggaactgagatcacccatgcatgtngtnatcaagaaactgaanngagatcctacaggcacgaggcacgaagggaactgatcgtgctgcccaagatngagctgctgccaactgctggtncagatngcagcgganaacaacctgngagagggcgtcantgtcanganccagtcnatatcatcgcctctctctatgacctaccaaaccccaaccttggcacacctaccatgaaagccaaagattctggcgcgaagcgcccttgcaacggcccccaaacgcaagcctgacatgagatcatcactgatacgccaaaagatccccaacaatcccggtagcgcgaagccatcatcctgcgacgaagaccgcaaacactgggaaacgacgaaccagaccacgcgtgaccccggccacgacaccatacacacggcggcagcaacggacacaacactcc

SEQ ID NO: 730599 - DNA, 720 bp, Homo sapiens
ctcccctgctcactcctcactccccagccctctctgccatgcctgctcactcctcagtcttacgtcattacacgtcacttctatcagggagggtctccctgatccacctgtccacagcgtggcatgctttctaaaagcgctctgcgatttccttcacagcaccgtcacccgtgtagccatgcctgtgtgtgactgatctcatgtctctcccaccacacttcaacggccaagagggcaaggcttgtggcagccttgcacagtgggatatacttggaccctcctcggcaccagcacacgggacaggtcaacgtctgataagagaatcagccacttcctggtacaccccctaacacaccccaggctgtggacgcgaggtccaccccaggcacagccacttcccctcagtccaccatgggggttccaccgtctttcaagacagagccctaacctcaccctccctgacaccttgctcccttcaattactctcacatcctctgtgatccccccaaaaagctgactcttcctaaaccactatctcagtttcacataatgtcatgcacatggtctgttttttctactagatttattttctttcattttattttgacacagtcttgctctgtcacccaagctggagtataatggtcccatcacagctcactatagcctcaactcgtgactcctgggatctccagcttcagcctctcaagtagctgggac

SEQ ID NO: 730600 - DNA, 1112 bp, Homo sapiens
  misc_feature (729)..(729): n is a, c, g, or t
  misc_feature (733)..(735): n is a, c, g, or t
ccagaaaagtgctttaggctgggggacccaggaatacttcgccaacgagaagggtttgagacggacgtgagagaagaaggtggtgtgagtgtcctggtttcctggctgcccaccatcagaacctcctgcctacatttggggaattcccatcgcaagggccctaatggaaagcaggccaccatttgccacaaagccccaatgcttgctctccctgactcggctctggggttgcaggcagaagacatgagctccgccaatcggatgctccaactgggaccttgaatctggagcaagtcacggaatagcaaggctggtttaggaattcatttctgcggcggcggtggaggcgatggggccaacagcggcctctagtgtctggaggaggaagtgtcagcgctactgccgcagcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttctgtggatctggagcctacggtcattgatgagatccgaaatgggccataacgaaaggtcttccacccagagcaggtcatcactgggaaagaggtgctggccaaaatatgccgtggtcctataccntggnnngggatcttggcccatgctgggtcggggaccggcagctgttgtacccgtggccggcgttagggggccgggggtccacgatgtggggggcccggccgtggtacccaaccccgagaagggggcccttgagactgaggaaaccacgggggagtacataacacgacccccgaggtattgtagggggggccgaaaaatttgtttgcacacccaggggaacagagtcctgtgtgggcaggaaaaatgctccgtagtaaggatgagtggcccccagccagcatagtatactagtgtagagaaaggagcgtcagacaaccaaactaggagagcgcgagcgcgtcggctttcgtactgcgtctgtcttgatccactaaccttagtat

SEQ ID NO: 730601 - DNA, 813 bp, Homo sapiens
gtggcaggagaggggggcctgcgtgtgaccgagcgtgcgtgggaggacgcgcgtgtgtgtctgtgcgccctgatcacggtggtctgtgggtggggcggatcgtgcacgcgcgcccgatctgtgcgccccaagccagccttgccttactggtaccagtacctgcctgctgctaccaactagtcaacatgtggcatcttccaggccactgtgatgagtcagggatgagcatctgactctggttggtccaatcagcttgtccagggactttggctgggaagattggaaaggaggccagctttttgggctggggttgctgagagatgtgatgatgaaatgtgtggcctacctggcatctggccccagcttcagctccatttactgtcttgctccccaccctcactagcctgcattgaggcctcctctgtgccccccaacccctgagtttctcatccccagagagcccagctacacagaattgaagggttttctcattcatcttcctgcgctcaccctgaagactgggcctatgtcatctgctaaccactgtccccccagcactcacagtggaaaatggagtgttatgcagccctgcagcttgccttctagaacagttcacaggcaaggctcccaaatgaaccctgtacagccagatggtgccagcaacacagagctacttgttacatcagctcagactaagccaacccaaaggagcatctggtgattccacagaaccacaagagacttgacctcctggaaatgaattaaccaagattaatgaaaaagattaaggtcatgtgccctgtaaaaatgtcc

SEQ ID NO: 730602 - DNA, 610 bp, Homo sapiens; identical to SEQ ID NO: 171413

SEQ ID NO: 730603 - DNA, 760 bp, Homo sapiens; identical to SEQ ID NO: 171608

SEQ ID NO: 730604 - DNA, 774 bp, Homo sapiens
  misc_feature (640)..(640): n is a, c, g, or t
  misc_feature (657)..(657): n is a, c, g, or t
ggcaggatcgaggccgcgggttaagtcggccgaggggcagaagcgcatgaggctgtgggacttgccttccatttgatttctgaattgtgaaggtgcatgctttctggaggcctgcacagacctttcccacccgctttcctgaaagaatttgacagggaaagtgagaccgcaggaaggctttttgggggaaggtttcttcaatgctagactctctcaggcagagctgcatcgggccccctgccttccctgctcccaatttcctgagaccgcccgcccccacccagaattggggatcttgatcaggtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggcacccaggtggaggggcaggncaccaacctgcagcgantggccgagccgtcccagctgctcaagtcggcattgtgccatctcatcaactaccaggatgatgcccagctggccattcgcgcctgccgagctcacaaactgctcaaacgaagaggac

SEQ ID NO: 730605 - DNA, 1232 bp, Homo sapiens; identical to SEQ ID NO: 490411

SEQ ID NO: 730606 - DNA, 2607 bp, Homo sapiens
ggcacgagggataagtattgaggcgctgctatgggggccctgctaggaggatttccctggactcaacgggttcctgtccaaggtcctttcattatccttcttcgccgatggagaactgagatccagagagtttaactaactcacccaagatcacatcagctactggggtggaagtaggagctgatcccagaccaacttgctcaggaagaaaggttttctcctgtgttggatatggtagagcctccgtacataccgggttcatctgaattctcagcctcagctgcggtcacgcgcatcaccagcctctcacctcccaaatcacaccaaagaagaataaaataggcatccatcggaaattcccgtctgctttcgacacacatttttgtaaatgttcgttacatcctagtaggggtgagtgtgtgtctaaggcaggcatgttgatggggttggggaagttatggcccaccttaaacgtaataaccttgcgcagttctttgggggctgcgagtacactacaggcatgaatgttcagtcacctgatcttcattccagacgctaggaaaagcaggccggtgtaaggaagaaagcctttcaaatttgtattggctcctatttagtatttgtcagggtccagggctgcactccagtgaacgcctcacttaggaaagattggacactcgacagaccacatatttatctcgctctctgtcggtcagtgcgttccaaagcccaagccgttatggaaaacaggctcggaaaaatgcatatttcccccaacatctcagactaacaagctgccccttcagcaaatatcctattgccccagccacggggatcaccttcatgatgccccctccccatcagagcgtataaaagagtccctatgcttcccataggcctcatgacctcatctctcctgcacagtccacttggtgttaatgggcccagtcaaaaggcaggactgttggacgccagtgttccttattcgaccatctgtcgatcaaagtgaccacacaaaccccgctttgccgtcgcagtacctccacagcaacgccacggttctccctcttcctctcacacgcttctccccatcccacctgggtcctgccgcctcctcccgagagcaaacgtggagctatttgtccaagcgtcatatgcgagctgcaggagacgctcataaatccctgccctgttctctggcagtttcagacgttgtcgggcccagaccctccttttctttcttaaaggtcacaaaatctaattagaaccattgctaactgtatattctcgttgtcggtaagccttaaataataaaaatcagaccaaatgagactaagcaagggagatggaaaatcgatgtcatatttgttccaagtaatttcccttcagaagagaaaaggctcttaggactggtttgtgaatttaaaagatgtttaaagttgcatctaggcatcggaacatcaaagtcaaccccaaacagaatttcgctggatgatctctccttattcccggaaaagtcagtgctgtttggtagaagggcctaagacggggtgacagccttcctcttcctgtctgttttaagcagttgtggctttgccaaaaataaaaataatttctttgaaaaacggaaaaaaaaaaaaaaaaaaaaaaaaactggagactagttctctctctccctcattgtacccattctaatcgcaatggcattcctaatgcttaccgaacgaaaaattctaggctatatacaactacgcaaaggccccaacgttgtaggcccctacgggctactacaacccttcgctgacgccataaaactcttcaccaaagagcccctaaaacccgccacatctaccatcaccctctacatcaccgccccgaccttagctctcaccatcgctcttctattatgaacccccctccccatacccaaccccctggtcaacctcaacctaggcctcctatttattctagccacctctagcctagccgtttactcaatcctctgatcagggtgagcatcaaactcaaactacgccctgatcggcgcactgcgagcagtagcccaaacaatctcatatgaagtcaccctagccatcattctactatcaacattactaataagtggctcctttaacctctccacccttatcacaacacaagaacacctctgattactcctgccatcatgacccttggccataatatgatttatctccacactagcagagaccaaccgaacccccttcgaccttgccgaaggggagtccgaactagtctcaggcttcaacatcgaatacgccgcaggccccttcgccctattcttcatagccgaatacacaaacattattataataaacaccctcaccactacaatcttcctaggaacaacatatgacgcactctcccctgaactctacacaacatattttgtcaccaagaccctacttctaacctccctgttcttatgaattcgaacagcatacccccgattccgctacgaccaactcatacacctcctatgaaaaaacttcctaccactcaccctagcattacttatatgatatgtctccatacccattacaatctccagcattccccctcaaacct

SEQ ID NO: 730607 - DNA, 1221 bp, Homo sapiens; identical to SEQ ID NO: 174501

SEQ ID NO: 730608 - DNA, 717 bp, Homo sapiens; identical to SEQ ID NO: 176524

SEQ ID NO: 730609 - DNA, 708 bp, Homo sapiens
  misc_feature (233)..(233): n is a, c, g, or t
  misc_feature (393)..(393): n is a, c, g, or t
  misc_feature (420)..(420): n is a, c, g, or t
  misc_feature (442)..(442): n is a, c, g, or t
  misc_feature (465)..(465): n is a, c, g, or t
  misc_feature (529)..(529): n is a, c, g, or t
gcagccacgccactccctcctgagagcccaccgcgccacagcttggaggaagagcctgcggggaactggctgcaggacgctctcttcttgagtgcaggtgctggctctgctgtgaccatgcccgtgacctttgccctcctgctcctcctgggccaggccactgcggacccatgctacgatccacagggcctgccccaattctgcctcccgccatgtgacacagctggcatgcntgtggctggcctcctgccctcaggcctgtgccctgtccccaggaaaccaccttgtgcgccagtggaaacctgcaatggcagcctgacatttggccctgggtggccccttcctcctgacatcttgtcagcttgcgctttctgtaccccaggacccccagcncctcatcctgtctgctgcctggggccntcagtggtggtccctggaggcntgctgttggcacagggcccgccntggcctggggccttagtgggtgccctgaaacgggtgaccttccactccacaccagtgtcctaanggccactgtgtgcggccatgccacctccgtgtggagtttgggggccaggccgtggctagctggcagctggtgctgagaggccgctgccagtgtcatggccacgctgcccgctgtgccgccctgtgccggccccccgctgcactgccgcaatataccactggccgggtgcgagagctgcg

SEQ ID NO: 730610 - DNA, 670 bp, Homo sapiens
gctccccatgagttcagggttggctctatcctgaacccaccataggggcccagctttcaaaatgtgtgggtggtttgttttcaaagagagagaaggcggtgggcaggaagcaccatcccagatctgctgtcaccaccagataatctgttgtcataaaccccagaactttccatgaggctgctcaaatgtgctcggccttcccaggccggtgttacggccaggccgcctcctgcttgcagctggtgaggacggacagggcatgctgtggcctctgtgaggtcgcaggcccaggcgtgtgaaggaagagaagacacagggtccccatgacctccagagaggcctcctcgccctgtcctggccaggcctgccccggaagcaccccttgcgggcagttagagcagcgacgtccccgagcggcacctggtttcctctccaagctcagctgcagctggggtggcggcaggacctcggctgggtcctcaccagccctgggcctccctggcaaagtgggctgtggacgctgggcaggccagaccccagactcctggctccctcacccaggcctgggagtggttctcagtttgctcagtgccccccagcccactgagatcaggtccttatggctggagccagggatctgagctccctccctttcctggcctctcgaagc

SEQ ID NO: 730611 - DNA, 1196 bp, Homo sapiens
cagcagctgctgcctagaagggaggagaggagtgggagtgagccggagagggtgaagcaggcaggaagctgcaggccggcggtggatggggccaggaagcatgcagggggagtgaggaccgtgtatgagagaaacactgcccaagagagaagaaagaaaatcacaggacccgaggaaaaagaatgagtggtgtgttcagagatgacacatgacaacaaattgtttgcttggaggattttcttacgcgtgcgtgtttaaactggcctcaaggaggaagaagaaacatgcgttcctggatgactgagttctggaatattctgtcataagactttgcaactggagtagccccagaaaaaggcaggcagtgggagttggctccctccccaaagccatccctgagttggctttgttttgggttcctcccaggtggaatttaggcaaaacttacagtattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcccgaggggtacatgttcatatggaatggtgaggtgtcacccaacctttttgaagaaattgacaaggatggcaacggagaagtcctcctggaagaggaaggtgggaccgaagagctcagggagcctggtgaggctgtggggccggttctgaagggtggccaatgtcttccgtatcgcggaatccagtggtcagctctcacgctcctcttaacttcaacacagctgattcccctacaggatgcatctttctctggcttccaggacaccacacttcatggtgttccttctacctccctgctccagtccagtcttctctctccacttcacactcatgtgttcagctgcctgcttgatgtcctcatttacggaacccctgctatccacccgcacaccccgcttggggcctgctttacccaaagcctttcccgtcgcagtcagtggcatcactggcctccagtggctcaggcgagagcactcggtgatctctcactcctctttctctcgtaggccgtaatggtcctcaggaaatcattccagctctaccttgagagcacac

SEQ ID NO: 730612 - DNA, 736 bp, Homo sapiens
caccatccatgtaagatgtgacttgctcctccttgccttctgccatgattgtgaggcctccccagccacttggaactgaagcaaacactgctattgccacctttttgcagaggaaggtactgaggtgaagcgacttgcccaaaccctacaaaaataactggccattgcatcaacagcagtgtcaagagcatcatagcatcggatgatgatggacagatgcctctgctgcagagttatgcccccgccccaacactcaattggcaatcatctggggaagtctgtcacaatggtccctgtccacctttcttttagtggtttcagcatctgtcaaaggttcttatttgaatttccatcctatcaagggctgcaaaatggtgactttctgaccgtattattgcatctacattcacagctgacattcttcaataaagaaaagttttccttcatcaagtagaactatttagttatgctgaaattcagtatcttctagaaagacattaaatctttaattatttttaattctcaattctcagaataaccaattcatgtaataatcacctccagtgatggcaaatgagttttgttttggaagacattctcttttctagttatgtacttgcggagttttatatattcatagtcatttttaaatgctcaggttgtctcacacttgccactgtatactcttcaactagaatgctacttaacccagattaaaatccacgtttcccgtgta

SEQ ID NO: 730613 - DNA, 469 bp, Homo sapiens; identical to SEQ ID NO: 728600

SEQ ID NO: 730614 - DNA, 1307 bp, Homo sapiens
  misc_feature (801)..(801): n is a, c, g, or t
  misc_feature (1255)..(1255): n is a, c, g, or t
  misc_feature (1267)..(1267): n is a, c, g, or t
  misc_feature (1271)..(1271): n is a, c, g, or t
  misc_feature (1276)..(1276): n is a, c, g, or t
tctgtgtcattggcgtaccagtgctacacgggttagcctggactaaaggcatccttgtcttgtgagctatacacctcagtagaaagaggatctaagggaatgatcactgtagtttagttctgttgacctgtgccaccttacccctttgtgaattgtctgcttggtatttactaattccacagggtcatcagatgcctgcttgataactatatacaacaataacataacatactttcacttcttcctattgtaatcgttgtgccatggatctgatctgtaccatgaccctacataaggctggatgtgcaccatcacgtgctgagtggccccatatgtactgtgtggctgtgggtgtgggtgggagtgtgtctgctagagtcacacggcaacacgattttcaagattctaaagctcaattcaagtgacacattaatgataaactcagatctgatcaagagtccggatttctaacagtccttgcttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttttggggttaaaagatggttggtagcntttaaaagggaaaattttctcctgggttggctagtatctggggggtatcctcgtggtaagtgtagcctcaaataggtcatcatgaagggttaaaaaagcgaggtgggccagtgttagtgcgggggggtaaaggccagggcctctccaaccacgggtgccactgacttgctgtgtgacccgtgggcaagtcacttaactataagggtgcctcagtttcccttcgtgttaaaaggggggataataatactgacctacctcaaagggcagtttggaggcatgactaaggcttttaagaaagcattgtggggatccttcagcacaggaattctcaagacctgagtatttttatactaggaatgtcccccatgaacttgatacgtccgtgtgtcccagatgctgtcattagtccttttggtccctccagaacctgatgatccctgggacgggggtactngccgacattggntctnacagntgcggctcggggccttggggggttcccttgg

SEQ ID NO: 730615 - DNA, 1872 bp, Homo sapiens
tctgtgtcattggcgtaccagtgctacacgggttagcctggactaaaggcatccttgtcttgtgagctatacacctcagtagaaagaggatctaagggaatgatcactgtagtttagttctgttgacctgtgccaccttacccctttgtgaattgtctgcttggtatttactaattccacagggtcatcagatgcctgcttgataactatatacaacaataacataacatactttcacttcttcctattgtaatcgttgtgccatggatctgatctgtaccatgaccctacataaggctggatgtgcaccatcacgtgctgagtggccccatatgtactgtgtggctgtgggtgtgggtgggagtgtgtctgctagagtcacacggcaacacgattttcaagattctaaagctcaattcaagtgacacattaatgataaactcagatctgatcaagagtccggatttctaacagtccttgcttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggctgtcatgcagcagctgtgactgatgtgctggtttagagggtgtctcccgagaggacccagaaattcaggaacgttccctgtgaaattacgttgccccgtgtgtgagtggtctccatggcaacttgagagccagaccacggcatgggagtaggagagcagcaggaaggcaactacgtgggcagggcagcaggacccccacgaacacacaatccaaccatatacccccacaggacacatgaaggctcccaagacaaatcttgacagaacggagaccccacagaacagaacaaacaccacaatcagaagaacacgacagagaaaaagccacaacgacaagcggagaagagaacagcagcccgaccccagacaaaaacaccaaacacaacacacaaagggagacaacaaacagcaggcagcagggcagccaccaccacacaagcagcccagcaagccgagagacagaagagcaagacaccaagcaaacgccgcgccagacgcacacggcgcagcacacagacaggacaaaggaaacaaggccacacaacagcaaccaacaacacgcacaccgagggcacacagagcacaacagaaacccacacgcacgcccgcaagaacagaaaaaaagacagaacaacaagagcagagaacacgcacacgacgccggagaagcgaaacacgaacacacaacaacaccacaccgacaccaaaaacaaaaaccacacacaagcaacaacaaggaacgacccgaccgacagacgcacgaaggaaaacgggaagaacgaaggaaagaaaaaaagaaacacagggcaacaaagcaagaaaaggacaaacacgaaaacgacagaaaggggaggagcggacggagggaacaagaagaaaaagacaacgaggcaagcagcggaaaaacaggaaacaggaagaagcaagagggaaagacaagcgacgcgaccagcggaggcaaccaggcagcgagaaaggcgcgggcaacgagagggccaaacgcgccacgacgagcgcaacgggaggagagcagcacgcaacagaaaacagagacccaaacacaccccgccgccagcaggcaaaacgctgaccgcacaccccaacggaaagaggagaccacgcagcgaccggagccaaac

SEQ ID NO: 730616 - DNA, 796 bp, Homo sapiens
  misc_feature (21)..(21): n is a, c, g, or t
  misc_feature (23)..(23): n is a, c, g, or t
  misc_feature (250)..(250): n is a, c, g, or t
  misc_feature (672)..(672): n is a, c, g, or t
gtctagtacaggcctgggtgntngacccggctgcgcgggtgtgtgcgggcgctgtggcctggtgggtgctgccttgtgcctggaggctggtgagtgctgcgccccagccgctgctacccacggcagagccgggctggcttcgcgtggggcggcgtgggcggccctgagccccgtggctgcagctcgtaaggggagccctgctgggtgctgggagctgcgtgcgctgtgccctgtggtgggatgccctggngtgctgtaccacacggcgcggtggcacctgcgcgcccaggacctccactgcagagcgctcagccgcgcagctctccctgtccagccgcctgcagcttgaccctgtaccagtacaagacggtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcgcaacaactaaatgactcctctgtcatcatcagcgccctcaagacctacctggtgtcggggcagcccctggaagagatcatcacctactacccagccatgaaggctgtgaacgagcagggcaaggaggtgaccgagttcggcaataagtactnggctcatgctcaacgagaaggaggccagcaagtgtatggtgggaagcgaggccagacggcaggagagagattaaagttggaggaagagggcgggaagagtggatggtgcacctgagtatcaccc

SEQ ID NO: 730617 - DNA, 2311 bp, Homo sapiens
gccgggacgcagcccgagtcccagttcccgccgtagcgatggccgatttcccagccgcggacgctgaaagcgaggactccacgccgatgacccttcggcgtaccatgtccggcgggcgcttggccaaacagcccaagactgcggaatcacactcgccactgtgtacctagacgccatctgcagacccagcgcctgcggggattccggaaacgggagagcgggcttccggaaacggtgaccaatgggaaacgtgatcagatgttactaggcgaacagtccgtttccaggcaacacagaaggaagagacgctctcagtcaccctaaaatagacggagctttcagccaatggatatgcaggtttgctccagattagccaataagaagtgtttggggccggccgagcgcggcggctcacgcctgtaatcccagcactttgggaggccgaggcgggcggatcacgaggtcagaagatcgagaccatcctggctaacacggtgaaaccccgtctctactaaaaatacgaaaaattaaccagacgtggtggcgggcgcctatagtcccagctactcgggaagctgaggccgcagaatggcgtgaacccgggaggcggagcttgcagtgagcggatatcacgccactgcactcctgcctgggcgacagagcgaaactcggtttcaaaaaacaaaagaagtgcttgtggccgaccttcctacaagcacagcagaaactttcctgcgcatttctgcgctggaacgcctacccgccgcgccaaaccaaaactttgcaatcacgtttggtgctgtttcctgcactttcttggagattagcaccaggcgctggagaccctcccacctcgcccacgcccaccgcccggtgaacaccgagacccaaccttgtgcaccgccagtcttgtgatcaacaaacaggctagtaaagtataaaaataaaataaaggaaatgtagtcgggcgtggtggcgtgcgcctgtaatcccagctactccggaggttgatgcaggagaatcgcttgaacctgggaggtagaggttgcggtgagccgagatcgcgccactgcattccagcttggacagcaagagcgaaactccgtctgaacatagtaaaataaaataaaggaaatggggccgggcgcggtggctcacgcctgtagttccagcactttgggaggccgaggcgggccgattacttgaggtcaggagttagagaacagtccggccgccaacatgatgaaacccccgtctgtactaaaaatacaaaaattagccaggcgtgctggcgggcgcctgtaatcctcccaaagtgctgggattataggcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacct

SEQ ID NO: 730618 - DNA, 925 bp, Homo sapiens
gaactaggtcacgcgctccgcgggtcgggcacccccgcccgccaggcacggccgcggctccttcctcttcctgcccgcggtagtgggggtggggcaggcctcgggacacctgcctccgccgccggcgccggcgccgtcctcgcgcggcttcccgggcggtctgccccgaccgtagactcccggcccgctcgccgcggcaggagccgtggttccgcggacctgggcgcgctctctccctggccactgggagaccccccgcggcctcgcggggaaaacctcgggactgccccgcgcccccggccgtctctgcgtcgctccttctcgcccgcgaccgtggactcgtcctcgcgagcctgggttggcggaagctgcgggggccggggtcgcactacttggcgcggaagggccggcggtgggcggagggatccccgtccgcggggtgagccgctgggcggagccgggaggagccgcgaggatccgcagtggggagccgggaggaacctggcgccggcacccacccgccgcgcccacgcgtgccgcggtcgcttgtttcccgcgggagcccggccgcgctcggggggaggcgcgcgcgcagctggggctgcctgggtctaggagctccggagccaccgtttggtgcccgtggagccgcggggaaggcgcacgcgctcgggtcttcccggcgggtcgtcctgcactttctccatctcggtacggaccgcggcgttctgttccaggcaaggcaaattagtcaacgactcagaaggcagctgaatccgggcctgggatgccaggttgctggaacagcagacggtgcgatcgccccctgggaatcggatagccgggcgtccatatcctgctggtggacccagaaggccgaattgccaggctgaggctggttggaagcggcaaaacaaggccggaa

SEQ ID NO: 730619 - DNA, 1072 bp, Homo sapiens
gaggcttgccctccttccctgcctgccgggtgcgtgtgagcggctgccctgcggatgctgtcctggacctgttggcaccacagacagttgctctgctgtgcctgtggcctcggggcaaagagaaagtggcgatttctacactcagtgctcgggaaccagtgggcactgagaatggtttatggcctgacattacttgcaaccaaagccaggcagcatttggattttcgcttttggaaaccaccttacctggtttgctccatgagggaggggcagcaacatcgctgggaaccctgaggtgtagatatgtataaatgagctgtgtgtgtatctgaagctcgggcacttgtggggttaccaggagtgtgcgtctcactcccaggcctcgttctggaaacgattctgtaggtctgtctgggaggccttaggcaagtttgatcaagaacagtcgagctggataaacaggctgttccttgtccagcactagtcatcccaggggggcgggggcggggctgcaactcctgtgcacaaaggaagggccctgggtaggggtcaggagctgccttgcccagagatgtgtctgggtcactttggaaacaggaatcctctccccaaaatgggtagcaatgggggtacagaggccaaagacgcagctgcatgtcctgcagtgcctgggacgccccgtagtgaagagtgatgtggcccaaatgtcagcagtgccagtgtcagactcctgctaagagacagtatcaagaaagataacttcaaaatacactttctggaggcctggcgcggtggctcaggcctgtaatcccagcactctgggaggccaatgcatgtggatcacctgaggtcaggagttcgagaccagcctggccaactgcctgaaaccccatctctactaaaaatacaaaaattagccaggtgtggtggcgcaagcctgtaatcccagctatttgggaggctgaggcaggagaatcgcttgaacccgggaggcagaggttgcagtgagccgagatcgcaccactgcactccagcctggacaacagagtgggactctgtctcaaaaaaaaaa

SEQ ID NO: 730620 - DNA, 710 bp, Homo sapiens
  misc_feature (18)..(18): n is a, c, g, or t
gctgagtgcggccgcganggggcgggcggactctcgggcgctcagagctggcctcgggtcctcggagcctggcgctcgaacctcccttccgacctccacccggaccccgaccgaacggctggccgggccgaagaacggcgagagaatccatactcctgaagtgcggtaggagattcggtggcgatggtgagacgcaaggaaggactgaattgcgatggtacttgtggatgttggtgactgtgattgtgcagttagttgtgcgggggggagataccgaagagacgaggccacactgtaggggacggatggtggagagtgaggagaacaggtaacgaccgctgtaaacgcaggacttagggagagcatgggagtggtgagggacttacgagaggatgacgatgcggatcaggtggcggctcaagacacccaggagagacaacaacgatccgggcgacgtaggacgaggaaaccaaaagggagcacccgcgaaagaagaccaatcacggcagagctagtgcgccgaacagaaagccgaccaccggcaggacggggaccactagaaggaaacacgagcgtcatcgagccacaaaaagcgcaaaggaccccacacagcagaacagcgaaacagaagatacatcgccattgacgacacctacttagagagcccgaacagttagacgacagctgctgatcggagcgacgacagcaca

SEQ ID NO: 730621 - DNA, 749 bp, Homo sapiens
tttgtttttttaggtttccgtgtgtttctattgagctgctcagtgcccggcttagaagaccaggaaaaggagtcacaggtcgtatgctggaggcttgagccgcggcaccgtggcgcggctcgcctcgctgcggttggtggtggcggtggacattgcagcgcggctggaggggtaggaagaagaagatagttttgggatagatagagggtccttagacaaggtgcaagacaaacagaagagggcatgtggggtcaaactcgctagctgcctgcctgatttttctgcacacaggtgagatattcctgcacatcctctggtgaccccagaatgagggggactcgctggtgaattgcctcgggcttcacgtccagtacaggctgggtccccgtggtcgccaagcctcctgcctgctcaatgatgtaggccacgggattgcattcatacaggagccggagctgtggaggaacagaggcaggacaaattcaccaagagcctagcaacatgaagagagatgccaggaagaagagagaagccaggaaacaagccaaccgcacaatccccacatcagagcaggagaagatgggggcctgctggcagagctggggcttggctgtggtcactctgaacctgctctttggtgttttcatgagtggtgggaagaatagggaccatatggagcccacacaggaagctctagcagtaacacagcagcaggaagacattctaggaagcagccatatagtcttctt

SEQ ID NO: 730622 - DNA, 759 bp, Homo sapiens
tctctcatgtgcttctctgcatctctgattcagccatgatctaattatctcagtctgtttccctatgcgtgcctctgtctgtctgtgggtgtctctaagtctctgtagatagacaggtaggtagggagagagaaagagacagagagagagaaagatccactctttctcttccctgccccttcttccttgcctctcctctcctaccaacttcccagtactctcagcatatccctcctttctagagctaaagaagtagagcaattccactggggaagcagcgtctaaagggtatttggtcaccttctccatgtgcagcctttgcagtacgctgcccctccagtctacagcaagtttttcagcttatgcacctgttgcaggggaagggggcaggagcactgtggtccagcagcatggccattggcggagctgtctccatggtgagcagcagagcccataggagccaggggagcacgtgagcagccctaagggtggatggagaggctgcctcaggtcagaaagccatgcagctcttgaggctgaggatccaatggcactcctgggaaatccctcccaggccctgtactcatctcttcctttcaccttccttcatgaaagcttttgccactgcctcttctagagaagattgtgagacccttgagactgggggtttctgacatcgagagggagatccagaatctgtggccaaaaacattcttcccaaccccagtgctgccttctacacccagctgcctccttctt

SEQ ID NO: 730623 - DNA, 791 bp, Homo sapiens
gtaagaagtgcttttcacctccccccatgattccgaggcctccccagccacatggaactaaccaggacatcagaggaagaaaatcagcagacagaaaaatactggggaaaaaaaaatgccacgtggttctgttcagctgagcttctgctccctccagcacccccacatgggacatttgtttaccccccacgatgctgctcttggagagtcccaggggacaggtttcaagcccttagggatgcagcctgtctaacttaatatgcacagccgttcacatccagggcacagaggcagcctggctttccctggaggcccacggggaccacaatgctgcatttgtctgtggaactgagatttagctgcacattcttgcctgaatgcagcgggcctccagccacagcctgctggcatgggggattccaggagggatgtgcttcatgagccggcaattgcccttctttccagtccccagacccagtcaagattacagatagatgcgttcatcgcgcgcaggtgctggggaagccagtgggacatcactggctacattcaccaacaggattttccaactgcagtatttatcggtttttcaaacgaattcaacatctgtattcctcacccatttactgagtggctacaatgtgtaaggaaatattctcagtcatggggagttcagaaaaggtccaaggcatataagatatggcatgtgctctgagagaactcatcatctatccagaacctaatcatcactttgtggacaacgcgagagaaactagcattctatggagtac

SEQ ID NO: 730624 - DNA, 1197 bp, Homo sapiens
ggcacgaggtgacgatgaccaccttttcatatgcctgtttgccatttatgtcctctgtagcaagaggcaggacaaacagtgaggactgcaccaacactcaccgggtgacccctttgctttggaaacttactcagggtgaaaggaattccgattttaaacagcatctctttgtgtggcctgtttgaggcaccacacagagcttgctggagcagctctgttgaccgctgacccttggcctgctaactgaaacaagattcacaagtgaggctgctgccccagtttcatggatgctggcagaagacttaagatttctgaatcagagacagaagacttcatttatttgtcacagctaaagcaatggccagtgtcagtgtatttgcactggtgcctcaagccctgatgcccacggggtgatgcagagaccctatgactcccgcacatgcattgggtcaagtcacagtagaggaccactgagctgggcaccatgtggacctatagcaggcagcaggcaagccctctcctttgaggttcctccctgcaactacgaccccgaaaaatggatccagtaaagaagagtcaaggctttatagtcttggtgcacccagtaagacctgtaggagaacaggaagcctgtggaggactgtttcttccaaaagtttccaagtgttagctcttacaacatgtataaacaacactgcaatttgtctccttgcaccgtacatccacgaagcagatttgcttcttgccaaattatttccctcagtgatttcaggaactgacaattcccagtcgcatataggaattttcttgcgtcttcttttcctgactaactcttgcgttgtcagacactttcatttgtgctaagctgataagtatcaaacgatgatgcaggctattcattatgtgtgtccttgattactgatgagtttgagcaattgtcatttgttggactgatcgttcaatttcctcttcggtccttggccttttcatatattttgccttttcttgtaggtgtgtccttttcaaattgatttttttggtgtttttggtatatcctgtgtactaattctttgtcatttatatgcattaataatatctcctttcactgtgtggcttgtcttctcaatttgtttttgggtttttgtttcagagaacattttataagctttaaataataaagtttatttatttttaatt

SEQ ID NO: 730625 - DNA, 978 bp, Homo sapiens; identical to SEQ ID NO: 405169

SEQ ID NO: 730626 - DNA, 3126 bp, Homo sapiens
ggcacgagggtgagggtgtgagggtcgcgctcctgctgtctggactttttctgtcctactgagacacggccgacatgagatgatgaacctcaagtaccaccccagacaacaaggctgcttcatcaggacacaaacctgcctgtaccaggacctctgacctgtgtgcagcagagacactgaggataccattggcatcaatgtcaaaagtgacttcaatctgaggaacaccttggggttcaggaggtatgcccgtgaattcaaacttgccaagcaggttgttatccttggacatggcacgctcaccttcataaacctgaataagcacaccaggctggttgtcagaataggtaatgaaggtctgtgtctgcttggtaggaatggtggtattacagttgatgaggatggtcatgactccactagcagtttcaataccaagggaaagaggagtgacgtccaagagcagcaaatcttgaacattttcagacttgtctccagacaggatggctgcctggacagccataagcaacagcttcatcatggctgatgctcttattcagttcttttccattgaagaagtcttggagaagcttctgaatcttggggatactaatagaaccaccaaccaggacaatatcatgaatttgtgacttgtctggtttggcatctcgaagggctttctctactgggtccagggtgccacagaacaggtcagcattcaattcttcaaactgggcacaggtaatggaggtatagaagtcaattcctacatagagagaatcgatctcaatactgacttgggtgctggaagagagagtacgcttagcatgttcacaagcagtacggaggcatcttacagctctcttgctctcactgatgtccttcttatgcttgcgcttgagctcagcaataaaatggttgaccattcggttgtcaaaatcttctccacccaagtggttgtctctggctgtagacttgacctcaaagattccatcctcaatagtgaggattgacacaccgaaagtgccaccccccaggtcaaagataagcacgtttctttgtgctccaacctttttgtctgaacttttgtaaacaatagcagcaacagttggctcattaataattctaagtacattgagaccagcaatagttccagcatctttggtaacctgaaactgagagtcattaaagtaagctggcactgtgaccacagcactggtaacagtcttcccaaggtaggcttctgcaatttccttcatctttgtcagaacaatagaggatacctcctctggatagaagcttttggtctctcccttgtattctacttggacctggggcctgtcagcatcattcactaccatgaagggccaatgcttcatatcagactggacaacagcatcatcaaatctgcgtccaatcagacgtttggcatcaaaaactgtgttggtggggttcattgcaacttgatgctttgcggcatcaccaatcaactgtttagtgtccataaaggcgacatagcttggagtggttcagtttccctgatcattggcaattatctctacttttccgtgctggaaaacacccacgtaagagtaggtggtgctaagatcaataccaactgcaggtcccttggacatggttgctggcatgtagccctggctccgataaagaagaaagccacaggaacccgagagctgcaggcgagttcaatgagctaggatttcttaatatatatgtgataatgttttaactttgataattgacttttataatgacttgagtagtcttaaattgtctttcatttaaaacttttgttcttttaaaaaagcaccaagtctatgctactaacaaaaatttccttttaccatgtagactacttgggatgaaaataacttttcataattactatcatgaagggaggagagtggaaagttgccagatactgcagcaagatataaagatgaattcttcaaatgaggaagcaaactttatcaagtggttgaatttcttagatcaccttgttggacataatttcttgtaaacaaattatgcagtcagtgtcacgttcatgcagagtcttttaacttaaaattcattacaggtaacactttcaaaaagaagttctgtagtcttgcatactatttaccacaccatatttactgcacttagcttcattatggaggaaagaacaatagtaaactatcaataactgagacaataatcatattcattagtgatgagtcaaacaggttatacttattttttaaaataaaaacatttgtaaatttttctctacgtttttaaaacaacagtttaacaatagcagttctgttattttagctttaattttttgtaccaacagttaatttgctcatgcccaaagatttacatttataaaaaatgttctgccatgcaagttttaagagatttttgaattgttgacaatactcagcacagtcacatgtctctcataaatccacccagacttaagaaccaattttcagtgcaactcatgaagacaaagaatagccattataaacacattgttgaaaatcatttaaaaaatcattaaatttttttgcatttaatattttttcagctttcttaagatataattaacaaaaattgtatatattcaagttgtgttatgtgaggttttgatacatgtatacatagtaaaataattaccacagttaagctaattatactatacatagtaaaataattaccacaatcaagctaattaatatatttattatcacacataattctttttcttgttgtggtgagaatacttaagatctactctcttagaaaatttcaggtatataatacattattattaaccatagttgccatgctatacattagggctccagaacttattcatttcataacttcaagttataaaagtcacgataaaagtttgtgccttttgcaagtttgtaccttttgatgaacatcttcccatatcttcccattttcctcagtcccctgcacctggaaaccacccttctaaactgtttatatgagttcaccttttttcagattccacatataagtgagatcatgcagtgcttgtgtttctgtgtctggcttatttcacttagcataaagtcttccaagttc

SEQ ID NO: 730627 - DNA, 1692 bp, Homo sapiens
  misc_feature (735)..(735): n is a, c, g, or t
  misc_feature (1128)..(1128): n is a, c, g, or t
  misc_feature (1139)..(1139): n is a, c, g, or t
cagatcggatcaggtcgggcgggggtaattcggacgaggctcgggttaccttcactgctctgtgtcctcagcgtgtgtggcttcgtgacctgaagatactgggaaatccatagctaagatgccaggaccccctgaaagcctagacatggggccgttgacatttagggatgtggccatagaattctctctggaggagtggcaatgcctggacactgctcagcaggattgtataggaaagtgatgttagagaactacagaaacctggtcttcttggcaggtattgctgtctctaagccagatctggtcacctgtctggagcaaggaaaagatccctggaatatgaagggacacagtacggtagtcaaacccccagtagagacggggtttcaccgttttggccaggatggtctctatctcctgacctcgtgatccgcccgcctcagtctcccaaagtgctggtattacaggcgtgagccaccatgcccagcctaataaaaatttttttatttctattgtatccaatagcttgttttaagtgtgtagaacaataacttacacttttatgttaattttatattttgttaatttactgactgtattattagtttagacaaatttcaatgtactgtggttttttatgtgtaagattatatattcctcaaacagcaactttttacttatttgtcttcagtttcaatggctttaaaaagaattcttttttcattattctgccanatgcttccagtgctatgttaaaatagaaacattgacaaagggcacaatagagtttactattggtgtctgtgaatttgaaatggcaaacaactccttaagtttttataagctgatttcaggaggtaaagatcttcttttcttgtgttccccagggttttgggatgccctctgggtttgtagtggagtggggttgtaacttggttgcaaggctgctggttctacattagggtccatatttagttgtcatgttacaagaggcttgggtagttgtacttcccaatttttttttttttttttttttttgagacaggagtctcgctctgtcgcctggctggagtgcagtggtgtgatctcagctcatcaaaacctttgcctccctagttcaagcgattntcctacctcancctcctgagtagctgggattacaggtgcccaccagcacgcccagctaattttttgtgtgtttttagtggagacggggtttcaccatgttggctaagctgggtctcgaactcctgacctcaggtgatccacccgccttggcctcctgggtgctgggattacagacgtgagccaccacccccggccacttgtttcttttaaatgcttattaaaagtttctcatcagaatattttatttataattatactgcatattctctgaaattttactgccaatttttcaaaatacctgcttttgatgagtacagttacagtcaaatactgtagttagacaaattcttttttaatggtatattaatgttgcataccaaattgtatgagttaaacgtctcttcctgtgcagtttcatattagtggtgttttcagtgtaggtatcttaatatcagcttatcgtggtttttggttatgtattataattttagtcaatttgcaattctgtctgtatactttatgtcaatgtgaggttgaattaaaagatagccatatgtctatcac

SEQ ID NO: 730628 - DNA, 442 bp, Homo sapiens
  misc_feature (224)..(224): n is a, c, g, or t
  misc_feature (226)..(227): n is a, c, g, or t
  misc_feature (284)..(284): n is a, c, g, or t
gcgcagccggcgctgagcttgcagtggccgctcccctcacccgcccccttcgagtccccgggcttcctgccccacccggcccgtgggggagtatctgtcctgccagcttcgcccacgccctgactccgggaccgtccctgcgcgctcttgggcgcaccaatggcccgcggggctgcgctggcgcatggtgctcttcgagcctgctgggtgtactggtcggccgncnncgtcgtggtggtttcgatttatctgatgcccttcctgacaatgaaaacaagaaaccnactgcaatccccaagaaacccagtgctggggatgactttgacttaggagatgctgttgttgatggagaaaacgacgacgacgacgacgacgacgacgacgacgacgacgacgacgacgacgacgacgacgacgacgacgacgacgacgacgacgacga

SEQ ID NO: 730629 - DNA, 681 bp, Homo sapiens
  misc_feature (224)..(224): n is a, c, g, or t
  misc_feature (226)..(227): n is a, c, g, or t
  misc_feature (284)..(284): n is a, c, g, or t
gcgcagccggcgctgagcttgcagtggccgctcccctcacccgcccccttcgagtccccgggcttcctgccccacccggcccgtgggggagtatctgtcctgccagcttcgcccacgccctgactccgggaccgtccctgcgcgctcttgggcgcaccaatggcccgcggggctgcgctggcgcatggtgctcttcgagcctgctgggtgtactggtcggccgncnncgtcgtggtggtttcgatttatctgatgcccttcctgacaatgaaaacaagaaaccnactgcaatccccaagaaacccagtgctggggatgactttgacttaggagatgctgttgttgatggagaaaacgacgacccaggacaccggaacccacccaaaccggatgccaatatccaaacccaaaccaccctaagttcctccgggtagcctttcagattgctgaacctttgcgagatggcgttcaggtggaagcacggaaacggaggcagtgatggtggcaggcagccacaggaaacgcacagggcgaagagggccgaaagccccaaggcgttgatccccgggagattgtggggggcatgtcgatggtcggccgttggcatggagccattctctagcttcattgctaaccagaaaagagacgctatgcttccaaggaaaatgcgaacaagggagg

SEQ ID NO: 730630 - DNA, 890 bp, Homo sapiens; identical to SEQ ID NO: 178664

SEQ ID NO: 730631 - DNA, 902 bp, Homo sapiens
  misc_feature (716)..(716): n is a, c, g, or t
  misc_feature (718)..(718): n is a, c, g, or t
  misc_feature (720)..(720): n is a, c, g, or t
  misc_feature (858)..(858): n is a, c, g, or t
  misc_feature (860)..(860): n is a, c, g, or t
atcatcaactgggcacaaagtaagggactctgtgtttctgaatcagaagctaccactacatgccagatttgtgacctctgccaaaagttagcctatttgtctcatggtgaaagaggccatattgcactgagtgttgactggctgcagagtgttgactggctcctggtaaattggtgacatcagacctttgacctcttccaagctattccactggtatctcattcctgttgactttttctcaggtaatggttttgctgttctagtctgatcagccaattgtggccacatcattgtggcccttgaaactaatctgtgtcatgattttggctttctggatggtgataatactgcattttttagtgcaaaaactcatcaacaatgggcttatagtcaaagtatttggtagccaattcattatcttcagactggtggtaccattgagagatggaataaacttttaattaaaaaacagcttaattgagatgtaattcacatatcataaaattcaccctttggaaggtttttagtttattcacagagttgtgcaaccatcctacagtatgtagtctttgtggctggcttccttcacttagcaaaatgttttcaaagtttatccatgtgggccgggcgcggtggctcacacctgtagtcccagcactgtgggaggccgaggtgggcagatcatgaggtcaggagatcaagaccatcctggctancntngtgaaaccccatctctactaaaaatacaaaaaattagccgggcatggtggtgggtgcctgtagtcccagctacttgggaggctgaggcaggagaatggggtgaacccaggaggcagagctttcagtgagctgagatcncnccattgtactccagcctgggcaacagagcgagactctgtatc

SEQ ID NO: 730632 - DNA, 1299 bp, Homo sapiens; identical to SEQ ID NO: 178863

SEQ ID NO: 730633 - DNA, 669 bp, Homo sapiens
ggaatgtggaaagaaacgaggttaatatcttttgggaaattaatttgtgccaaactatttggcttcttcgtcctagttgcattgtctccctgacctcatctcccctgagaatcagcctctgtttccctggtcaaggccacggcttttctctgatcctgaggagagtttcctaccagagtggaagcagggaggactgaaagcactaggaacagaggggagctatcggattgcatctagaacctgctgtgagcaacatcttcagaattaaccataatgtgttccctcctttcctgtgtccagatgaggaaggagaactttgattcttccttccaattacatgatgcgagaggaaatcttatgaaatgttgggaggccattaaaggaggcccatgcaagagttggtggtagcaatgggcacaactgggatgaacagcctgtgttttcaagggataactggaagcagagatgagtgaaggggaagaagtagaagacgcatatgctaatagggcatgctccaatagtgctcatgacctcaggtggcctctccacagtctaaactggagctgggatctccaaaggccctcttcgttcccaagactttaattataatctgtatatgcaggtgactccctaatccatatttccagcccagtctttcttggaattaaa

SEQ ID NO: 730634 - DNA, 696 bp, Homo sapiens
gaacaccttctccctttggttttggtccacagaagactggtgatacagattgcattgtctccctgacctcatctcccctgagaatcagcctctgtttccctggtcaaggccacggcttttctctgatcctgaggagagtttcctaccagagtggaagcagggaggactgaaagcactaggaacagaggggagctatcggattgcatctagaacctgctgtgagcaacatcttcagaattaaccataatgtgttccctcctttcctgtgtccagatgaggaaggagaactttgattcttccttccaattacatccaaaatatccacacaactactaatatttggaagctttgatcctttggggtgaggatgcgagaggaaatcttatgaaatgttgggaggccattaaaggaggcccatgcaagagttggtggtagcaatgggcacaactgggatgaacagcctgtgttttcaagggataactggaagcagagatgagtgaaggggaagaagtagaagacgcatatgctaatagggcatgctccaatagtgctcatgacctcaggtggcctctccacagtctaaactggagctgggatctccaaaggccctcttcgttcccaagactttaattataatctgtatatgcaggtgactccctaatccatatttccagcccagtctttcttggaattaaa

SEQ ID NO: 730635 - DNA, 1387 bp, Homo sapiens
tccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggcctggacatcgagatcgccacctacaggaagctgctggagggcgaggagagccggctggagtctgggatgcagaacatgagtattcatacgaagaccaccagcggctatgcaggtggtctgagctcggctatgggggcctcacaagcccgggctcagctaaagcctgggctccagctttggctctggcgcgggctccagctccttcagccgcaccagctcctcgagggccgtggttgtgaaga

SEQ ID NO: 730636 - DNA, 789 bp, Homo sapiens
acttaatggttaaaaagcaatgataaaactggacattaatgaaattgatttttagttacagttggaataagttttttaccaaaaagaaaccagagacgttagttaaggagacttaaaaagatctgaaatatgaaaagagaatgagaagatgagcagaagataaatttgtgggacacaagtataacttggggtagaaactggagaagagaatcgaaaaacaataatgccagaaggacccttggtatgaaagtactaatggaatgtgattcatagaaagttcatagaaagtgagtccttgcaacttgagaaacatacatacatatatatttataatctctaaagcaacatcaggaatcttctaatatatgataaagaatttgtgtagaattacgttgttcacagtattattggagagacaaataagatttcaaggaattcatttataatcaaaagtgaaatgtgtcttcttgaaaccagcaagaaatagatgaattgagtgaaacgtgttgttattaggagaagtgggataacgtatacaaaaagaacatgcgatctgaatatgatctgaatatgagggtggataggaattttttgacagtgaaatctgttatgatgtagtctcatttccaagaaaagtcttgagttccatccccttctgaatttaaattgaaacctggacagaaaacaaactatcctgtagtttccactgctcaggaggaacaaacagaatctatattatctaatgcatcttgccatctttatttctagaatctataagattttcattat

SEQ ID NO: 730637 - DNA, 1215 bp, Homo sapiens; identical to SEQ ID NO: 285678

SEQ ID NO: 730638 - DNA, 1582 bp, Homo sapiens
cttccacactgtggaagctttgttcttttgctctttgcaataaatcttgctactgctcactctttgggtccatgctgcttttatgagctgtaacactcaccacgaaggcctgcagcttcactcctgaagccagcgagaccatgagcccgccgggaggaacgaacaactccagatgtgccgccttaagagctgtaacactcaccgcaaaggtctgcagcttcactcctgagccagcgagaccacgaacccaccagaaggaagaaactccgaacacatccaaacatcagaaggaacaaactccagacgcaccaccttaagagctgtaacactcaccgcaagggtccgcagtttcattcttgaagtcagtgagaccaagaacccaccaattccggacacattttggcgacccagatgggactttcgcctatcaccaagcggtgagaccatcacctatagctgagcggcgagaccatcacctatcaccaagcaatgggaaacactcaggcatcaacaggctcacccttgaaatgcatcctaagccattgggaccaatttgatccacaaaccttgaaaaagaggcggctcatttttttctgcactatggcttgggcccaatattctctctctgatgaggaaaaatggccacctgagggaagtacaaattacaatactatcctgcagcttgaccttttctgtaagagggaaggcaaatggagtgaaataccttatgtccaagctttcttttcattgaagaatcaaggccatcaagctacagatgggcttacaaatagaacctttacaatccctgagctagacataaatacaccaatcggcactctgtatctagctcaaggtttgtaaacacaccagtcagcaccctgtgtctagctcagggtttgtgagtgcaccaattgacactctgtatctagctgctctggtggggccgtgaagaacctttatgtctagctcagggattgtaaatacaccaatcggcactctgtatctagctcaaggtttgtaaacacaccaatcagcaccctgtgtctagctcagggtttgtgagtgcaccaatggacactctgtatctatctgctctggtggggccttggagaacctttgtgtggatactctgtatctaatctgatggggacgtggagaacctttgtatccagctcagggattgtaaacgcaccaatcagcgccctgtcaaaacagaccactgggctgtaccaatcagccggacgtgggtggggccagataagagaatgaaaccagggcttgggacctgcagcccgccatgcctgagcctcccacaccccctccatgggctcctgtgcggcccgagcctcctcgacgagcgccaccccctgctccacggcacccagtcccatcagccctcactcactcttggcacctcctctgcccgggctcccactttggtggcacttgaggagcgcttcagcccaccgctgcactgtgggagcccctttctgggctggccaaggccagagccggctccctcagcttccacactgtggaagctttgttcttttgctctttgcaataaatcttgctactgctc

SEQ ID NO: 730639 - DNA, 824 bp, Homo sapiens
cttccacactgtggaagctttgttcttttgctctttgcaataaatcttgctactgctcactctttgggtccatgctgcttttatgagctgtaacactcaccacgaaggcctgcagcttcactcctgaagccagcgagaccatgagcccgccgggaggaacgaacaactccagatgtgccgccttaagagctgtaacactcaccgcaaaggtctgcagcttcactcctgagccagcgagaccacgaacccaccagaaggaagaaactccgaacacatccaaacatcagaaggaacaaactccagacgcaccaccttaagagctgtaacactcaccgcaagggtccgcagtttcattcttgaagtcagtgagaccaagaacccaccaattccggacacattttggcgacccagatgggactttcgcctatcaccaagcggtgagaccatcacctatagctgagcggcgagaccatcacctatcaccaagcaaatcaaggccatcaagctacagatgggcttacaaatagaacccaaaatgagttcaactaacaacttctaccaagggcccctggaccgacccactggcacttcccctggcctagagttcccctctgaaggacactacaactgcaaggccccttcttcaccccatccagcaggaagtagctagagcggtcatcggccaaattcccaacagcagttggggtgtcctgtttagaggggggattgagaggtgacagcgtgctggcagtcctcagccctcactcactcttggcacctcctctgcccgggctcccactttggtggcacttgaggagcgcttc

SEQ ID NO: 730640 - DNA, 1675 bp, Homo sapiens
actgacttccttcgcactcagcccactcgcacccgggtgaataaacagcctttgttgctcacacttagcctgttcaagttgtctcttcaattagatgctcgcataacatttggtgccgaaagcccgggataggggaactcctccggcagacctctcctctatcctcccggtacccacgttctcccatgcaagagacttccctcgccctcaggacctcagaccagctccgcgagcactccggcctctgtctatggatatgaaatccaacaccggtcacggactcttcttggggagacagccttccttcagtgttcggtcaatgcccgggacgcccgccttggccatttgccagccacacaacccaggacctccaatggggacgcccactgaggatcctagtggttgctcttttccttgtctctttctttccccccagtctttccttgttctatcatgggcaatttcccgccttccatccctctttcttctgtctggcttgtgtcctcagaaacctcaaacctcttcaccttgcacccaatctaaaggctaaacgtctaatttttttctgtaacacgtcctggccccagtataaattagaaaatggcgctcagtggccagaaaacagcacttccaatttctctatttgtgggacttagacaacttctatggaaaaatgggcaaatgggtctgaggtaccctacttccaggcattttttacatacgatctctccctagcctatgcttccaatgtaatccatccccaattttccttatttcccttctgtctacccctccttcttccactggcgatgctgactcctcttgtctgttgacccctccgatctttctccccaccacctatcgaacctgcttctaattctcccccagaacctatttctacccacaatccaccctcttatgcccctcccattaccacccttcctcacatcctctatggcttacagtttgggcctgcgaccaacccccaggcccctgcctagcaatttcccctcggagaggtggcaggaaccaaaggaatagttcgggttcaggtccctttctccctgttcgacctttcccaaattagtgaacatctaggctctttcccatctggaccccaccaaatatatacgagaattccaatacttaacccagtcctataatcttacttggaatgacttaaatgtcatccttacctctaccctcgctcctgaggagtgagagtgggtttggatcctagctcaatcttaggctgataaccgccggtgccgtaagcctggcctccagtaaggtgctagggcagtaccctgtgaagaccccggatggacttaccaggccctgggacccaggcatagccaggcgggactacatgatctcttgcctagttaaagggcttcagaaggctgcatataaagccgtcaattatgacaaactaaaaaacaaaaacaaaaacaaaaaaaaccactcagaacaaagataaaaatccagctcagtttatggcctgtctacctgccaccctcaggcgatatacagcactagaccctgaagggatagaaggccgccttattcttaacatgcattttattacccagtcagtttctgacagtagaaagaaacttcaaaaattagagtctggctctcagatcccacaacaggaattaatcaacctcgcctt

SEQ ID NO: 730641 - DNA, 1764 bp, Homo sapiens
  misc_feature (334)..(334): n is a, c, g, or t
actgacttccttcgcactcagcccactcgcacccgggtgaataaacagcctttgttgctcacacttagcctgttcaagttgtctcttcaattagatgctcgcataacatttggtgccgaaagcccgggataggggaactcctccggcagacctctcctctatcctcccggtacccacgttctcccatgcaagagacttccctcgccctcaggacctcagaccagctccgcgagcactccggcctctgtctatggatatggtaagctgcctcggtctctcctcatctctccctctctttttctcttttcaaaattgagacaaagaaccttcctcntatccgtgtttcagaaatccaacaccggtcacggactcttcttggggagacagccttccttcagtgttcggtcaatgcccgggacgcccgccttggccatttgccagccacacaacccaggacctccaatggggacgcccactgaggatcctagtggttgctcttttccttgtctctttctttccccccagtctttccttgttctatcatgggcaatttcccgccttccatccctctttcttctgtctggcttgtgtcctcagaaacctcaaacctcttcaccttgcacccaatctaaaggctaaacgtctaatttttttctgtaacacgtcctggccccagtataaattagaaaatggcgctcagtggccagaaaacagcacttccaatttctctatttgtgggacttagacaacttctatggaaaaatgggcaaatgggtctgaggtaccctacttccaggcattttttacatacgatctctccctagcctatgcttccaatgtaatccatccccaattttccttatttcccttctgtctacccctccttcttccactggcgatgctgactcctcttgtctgttgacccctccgatctttctccccaccacctatcgaacctgcttctaattctcccccagaacctatttctacccacaatccaccctcttatgcccctcccattaccacccttcctcacatcctctatggcttacagtttgggcctgcgaccaacccccaggcccctgcctagcaatttcccctcggagaggtggcaggaaccaaaggaatagttcgggttcaggtccctttctccctgttcgacctttcccaaattagtgaacatctaggctctttcccatctggaccccaccaaatatatacgagaattccaatacttaacccagtcctataatcttacttggaatgacttaaatgtcatccttacctctaccctcgctcctgaggagtgagagtgggtttggatcctagctcaatcttaggctgataaccgccggtgccgtaagcctggcctccagtaaggtgctagggcagtaccctgtgaagaccccggatggacttaccaggccctgggacccaggcatagccaggcgggactacatgatctcttgcctagttaaagggcttcagaaggctgcatataaagccgtcaattatgacaaactaaaaaacaaaaacaaaaacaaaaaaaaccactcagaacaaagataaaaatccagctcagtttatggcctgtctacctgccaccctcaggcgatatacagcactagaccctgaagggatagaaggccgccttattcttaacatgcattttattacccagtcagtttctgacagtagaaagaaacttcaaaaattagagtctggctctcagatcccacaacaggaattaatcaacctcgcctt

SEQ ID NO: 730642 - DNA, 573 bp, Homo sapiens
actgacttccttcgcactcagcccactcgcacccgggtgaataaacagcctttgttgctcacacttagcctgttcaagttgtctcttcaattagatgctcgcataacatttggtgccgaaagcccgggataggggaactcctccggcagacctctcctctatcctcccggtacccacgttctcccatgcaagagacttccctcgccctcaggacctcagaccagctccgcgagcactccggcctctgtctatggatatgcataaaaagacaggaatgttaggtcctctgagcaggcggcgccatggtcaagccatcgtgacccctgtgactcacacgtacacatccagaaggtctcctggagccagaaagtctgggacgacaggaaaaccacaaaagaagaaaaacggctagttcctgtcttagctgatcagccaaccttgtgacattctatcattgtaacaggctgtaccctaactgatcaatcaacctcatgacactgtgctctgtaaccttatgataatgtaccttatgacattcttcccctgccctcaataaacagctccgaactataa

SEQ ID NO: 730643 - DNA, 1004 bp, Homo sapiens
actgacttccttcgcactcagcccactcgcacccgggtgaataaacagcctttgttgctcacacttagcctgttcaagttgtctcttcaattagatgctcgcataacatttggtgccgaaagcccgggataggggaactcctccggcagacctctcctctatcctcccggtacccacgttctcccatgcaagagacttccctcgccctcaggacctcagaccagctccgcgagcactccggcctctgtctatggatatggtgttcaataatagggaagagactgcccggcgacagcgcatttcagaactacagatgcttgcctccgccataagacaaaccccagctgcactgcctacctgcaagaacttcaaggcatctaaacgcaacatccaacagcccctctgggactttgcttcaagcgatgaaaacctggccactgggccaaggaatgcctgcagcctgggattcctcctaagccatgccccgcctgtgcgggccctcactggaagtctgactgcccgactctcatcgccacttccggagctcctggagctcaaacccaaagctccccaccgactccttcccagatctcctcggcttggcggctgaagactgacgctgcccgaacgtctcggaggccccttagacaatcgcggatgccgagcttcgggtaactcttagggtggaggcataaaaagacaggaatgttaggtcctctgagcaggcggcgccatggtcaagccatcgtgacccctgtgactcacacgtacacatccagaaggtctcctggagccagaaagtctgggacgacaggaaaaccacaaaagaagaaaaacggctagttcctgtcttagctgatcagccaaccttgtgacattctatcattgtaacaggctgtaccctaactgatcaatcaacctcatgacactgtgctctgtaaccttatgataatgtaccttatgacattcttcccctgccctcaataaacagctccgaactataa

SEQ ID NO: 730644 - DNA, 941 bp, Homo sapiens
  misc_feature (579)..(579): n is a, c, g, or t
  misc_feature (607)..(608): n is a, c, g, or t
  misc_feature (665)..(665): n is a, c, g, or t
  misc_feature (712)..(712): n is a, c, g, or t
  misc_feature (726)..(726): n is a, c, g, or t
gtgttcaataatagggaagagactgcccggcgacagcgcatttcagaactacagatgcttgcctccgccataagacaaaccccagctgcactgcctacctgcaagaacttcaaggcatctaaacgcaacatccaacagcccctctgggactttgcttcaagcgatgaaaacctggccactgggccaaggaatgcctgcagcctgggattcctcctaagccatgccccgcctgtgcgggccctcactggaagtctgactgcccgactctcatcgccacttccggagctcctggagctcaaacccaaagctccccaccgactccttcccagatctcctcggcttggcggctgaagactgacgctgcccgaacgtctcggaggccccttagacaatcgcggatgccgagcttcgggctagacataaaatctgccaagctgccaatttcctgttacctactccagagacccagtgatatgaagacaccctagctggactgtcagttctcgttaagaacctaacccctcaaactctacaacctctgtggacaggatcctacctggtcatctatagtaccccaanagtggtcagtctacagaatcctccccannggattcatcgctccaggataaaatatgcccatctgacgaccagcctagctcctccanctcctcctggaagtcacaagtactctctcctacttcccttaaattanccgattcctgaaanagaacaataaccctgtataccttttatttacagtagacctttacacagttcaccccactatgtaaagctctgttctactttatgcccctgatcaccattctcaactaggtctaaatggccctgcgtttggtctaatacggcagtcaaggtttcttcagaccatgggagtgaactcatggggtccctccagtgtggacttaatctttctaagtggg

SEQ ID NO: 730645 - DNA, 959 bp, Homo sapiens
  misc_feature (597)..(597): n is a, c, g, or t
  misc_feature (625)..(626): n is a, c, g, or t
  misc_feature (683)..(683): n is a, c, g, or t
  misc_feature (730)..(730): n is a, c, g, or t
  misc_feature (744)..(744): n is a, c, g, or t
gtgttcaataatagggaagagactgcccggcgacagcgcatttcagaactacagatgcttgcctccgccataagacaaaccccagctgcactgcctacctgcaagaacttcaaggcatctaaacgcaacatccaacagcccctctgggactttgcttcaagcgatgaaaacctggccactgggccaaggaatgcctgcagcctgggattcctcctaagccatgccccgcctgtgcgggccctcactggaagtctgactgcccgactctcatcgccacttccggagctcctggagctcaaacccaaagctccccaccgactccttcccagatctcctcggcttggcggctgaagactgacgctgcccgaacgtctcggaggccccttagacaatcgcggatgccgagcttcgggtaactcttagggtggaggctagacataaaatctgccaagctgccaatttcctgttacctactccagagacccagtgatatgaagacaccctagctggactgtcagttctcgttaagaacctaacccctcaaactctacaacctctgtggacaggatcctacctggtcatctatagtaccccaanagtggtcagtctacagaatcctccccannggattcatcgctccaggataaaatatgcccatctgacgaccagcctagctcctccanctcctcctggaagtcacaagtactctctcctacttcccttaaattanccgattcctgaaanagaacaataaccctgtataccttttatttacagtagacctttacacagttcaccccactatgtaaagctctgttctactttatgcccctgatcaccattctcaactaggtctaaatggccctgcgtttggtctaatacggcagtcaaggtttcttcagaccatgggagtgaactcatggggtccctccagtgtggacttaatctttctaagtggg

SEQ ID NO: 730646 - DNA, 950 bp, Homo sapiens
gactgttcaggtcactgaaagcaaggaaagcctgataaactgccacggccacgaggagtctaaggacacatccaatttccattcgcatccaaaatggaatccgagacagaaagaggaccttagccttcatatctgtttttttcttatgaagcttcttctggttggaaacttgtcaaatttcatcagatggctggaactctccgtgtctccttttctttctgtcatggctggcaagagctcatgggccatgagctgcatctttataaacatgaacagattagcaggtattcccaaatgggacaaatgctaccttattgcagacagtttctagtatagtcccacattctttgagaaagtaggtggagaccccatcagcaccaggccactggcagcaaatggttgtagccaggagccagaatagagcaagtccagcctgagcctgtggtcggcagtggagaagagagggtcgcagacctgaggcaaagggcagcctgaacaatcaagaaccagagcagccctggcacccgacacccaggagagtgggctacaggaagaggatctgagaccagagcccacagagtctgcagaaactagaggcacaaggcacgaggaatcacaaagcaaacttaagtgccgacatcaaagaaggcattctcaccctgtttcctgcttctgggtttctccacattcctatagccttacagacagtaagcccagtgtggtgggaacagggaattgaagtggaaagcacaggccaggggatctgatgggtctcttagatcccctgggagggcatgacaacatagagaaagaagagtcctttaaaagcattcaacataacgtagtttgcccaggcagttcacgctgactgaaacctcctctgtcttctgaactcgggcatgcctatctcatctcttcttttgaagcagaatgctttaaatttttatttt

SEQ ID NO: 730647 - DNA, 640 bp, Homo sapiens; identical to SEQ ID NO: 460923

SEQ ID NO: 730648 - DNA, 671 bp, Homo sapiens
  misc_feature (72)..(72): n is a, c, g, or t
  misc_feature (161)..(161): n is a, c, g, or t
  misc_feature (180)..(180): n is a, c, g, or t
  misc_feature (194)..(194): n is a, c, g, or t
  misc_feature (274)..(274): n is a, c, g, or t
  misc_feature (333)..(333): n is a, c, g, or t
  misc_feature (426)..(426): n is a, c, g, or t
  misc_feature (442)..(442): n is a, c, g, or t
  misc_feature (578)..(578): n is a, c, g, or t
gtcactcccagactccttgcggagttcgccgcctgattctaggctggtcactactccgagcctgtgacgttngcggcagccaggccgtcgacgatgcccagtgaaactctctgggaaattgcaaaagctgaaggtggaaaaaaggggaattaagtggaagntgaaggtgatggagctganattgcagaaaaatngtgttttcttcattggcagtaacaatctgggggaaagactactattattctaaggtgtcttgacagagatgaaccaccanaaccaaccttagtttggcaatatacatatggaagaagagcaaaagggcacaacacaccnaaaagatatcgctcacttggggaactcgggtggaggaacctctttatgggacttaatcagcatacccatcacaggtgacaccttacggacgtntctctgtgttctcgtncgtggatctttcaaaacctaagtgatctcgtggcccaccatggaaaactctctggcaaggcaacaaaaagccatgtagaccaatgtgatatggaacacctggggaaagaccaaagtgctaaagcggtttctgaacntgagacacgacgaatctgcactactctggccgccggatcttctcagggaccatgacttctttgacccactccggtacctctggtcatattgga

SEQ ID NO: 730649 - DNA, 734 bp, Homo sapiens
agcgacagatgcgtcctggcaacagtcggcagagttgctgcggtttgtgcccttgcgatttctttttctgagagaggagagtcaaactcccacctccagctctcgaaggagcttttcctgagggcactgcaaagaggctccttttctttcagatcagcagtatcagcccaagtcagaaccatggctccaaaacaaaagaaaaagacatcacgtggcaaaaaaagactaaaaccagtattagctgctagtgaagacatggaaccagtaaatatggagagcatgggtcatccagaaatttatcctttagtattaaccaccaagacccaagaaatatttaactgccgaatagatgaagatgtcacagatgaacaaccttataagcttatcaataaagaagacatttttgaggacctgcgcaacagagctgcagtatctgatttccacccagtcaaaaaaattgtccaggaatatcctggaaatgagcttctgcttgtttatgacaaagacttcaaatatggacttaacttttatcttattgcaactgaagagggcaaagaaaactatttaaatcccccagaagtaccagaagaacaagaagaatataaagaacatattcctgaagatgtgtatatttataaaccacctgtctctaaaccatgggtttctttgggcagtgaaaaagaaattgaggaagaatcagttacggaatctacaaagcagattacatatatgat

SEQ ID NO: 730650 - DNA, 590 bp, Homo sapiens
agcgacagatgcgtcctggcaacagtcggcagagttgctgcggtttgtgcccttgcgatttctttttctgagagaggagagtcaaactcccacctccagctctcgaaggagcttttcctgagggcactgcaaagaggctccttttctttcagatcagcagtatcagcccaagtcagaaccatggctccaaaacaaaagaaaaagacatcacttgggccggaaaggtggaggttgcagtgagccatgatcatgcccctgcactccagcctgggtgacagagtgagaccctgtctcaaaaagaaaaaaaaataaaataaaagctaacagtttataattaaaaatcatctttcatttagccttaacattttcaattttatttttatgattgttgttctgtttttaattttttattgtaatgaaatattttaaatgtttagaaaaaactacagagtagtataacaaatatctacacttaattatccagaattttaaaatattaatttttattatatttactttaaaacttttttaacaaaagaaataaatattacagacaatattccactccctctcgtatcctccctaattcc

SEQ ID NO: 730651 - DNA, 842 bp, Homo sapiens
gagggtgtcctctcttactacagtgagggaggctatctggcggtgatattttgaagtattcaacatctttcgttctaaatccatcctgaaatatttatgaagctcacggcagtgcttagtaaatattgttgaaagaagtatttaagaggaaaatcaatgtgacgatgttggtagataggaaagtcaaggatacttcaaaagtatgaagttaacttgtgccatcacttaagagggcaaaaacacaagagcatattttcagtgagaagacagtgatttcaattctaggtatgttgttgacattgctgggatgtggaaatagagaggtctgatacacatgctctgtgctcagtgatgaaaggcccccaggaataagattgtgaggaagttgggaacttgttttcttaattagtggttctcaaagtatgatcttcaggccagcaacatcagcaccactggggactttgtggaaatgtaaatttggggcccaggccacacctacttaattgaaaagtctgggatggggttcaactatcagtgttttaagaagtcctccaggtgatctgctataccatgaagttgaggaccactatcttaaaaattaatcagaactaccaagctctaatgctcaatgctatccagacttttggtgataaacctactaaggcatgctaacattgtgttctttgtacagccaggtcctccctaacaggggatctaagaggctataaataaaagcaatgaaagcttttactctatgcatttgaatgctaggtataccactttctatttatgtgtcctaggaagtaaattgcttaaccttttgagcctagggtcctcatctg

SEQ ID NO: 730652 - DNA, 986 bp, Homo sapiens
  misc_feature (364)..(364): n is a, c, g, or t
  misc_feature (416)..(416): n is a, c, g, or t
cagaggctgggatcatggtagatggaaccctccttttactcctctcggaggccctggcccttacccagacctgggcgggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtacttgggaccgggcagacacgggagcgccagggacaccgcacagacttttccgagtgaacctgcggacgctgcgcggctactacaactcagagcgaggccggggtctcacanccctgcaggtggatgcatggctgcgagctggggcccgacaaggcgctatccntccgcgggtatgacacagtatcgcctacggacggcacaggacttatctcacccgtgaatgaggacctgcgctcctggaccgcggtggacacggcgggatcagatctccgaagcaaaagtcaaatgatgcctctgaggcggagcaccagagagcctagcctggaagacacaatgcgtggagtgggctccacaaatacctggagacggggaaggagacgctgctcacctggagccccccagagacacaccgtgactcacccaccccatctctgaccatgaggccaacctgacgggtgctggggccctggcgcttctacccctgcggagatcacactgaccctggcagcagtgattggggaggggcatacccaggacacggagctccgtggacgaccaggcctgccacggaatggaacccctccacgaaagtggggcccctgtggtggtgcccttctggagacggggccgcagaatacccgtggccgtgcccgctgaggggtcaccagccgcacaccttaataaaagacgggtcacaccacacccccacggggaaagacgccggcgcccggag

SEQ ID NO: 730653 - DNA, 2721 bp, Homo sapiens; identical to SEQ ID NO: 191265

SEQ ID NO: 730654 - DNA, 2618 bp, Homo sapiens; identical to SEQ ID NO: 191266

SEQ ID NO: 730655 - DNA, 354 bp, Homo sapiens
  misc_feature (14)..(14): n is a, c, g, or t
  misc_feature (22)..(22): n is a, c, g, or t
  misc_feature (25)..(25): n is a, c, g, or t
tagagcatccccgnctcatttnagntcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataaactgaaatgagccggttaccgagc

SEQ ID NO: 730656 - DNA, 1221 bp, Homo sapiens
  misc_feature (506)..(506): n is a, c, g, or t
  misc_feature (629)..(629): n is a, c, g, or t
  misc_feature (657)..(657): n is a, c, g, or t
atccgttgaagcagggctatgggagctggagcggagaggagagaagcaccttgcctttgctggtgtttttcccgcagcagatggagtctcgctctatcacccaggctggagtgcaatggcgcgatctcggctcaccgcaacctccatctcccaggttaaagcgattctcctgcctcagtctcctgagtagctgtgattacaggcgtgcgccatcacacccagctaatttttgtattttttagtagagatggggtttcaccatgtcggcctaactcctgacctcgtgatccgaccatcttggcctccgaaagtactgggattacaggtgtgagccactgcacccggcccaaacatttctttcttcttttcttttgagacagagtcttgctctgttgcccgtggctggagtgaaatggtgcgattatagttcactgcagcctcaaactcctggccttaagcgatcctcccatcctggcctcccaaagtgctgggattataggcatganccgcagcaaccactcctcacatttcttgagcatctgtgatgtatcaagccagatgctgggcactgaggttgcagaaggcattgttcctgtcttctaggagcccaggctagcagggaagacggntgtgtatagagttaccacaataccaggnctcaacttccgtctgtaacacaggtggaccatgctagattgtcccagcctgccctgtgcttcattagccggtcaacagatccatctcaaatacctcccatgggtactcactgattgctttaacccaaaccatggcactcttgaagactttccctcaggaagctcaaggactatgcatccttctgggtcagaactggacacacagccaccagtgctggacaatggcggcggctcagggacacactggagcctggcccctgcagagctcccagcatgggtgggaagagagatgcaaatgaccacacgcgggtgaggagactccctcggtgcggctgggatgagccctagacactctcaatcacccccacgatgaccccttcccagaggtcccctcagtcatctgccctgaaccaagctcttcctgatcctagaccctccaccctccctctatcttccagggcttggtgacattccaggcagaaatttctgacccttttactttggtccctccctccccagcccagtctctggtcaaactggattcctggctgttcccagaacgagc

SEQ ID NO: 730657 - DNA, 930 bp, Homo sapiens
  misc_feature (3)..(3): n is a, c, g, or t
  misc_feature (6)..(6): n is a, c, g, or t
  misc_feature (20)..(21): n is a, c, g, or t
  misc_feature (33)..(33): n is a, c, g, or t
  misc_feature (736)..(736): n is a, c, g, or t
  misc_feature (809)..(809): n is a, c, g, or t
  misc_feature (818)..(818): n is a, c, g, or t
  misc_feature (820)..(820): n is a, c, g, or t
  misc_feature (833)..(833): n is a, c, g, or t
  misc_feature (838)..(839): n is a, c, g, or t
  misc_feature (846)..(846): n is a, c, g, or t
  misc_feature (849)..(849): n is a, c, g, or t
  misc_feature (857)..(858): n is a, c, g, or t
  misc_feature (865)..(865): n is a, c, g, or t
aantangctagtacgaggcnnggttaatcggcngagggatctcctgtctcagcctcccaagtagctgggaccaccatgcccagctaattttgtattttttgtagagacagggtttctccatgttgcccaagttggtctcaaactcctgacctcaagtgatccacccaccttggcctcccaaactgctgggattacaggcgtgagccactctgcccggcctgtgcatattttcttcactgacgctgtttccaagtcacagaggccttcacacgtgtctgggagggttttgcccgggcacttgcaggggtggggtgggaggagcatttctacccgtggccccttcttctgcttaaacacacggcagatccagaaatttctctccagcagaatgcagcccctcaaggatgggggccttggttacatcggtttttatgtttaacttccacccagagcttggcgtttcaggggagcctgagttgaaggcacaaatgcgtgacagttcctgctctgccctttacaagctgtgtgaccttgggcaagttactgaacctctctgtgcctcagtcaatagggatgatgacggcaccccttgcagaccttttggaaggcttaactggatgagtcaccctaagcattcggagcagtgtgggtgggggcgctctgggtggaggagaccagctctaggcgagggtgccttggactccctcatgggctgcctctctctccaggcccgcanctctgttcagccagtctgggagacttgggcttgcctttggctatggagagtgttaccccatctttaaagtgcnggaagtgangnatcctctctctantcttnnttggaantgngcagaagnnacagaantgctgggtcccagtggcggcagtacaagtgggcacccggggtccggcaacggggcatgggggcgc

SEQ ID NO: 730658 - DNA, 793 bp, Homo sapiens
  misc_feature (16)..(16): n is a, c, g, or t
ggcagatcgaggcggngttaaccagagcaggaaaggacttggaaaggaataattttgaggagtataaatgagtcctgaaactttgaaaactgctgcttgaggagattctacagccagaggtgccaagagatggctcttgctattatttctgcccctagagattgtcagctttcttttggagctactttggggtggggaaactcttaacaccttccagatactggatgttctgcatgaaaagtccaggattgaagcatcttggtgatgtagctcttttcttcaataagcttatggacacaagatgctcttgtagacacaagatgcttataaacacacacacttcctccgaggtgtacccacagtgccacaaggggtttcactcctagctgcactctgacctgaactgtgtctcttcttagttcatctaggttttgttgagcactggccactagttcagactctaaggcaggttctccattgcgccttcctgacatctttttctgacctgtatgatgacagtccgggcaacctaagtccatgagggatgtcctaatatcattgctccttctcagtgatctttgagctccaaattctcatttgtgactttttttttttttttactacaacagatatctacttctggtctctataaaaatcaaaggtagtattcaagttccctccaggccctcaacccctcccctacccccaaaagttttcaccgttagaaacagaagtggtggaaactcacatggtgtttccttggttccttacagaaatgtgggcctatggaggg

SEQ ID NO: 730659 - DNA, 801 bp, Homo sapiens
tctggttgctcgcgccgacccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttctctcatactccttatgtacagaaatcacatgaaa

SEQ ID NO: 730660 - DNA, 1310 bp, Homo sapiens
  misc_feature (26)..(26): n is a, c, g, or t
cagtcaaggagcactacctagagganatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggacccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccggccagtgcaacgagtacagtgaggaggaggagctggtgaaaggcgtgctgatggcggctctaacccaactcatccaggtgaggcagggcaggtcacccggcggggaagttcagccaggttcttttgccattgggatctgtggaggccataagg

SEQ ID NO: 730661 - DNA, 528 bp, Homo sapiens
tgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaagctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccggccagtgcaacgagtacagtgaggaggaggagctggtgaaaggcgtgctgatggcggctctaacccaactcatccaggtgaggcagggcaggtcacccggcggggaagttcagccaggttcttttgccattgggatctgtggaggccataagg

SEQ ID NO: 730662 - DNA, 1572 bp, Homo sapiens
gtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccaggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctcctcctgtggcccc

SEQ ID NO: 730663 - DNA, 1996 bp, Homo sapiens
  misc_feature (446)..(446): n is a, c, g, or t
  misc_feature (618)..(618): n is a, c, g, or t
  misc_feature (728)..(728): n is a, c, g, or t
  misc_feature (772)..(772): n is a, c, g, or t
  misc_feature (878)..(878): n is a, c, g, or t
  misc_feature (984)..(984): n is a, c, g, or t
ggccgattctaatagtttgccaagctctgccgagtctggctggcactacagcggtcctgaaggctgtgtgctatcggtcgtgctgccaggagcatggtggtcagccgcgtataggatgagccgcattggcacaagtgagggtgagggagacccactgactggatcgttgtgcgtgatcaggcggactgtcctagcaagcgttcatgcacagctggcgaatggacgggagagagatgctgtcaaactgtctccatggataatctgaagagactgtgttcctgggagtgcagggttcacagattggggaaggcaagtgtgaggtgacggagatgtgatgtaagcgttgatggagaggcatcgattaacaatcgcaaagggaaacttatcttcttttatgaatggagcgtcaactaaactggacaggtacttctaagtcaggagtacantacaaaggacatgtggagatccccaatttgtctgatgaaaacagcgtggcatgaagtggagattagtgtgagccttgccaaagatgagcctgacacaaatctcgtggccttaatgaaggaagaaggggtgtaccatcttctaatgatgaacgcaatgcgtgaatgtacatcnagcaccctcatagacatgcagacggttcatcctcatgtggacatgtattctattaaccgtacacattgaagtgagacgatggtcaggtaggatcaccatgtatgtgtggncagacgcgaggtgatctgagagaagcttgacgtgaggctgcaantggcctaaaagtccctggaatccctatcagataaacctccagggtccatagagcacctgattgagaagatcacatatactgcgccacatctatggtgagtattccncttgctgtacacgtgaacagcctgtgtccctgatcggatcagccaagaaaggaggtcttctactagaagttgcttttagcacaaaccacatagtagcctgagttgnccagagggcacctgtataggcccaatgggctacgcgtggcagaacatatacggaacggcatgatcacgaatggatggggaaaaggagttacccagacaattggctatgaatggtcagaacggtctactgagggagaattgtaacttgaattcgtggggtcccctttgaggaaaacaatgatttgctcgacgtcgatagagttgcgacggagctgtttagaagatctccttttggggcccaacgaagtgcggacacccgtcttggccccgatcaactccacgcaatgtggaaccccttatcaagttccgaacaacagcaaacccggggaccacgacctgtgcattcttggttgtctactgggcaacgggtgccggaaagggcctaatcccccttgggatgcccttgaaggggaaacgaacaggcgaggagcaccggaaccaggggggcttgggcaaaggcaggtggttacctaaacctttgtgggaacgcgtgccgtttgaataagcaagcacccttcttgggccttaattggggcgccacacgccggtgcatcttataagggggcccgagcaggggccagggcgggacgtccccagaccttgtcttgggaacacctttccagctcccaaagcttcctcttccctggaagcgtggcggccctggccgcacctcaccacgggaacattgtcacattcggtgccccaaaccatgccgtaaccctgtgggtgagcccccaggagggccccccttacccttgtcgaccatatataccagcgtgggcgctctgctcgcacaggtcaccccggacgcgcgcgccgccaacaacgcggcagcaacctcctgcaacggcgcgcacatgtcgcacaaaaccccatgtcagcgacagaacaccaacacacccgccgaccccaactctgcgcgcgcaacgcgctgacacagcaccgacataaccagcccgtgacgaccctctaaagcgagatcacaccgctgccgccctattgacattaacgcg

SEQ ID NO: 730664 - DNA, 2202 bp, Homo sapiens
ggcacgaggcctcactgaagtgaatatgaataataatacaagtaattattatcgtattggattttggaaagttggatggtgatattcctttggcatgcgagactattaatatgactcgtgctggaaaaagtcactcatgttttctctgggcttggattcctcattccttcattcaatgaacatttgctccgcagttacttgtgcgaggcactctaaccggagactgaaggtatagagcaagcttgtccaacccgtggctcactaaccgcgtgcggcccaggacagctttgaatgccgcccaacacaaatttgtaaatgttcttaaaacattatgagaggttttttttttgcgctttttttttttttctcatcagctatcattagagttagtgtattttatgtgtggcccaagacagttctcccagtgtggctcagggaagccaaaagatcggacgcatggtatagagaaaaacaagaagcatccctccatagcgtatgccccacaagagacaatttcccagagaccagtagctgaggcaggtgtaggaagtgaatgggccattagatggatgcctgtggaagctaaagaaggcggatcggaggaagacaatccgacctggggagtggaggagagagggggagaaggtggcatcgacttggattttttaagattgagtcatttggggcacttggaaatgggcattctgggtagaaggttcagtattaacaaaaacaaaacaatactcttgagtgggaagaataatggatagtttgatttgcctagaatgtagagattaataaggatgccaggattctagggcgggggaccaagatggggagtcagtggtgggaagccctggaagattccaagcaaggcatgacagtgctgtggcagcggatagttaatttggccaaggagtggaaccctcctttgtagcgtgagagtgttggaccaaggatctttgcagcactgagagtctatgaattagccaatctgggaatacagggcttcatggaaacatcacagtgtaggaggattatggatggaaagtgcagctggaatgggaaaaggtcgaaacctaattagaagccttgggccaggggtagcctgtgatcacctgcgattgtgtttcagacttccagtaacattcttgggagtagttgttaaaaaagtgctcttcgtgtttctgtaacttgggtggcctcttaggcatgagcagacgttcagcctgtccctatcggcagggaacatttatttattttgatgcatccccagggaccaacagagagctataaagacagcagcctgttttgccagttggccagttgaaatgggaaatttcttatacaaagattacagacttaaccttcatgccactctttattataaactgttcatacagttctttgcagatggactcaaaatgaagcatttttttaccttaaagattgtagtagaggatgttataaatgtgtctttaattggttctgtgttttctcatacttatgaagcactgcattacacaatttgtctgaatgaaattggtagatgtggtccatgtaaaacttacccaatcagacaggttacagatatttgcctaaaatctgagcctgggcaccttagagatattctaacctcacccggaaactccgcaactggaaaggtgcagggattctggagcgaggttccacttcacattatcttctggttctgcatatgaatatttaaaaacttcctgtggtgttatatgaaatatgtatttgcatgcttttgcagctgctccatctaatagtatttgagaaggggaaaaaatgaaatgttgcttagtagaaattcctttggttaatgatgttaatcaatggtataaaaaaggagcatgaactctggaataagaagggacacctgaaattgaattccagttgtgtcgcttactacctgtgcgactttaggtctggcacttaactcatctgagtctcagtttcctcatctgtaaaatggtcaccacaataatcagctcgcagtctaacagaacaacctgtcaccactagaatcccacttgttggccttttatagccacacctacttccctcccactgcctcctccacttccttaactcatagcaaccactgtgtgttcactatctttttaaataattgtatcatttcaagaatgttataaaaatggaatgatatagtgtgtg

SEQ ID NO: 730665 - DNA, 1249 bp, Homo sapiens
cagcctgggcagagaccggagctagcccacacgctcttggccaaggacggcagcccgcagagctctgaccagcttggccagagggaatgcagctgattccccctgctctgtgcccgacccgtgttaaagtttaacccggctttccaggtctcctcttttccagacaggggcgcagggaaggagcgcccggcgagactgacgctccggctccacgtcccgctctggctctgggctgtcggttatccctgtaattacctgacagctctgactgggcttaggaaccggtgagaaacctcagtctcatctctggtatctggaggaaggaagggaaataaagaggcattttataaatgcggactcaccagttctcaacctccccggccggtgtgtgggaaagggcggcggccgggctggctgggcctggggcggggcgagccatccccggctcgggctccggggcccggcccactctccacaggccccgcagcgagggcgtggctcccaggttccacgtcctgcgagaggggaccatggcctggggctcagcagcctcctcggggcaccaggcagcctgcggagagaacaaggggagataagcttgaagaccgtggaccagcacaactgcacctcgggcagagccagccatctggaagggtctacgccccaccggtcgctggttacccagcgcagcagctccaactgcactgtcccccaaagaccctagggctcgcaggatgaaatggggcctgctgcctatttgggggtatttgtttccgaatacggaggctccgaagtgcgaaagttgcatatcagctgtgcctgagaccccacacctgagcccttcccagctgagcctggagcctgaggacaagccaggtcctagccccacacagaggaggcaccgcgagtcagcagcatctccaagctgtattaacaggggaaaacagttctcccattttcagagaaccaaggcaatctttcccccaagaaaatcaccttgccggccaggcacagtggctcatgagacaggaggatcgcttgaggccaggagttctagaccagcctgaacaacatattgagaccctgtctctacaaaacaacaagccaggcgcggtggcacaggcctgtggtcccagctactcaggaggctgaggcgggaggatggcgtgggcccaggagtttgaggctgcagtaagctatgatcatgtcactgtactccagcctgggcaacagagcaagatcctgtctt

SEQ ID NO: 730666 - DNA, 501 bp, Homo sapiens
tacccctaggtggaaagcgacgtgtgggaggaatgggacaggctggcccgggactggccggcattgtggtcaaactgcattaagcagaagatcaggtccgtcggcacgagctcaaactcatagggcgggttggtgatgacatacctctttgtgcactgactgggggtgctgaggtgagcatctctcagccggtaaattccaaaacaaagcatattatatgttttcagagctttgcagaacagatcaccataacaaccaccatcccctaagtccgcaaatggcccatcgagcagagctaactgggccacgcggcagcggtccctattggccagtgtctgcggggtgctgtagccacctctaagggcgttttcctcagcaatcagagcctccagctccggcgtggctcctccggtcaccagggtccgtatcagggtgaggatattgtcattgaagtactcgcgctcatgagtgagtccaggacactgacggcaaatgctgtcc

SEQ ID NO: 730667 - DNA, 260 bp, Homo sapiens
  misc_feature (66)..(66): n is a, c, g, or t
cgtgtgtcagccgatggcaccgggtggtcagtgagggacacactttggagaactgctgctaccagngtaagagtgcggggatatgcaggctcctgggtgtccatctgcacctgctctgggctcagaggcttggtggtcctgaccccagagagaagctatacccggggagggggaggcagacagattactagaccccaggagtttgagaccagcctgggcaacacggtgagatcccgtctctgctaaaaatacaaaattag

SEQ ID NO: 730668 - DNA, 628 bp, Homo sapiens
  misc_feature (66)..(66): n is a, c, g, or t
  misc_feature (628)..(628): n is a, c, g, or t
cgtgtgtcagccgatggcaccgggtggtcagtgagggacacactttggagaactgctgctaccagngtaagagtgcggggatatgcaggctcctgggtgtccatctgcacctgctctgggctcagaggcttggtggtcctgaccccagagagaagctatatcctggagcagcggcctggggaccttcaggggtcctcccattatttcgcgaatccaagatctccacctgtgcagggcacacctgtgtccctgtagcgtggggggaatctgtgtcacactcagacagccaccagagacaccccctgggacagcgccacattctgccggaggcgggatgttggtaaccgagacccagactgtgggagttggtgatatgtggggtgatccactcggatgcccagaaattaccgggactttccagcacctggtaaaacggacactggaagttgggcctctttgcttggacacatctcttcccgggccccttgaattgtgaccgaagttggccactaagttggggcgcttggaaaggcgcttggaaccccaagccgttgaaccttggttgggagagtcaaagcgccaaaaaaccaaaggcttgttcaaacccttccgaaaaaaactttttctn

SEQ ID NO: 730669 - DNA, 1168 bp, Homo sapiens
  misc_feature (178)..(178): n is a, c, g, or t
agcgggaggtacgccgggggcgctggggggctctgcggcgggcggcgcgcggccggggcgcggcgcggagcggagctgcagggcggcggcgggagcgcggggcgcaagagccgctccgccgggagtgccggggaagttcgcgctggcagcatggggcggtgacgccgcaccggccttncgcgcctgccagccgggcgagagcaggcggaggagaaggaggatgcatcctcaccgacggctcgcctcccggggccggcgcgcaggtgccttgcagagagaggagtagcttgctggctttgaacgcgtggcgtggcagatatttcagaaagcttcaagaacaagctggagaagggaagagttattcctccatattcacctgcttcaactactattcttatgggaatggacaatggaatgttctctggttttatcatgatcaaaaacctccttctcttttgtatttccatgaacttatccagtcactttggcttttcacagatgccaaccagttcagtgaaagatgagaccaatgacaacatcacgatatttaccaggatcttggatgggctcttggatggctacgacaacagacttcggcccgggctgggagagcgcatcactcaggtgaggaccgacatctacgtcaccagcttcggcccggtgtccgacacggaaatggagtacaccatagacgtgtttttccgacaaagctggaaagatgaaaggcttcggtttaaggggcccatgcagcgcctccctctcaacaactccttgccagcaagatctggaccccagacacgttcttccacaacgggaagaagtccatcgctcacaacatgaccacgccaacaagctgctgccggctggaggacgagggaccctgatctacaccatgcgcttgacatctctggagagtgccccatgcagttgaggacttcccgatggatgcgcaccgcttgccctctgaaatttggcagtatgcgtacctaaatctggaatacgctacgtttggaacaagggtccacaagtcggtggtggtgggggaagatggtcccgagtgaaacgtacaactgagggcaaagggggctgaaacatagaacagacgggaatacagttgcaggcatcagctgaaagaaaggtatgcacagaaactccgaagaggggacaa

SEQ ID NO: 730670 - DNA, 1535 bp, Homo sapiens
gatggttagtactataattatcccaaggattcattcactcatagaacatttgttgagcaattactacctgccagtcacttccaagtggtaagtgagatagaaatggttctttgtggcgctcacaatttattggagaatggaaacacaattacaaaaaaaaagtgtgataagttctgggagaagggtggtacaggatcctgtggggtagtggtggctccatataggagggacattgggatactgatcaggaaggagtgggggacagggctagaagctgcattagtataaagttatgtcagactgccaaaacaaaacaaacacaaaaaatcagtagtctgtggtaaagaattgctataggaacagccagtaggggcagttaagctggtcttggtgaatcaggggaagcgtcctagaggaacagatgtccatgctgaggccaaatgctggacaggagttagccagacagggaaattgcattctgggcagaggagacagcaaaggtcaagaaacatgacaactttggaagactgtaacttgttcagaggcagagggtgcaaaggagaaatgaggaaaggtgaagctggagaggtgggcttggtccagctcttgctgggccttttcagccgtgttaaagatttagactgtatccagagggatgttgaactttaagcctaagactgaaaaggtgagaattgtgccttagatcactatggttgcagtgtggagactggtttggaaaggggagaaatcagaggcttttacagccatcccagggagagagaatgaacaccagaattagggtaatggaagatggaaagaagagaaatcgttttatgggttgctcaggagatagaattgacatgtcttgggattgttttgctgtgtaggggagagagacaagtcaagagtatacatcctgtttctgacttggcaactgggtgggtcatgggtctgtttcctgagacagttgtctacagccataccaccgtaagcgccctaaatctcatcagagacagtttatgcaaatggagcttggggaaagagaggtcgtggctggagacagagatttgggcatcatcaacatataggtgtggggagcagagaaggctgaggaagaaagcaggaaacatataaaaaggagagcagggaaaggagccagtgagacaggaaaaataaaaaattataacaaacctgagaaccaaaatgaacgaaaatctgttcgcttcattcattgccccaaatcctaggcctacccgcagagtactgatcattctatttccccctctattgatccccaactccaaatatctcatcaacaaccgataaatcaccacccaaaatgactaattcaaataacctcaaaacaaatgataaccatagacaaactaaaggacgaacctgatctcttatagctagtatccttaatccattttattgcacaaataaactcctcggactcctgctcaatcatttacaacaaaccaccaatatctataaactagacagggcatcccttatgagcggcgcatgatata

SEQ ID NO: 730671 - DNA, 1872 bp, Homo sapiens
  misc_feature (21)..(21): n is a, c, g, or t
agcggaggggcggacggcgtnggtttgaagaccttcagcgttgccctggcggagcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtgatggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataaaaaaaaaaaaaaaaaaaactcgaactagtctctctctctcaatggcgtcagttggtgagtgtccggccccagtaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtacgtg

SEQ ID NO: 730672 - DNA, 783 bp, Homo sapiens
ggaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatcttttgataaggtcagaggctatgacatcaagctgcttcgatacctgtcagtcaaatacattctgtgacctgatggtggagaacaagaaggtgaagtttggcatgaa

SEQ ID NO: 730673 - DNA, 858 bp, Homo sapiens
ggaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacaggacgagtaccgtaacaggggctttggggggccacaaaccgagaaaaacccccaaacacacaacacaacaaacaaaagggcatttaaagggggcaaaaaggaaagactcattccacacggaaaggcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatcttttgataaggtcagaggctatgacatcaagctgcttcgatacctgtcagtcaaatacattctgtgacctgatggtggagaacaagaaggtgaagtttggcatgaa

SEQ ID NO: 730674 - DNA, 766 bp, Homo sapiens
  misc_feature (42)..(42): n is a, c, g, or t
  misc_feature (158)..(158): n is a, c, g, or t
  misc_feature (209)..(209): n is a, c, g, or t
  misc_feature (234)..(234): n is a, c, g, or t
  misc_feature (272)..(272): n is a, c, g, or t
  misc_feature (372)..(372): n is a, c, g, or t
  misc_feature (414)..(414): n is a, c, g, or t
  misc_feature (445)..(445): n is a, c, g, or t
  misc_feature (520)..(520): n is a, c, g, or t
  misc_feature (539)..(539): n is a, c, g, or t
  misc_feature (663)..(663): n is a, c, g, or t
  misc_feature (680)..(680): n is a, c, g, or t
gccggccggtctaagcgggagtctcgcggttccactcgcggnaagcgagagtctgagtcgcggggcagctccggtcgcgtcaagcgggagcgagatcgggagcgggagcctgaggcggcgagctcccggggcagccctgtgcgcgtgaagcgggagtncgagccggcgagcgcgcgcgaggccccggtttctgttgtcccgtttgtgcngggtgaagcgggagcgctgaggtcngatgaggactcggagcctgagcgggaggtgcgagcaangaatggccgagtggattctgaggaccggaggagccgccactgcccgtacctggacaccattaacaggagtgtgctggactttgactttgagaaaactgtngtctatctccctctcacacatcaatgcttatgcctgtctggntgtgtggcaagtactttcaaggccggggttngaagtctcacgccatacattcacagtgtccagtttagccaccaatgtttcctcaacctccacagcctcaagtttnacgtgccttccagacaacntatgagatcatcgattcctcatgtggaggatatcacgtatgtgttgaagcccactttcacaaagcagcaaattgtcaacttgggacaagcaagccaaatggtcccgggcatatgatggtaccanttacctgcgggtattgnggactggtaacattattggcaatgattattgcaacgctgcctcaggggtctatctatggtctctctcgcaatacttctggcacgag

SEQ ID NO: 730675 - DNA, 968 bp, Homo sapiens
ggattagggctcccgaggcaacttgctcggggctcaggccgttctcccccgaagctcgggctgccgggctgttctggctctggcctccctctcctcctcttcctcttccttctgtcccctcccgcgttccttcccggccgcgccgcctgcgccctcgcctcctgtggcgctgctcctccgccctgcgctcctggggtccccgcagtccggctggccgcgttgcgcgcggggctcactttctgccgccggtggcgagtggctgaactcctaagtgaccaggaacagacgatttttaaccgagttctgctgcgtggagcccaggttggcgctagtgagtgcagtgtgctgacccaagtggtggtggcccaaggacgcgctgacccgtacatttggcaaagctttcattaaatgtatcagattctcgcggaagtggttgcagtccggagagtgaaacagctatctctcaagtcctgaccggttcagctgaaatctacatttgcactgaatctggcaaaacacggacgggtccgcccgagatctcaggaaacccagagcaagttacctccatgtagttgatcattctttctgaaaggacggacaccatttaccccactgcaatcctgtccaacgggcagctctgagtttagctttagcgccaaaggattgatttcccccacccgctggagatttactggggacgagcgggggaggggaggcgaaggtacctcggaggaggtcaagtgggggaggaggaggagcagcagaaaattaccagccaagcaggggagggagttggaagcccggaaatataccaggatgcctcaagtaaccttcctttaagtctcagaattcagccctcggaaaacagcctcataaggtgtcctgggaaggagtcctcgggtgggctgcggaggtgatgtcaagagttacagtaactttatgaattaaactgacggtaggcatgtcgg

SEQ ID NO: 730676 - DNA, 821 bp, Homo sapiens
ctcgggctgccgggctgttctggctctggcctccctctcctcctcttcctcttccttctgtcccctcccgcgttgcgcgcggggctcactttctgccgccggtggcgagtggctgaactcctaagtgaccaggaacagacgatttttaaccgagttctgctgcgtggagcccaggttggcgctagtgagtgcagtgtgctgacccaagtggtggtggcccaaggacgcgctgacccgtacatttggcaaagctttcattaaatgtatcagattctcgcggaagtggttgcagtccggagagtgaaacagctatctctcaagtcctgaccggttcagctgaaatctacatttgcactgaatctggcaaaacacggacgggtccgcccgagatctcaggaaacccagagcaagttacctccatgtagttgatcattctttctgaaaggacggacaccatttaccccactgcaatcctgtccaacgggcagctctgagtttagctttagcgccaaaggattgatttcccccacccgctggagatttactggggacgagcgggggaggggaggcgaaggtacctcggaggaggtcaagtgggggaggaggaggagcagcagaaaattaccagccaagcaggggagggagttggaagcccggaaatataccaggatgcctcaagtaaccttcctttaagtctcagaattcagccctcggaaaacagcctcataaggtgtcctgggaaggagtcctcgggtgggctgcggaggtgatgtcaagagttacagtaactttatgaattaaactgacggtaggcatgtcgg

SEQ ID NO: 730677 - DNA, 1301 bp, Homo sapiens; identical to SEQ ID NO: 293140

SEQ ID NO: 730678 - DNA, 345 bp, Homo sapiens
  misc_feature (53)..(53): n is a, c, g, or t
aggccgttacgttcgatcttagcctgcgatggcccttccaccgagaagcccancgtgcccacgtcgtccccgatagcctccaccacaaagtctgctgacttgccaacgacgacgacgacgacgtcgtcgtcgtcgtggtggttgaggtgatgaccctctgcctgaacaaaaacaggcaatcaaggtggagggtgacaggttctgaaaggcagctaagaggagaggaaggctgacagcatgtgtgaggccagaaggaaagggtgagaagacaaggaactgacactctgagagtctccatgctttctcactgtgcatcaagagcaagtttaaccacgacgacgacga

SEQ ID NO: 730679 - DNA, 913 bp, Homo sapiens
cctgttggccgagtggagactggtgtactcaaacccggatatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatgggaacaacttgaccaaaaatttgtcacagaattttgagacccattaaaaaagtttcatgagaaaaaaaaaaaagaaaa

SEQ ID NO: 730680 - DNA, 834 bp, Homo sapiens
tctccggttttctcccccgcagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggcagagttggaccagctgctcagtggctttggcctggaagatcctggaagctccctcaaggaaatgactgatgctcgaagcaagtacagtgggacccgccacgtggtgccagcccaggttcacgtgaatggagacgctgctctgaaggatcgggagacagacattctggatgacgagatgccccaccacgacctgcacagtgtggacagccttgggaccctgtcctcctcggaagggcctcagtcggccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtga

SEQ ID NO: 730681 - DNA, 1140 bp, Homo sapiens
ctcttgccactgccatgtaagaagtgcctttcaccacccccacaccctgccatgactctgaggcctccccagccacgtggaactgaggcagctgtatggaggccaatatgcagacaagggaagtaactcaggcattttgggggagaggtacagaaagaagagaaaagactgaactgactgctgttctgaacaagaactgtgactatatgtggtactcccagaatgctggtttcctttcagacccatcaagtggccatcctattggcttggactgaagacccccactggagaactgtctctgcagcctatactgatgacactggccactgtccagggctccaccccaaggagtccaagccccagacatttagccttagagagaatccagattttgcatttccagtgcagggattgatggagccttgtgtatcaaagtgccaatttctttctaacaagctagggaggataccgttgacagcagcagaaaggggtagcagtggtttgctttccaaatggtaataagaagggcctggcagtggcaacctgtccacgtatcattaaaaatggactctcctgcttcgtttggaattcaacccaatgaacttgaataaactctggacaatgaccagcacagagccctaagcaggatacagcaagattatttgctttactcatccactgagtacctaccatgtgccaaatactatgctatatgccgagtatacactggcaaataaaacacatatggtccctggagcctatgaatcttaccccatctagccacaaataataaaaataagaagaatctgaaggacaagtgggacagaaatactcaagcagaatgagggtgagattgaagtccctgaacatacagtgccctttacacttgatcttagccaaaaggccgagaagagattacagtgctttttaaaggtagcatttcacccagccaataatcaatccctttggccttcttgaggtgcaaggccacacactcaaattctttaatcaaacaataggctagtgcaaatggagctatttcttaaacccagctgtttacacagcagctacaaatctgttcagaaggaatcccccaccatccacaactgtctatcgagcagatgtgcaagagtatttgtc

SEQ ID NO: 730682 - DNA, 1902 bp, Homo sapiens; identical to SEQ ID NO: 553992

SEQ ID NO: 730683 - DNA, 884 bp, Homo sapiens
tgcttgattcctcgaaaagggcggggactctgggcagcggttgtggagtgccgcgggtccacagtgctgcactgagcagagaggaaggggcgtcccgggatatttggaggataaaggtgtgggcaagggtgatgaccacacctgccggctccggcagcggcttcggctccgtgtcctggtggggcctgtccccggcgctggacctgcaggctgaaagtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgcccgccagtggccgccttcgtgcgtgcccaggccgacctgctggcgcacctggtccccgagcccgaccgcctggaggaacagctgccctggctcagcctccgcgccctcaagttccgcgagcgggatgccctggaggccgtattccgcttctgggctggcggcgagaaagggccccaggcgttccccatgagccgcctctgggactcgcgcctgcgccactacctgggctcccgctacgacgcccggcgcggtgtcagcgactgggacctgcgcatgaagctgcatgaccgcggggctcaagtcattcaccccaggagttccgacgctggcgggacacaggcgtcgcctttgaactcagggactccagcgcctatcatgtgccca

SEQ ID NO: 730684 - DNA, 687 bp, Homo sapiens
tgcttgattcctcgaaaagggcggggactctgggcagcggttgtggagtgccgcgggtccacagtgctgcactgagcagagaggaaggggcgtcccgggatatttggaggataaaggtgtgggcaagggtgatgaccacacctgccggctccggcagcggcttcggctccgtgtcctggtggggcctgtccccggcgctggacctgcaggctgaaagtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacgtgagctgggatgaagatgagagcccagattcccgagtccttgagggaggaagggattgaaattctaaaacctcagttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgcccgccagtggccgccttcgtgcgtgcccaggccgacctgctggcgcacctggtccccgagcccgaccgcctggaggaacagctgccctggctcagcctccgcgccctcaag

SEQ ID NO: 730685 - DNA, 1351 bp, Homo sapiens
ctctgcctggttcggcccgcctgcctccactcctgcctccaccatgtccattaggggacccagaagtcctacaaggtgtccacctctggcccccgggccttcagcagccactcctacacaagtgggcccggtgcccacatcagctcctcaagcttctcccaagtgggcagcagctgctttcggggtggcctgggcggcggctgtggtggggccagcggcatgggaggcatcaccgcggtcacagtcaaccagagcctgctgagcccccttgtcctggaggtggaccccgacatccaggctgtgtgcacccaggagaaggagcagatcaagaccctcaacaacaagtttgcctccttcatagacaaggtacggttcctggagcagcagaacaagatgctggagaccaagtggagcctcctgcagcagcagaagacggccgggagcaacatggacaacatgttcaagagctacatcaacaaccttaggcggcagctggagactctgggctaggagaaactgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctgtatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgcctgcagcgggcaagcaggacatggcgcggcagctgcgtgagtaccaggagctgatgaacgtcaagctggccctggacatcgagatcgcacctacaggaagctgctggagggcgaggagagccggctggagtctgggatgcagaacatgagtattcatacgaagaccaccagcggctatgcaagtggtctgagctcggcctgtgggggcctcacaagccccggcctcagctacg

SEQ ID NO: 730686 - DNA, 908 bp, Homo sapiens
  misc_feature (193)..(193): n is a, c, g, or t
  misc_feature (219)..(219): n is a, c, g, or t
  misc_feature (250)..(250): n is a, c, g, or t
  misc_feature (270)..(270): n is a, c, g, or t
  misc_feature (302)..(302): n is a, c, g, or t
  misc_feature (380)..(380): n is a, c, g, or t
  misc_feature (384)..(385): n is a, c, g, or t
  misc_feature (578)..(578): n is a, c, g, or t
  misc_feature (583)..(583): n is a, c, g, or t
  misc_feature (589)..(589): n is a, c, g, or t
  misc_feature (598)..(599): n is a, c, g, or t
  misc_feature (611)..(611): n is a, c, g, or t
gggggtgaagaaggggccggccttcaagcaacagcgacgcaagatggcagccaccacggctcgggagtaaaagtccctcgcaatttccgactgttggaagaactcgaagaaggccagaaaggagtaggagatggcacagttagctggggtctagaagatgacgaagacatgacacttacaagatggacagggnatgataattgggcctccaagaacaantttatgaaaaccgaatatacagccttaaaantagaatgtggacctaaatancccagaagcaccccccttgtgtaagatttgtnaacaaaaattagtatgaattggcagtacacatagtctctaatggagtggtggacccaagagccatatcagtgctagcnaaanntggcagaattcatatagcatcaaagttgtcctgcaagagcttcggcgccctaatgatgtctaaacgaaaatttgacactccctcagcgcccgatagcacaggggttacagcaattaattcaacaagaaaaacacaggccttccccttcccccaattcgatgtaatccagtccttcattttcccacagaagtanatttnctaganacgtttgtnnacctcaaagtancggaaggaaggtccccttcaaacggaaatttatcttacagactaccgtcgatgactactacttgttggcccatcgcaaacattaacgtgggcgccaacaaataatccggtccagtgtaaccctgtacagtagttgaactccggatcagacggctttactgggtcccacatactgggggggcatcacccactgggccacaccttcgcatacacgttgtggtacaagcggggcgcgtcaccataacagaggcacaccatgaaaacgcacagcgggggtcgaaacagcacgcacggacat

SEQ ID NO: 730687 - DNA, 940 bp, Homo sapiens
  misc_feature (140)..(140): n is a, c, g, or t
  misc_feature (321)..(321): n is a, c, g, or t
  misc_feature (400)..(400): n is a, c, g, or t
  misc_feature (439)..(439): n is a, c, g, or t
  misc_feature (648)..(648): n is a, c, g, or t
  misc_feature (689)..(689): n is a, c, g, or t
  misc_feature (697)..(697): n is a, c, g, or t
  misc_feature (699)..(699): n is a, c, g, or t
  misc_feature (701)..(701): n is a, c, g, or t
  misc_feature (703)..(703): n is a, c, g, or t
  misc_feature (706)..(706): n is a, c, g, or t
  misc_feature (711)..(711): n is a, c, g, or t
  misc_feature (718)..(718): n is a, c, g, or t
  misc_feature (722)..(722): n is a, c, g, or t
  misc_feature (725)..(725): n is a, c, g, or t
  misc_feature (732)..(732): n is a, c, g, or t
gggacacaaagaaaaattgaataaactgtatgatttaaaagattatcgggagagttacctcccgatataaaaggaaggatttacagaatgtgacctaaggtctggcgtaaatgtgcaccggaaccgagaaggcccggatngtcatggacgatgagatacaccggaatatcatggacatattctttaaagcgccctttatcttcaaatgcggcacggaaaccggaggctttgaagaactcaaggaagcgcggcacgataccgcccgcaataaacacgccgccaaatgtcccgagattgagcgccagattgccgcaaaacggnccataatgacgcaaaacagcgacaatgcgcggcggcaatcggtgcagctgtcagccagcgcgcgtcggtaatatctttnggcttgagattttctggcaggcggttgtcagctttcaanaatggcgcgatacaaattcagcagcccagggccagaaagcacgcgctccgcccgaaacatgaccaatttccgcacgcaatatttcgaggataatggcctcttcttcactattcgggcaaaatcaacgtgaccgcttcgcctggcaagcttaaccaaagcttatcgacatggaccagatgcgcaacccaagcccgttccggcacgtaaancggaataggcttaccttcgaccggtctggggcacaaatggntagatgcncntntncancatcnggatcgncatnganacagggntaaacacgggaataattccagaatggtaaaacgagaatccttttcacttcgcgaatggaaacgcaggttggtgggctcgcaccaggcggaactgggaccacggaaaacgggcttaccgcttgtttcaaaaacgcacagcgtgcgggggaaacgcaatcacggcgtaccgggccaaaaggtggccccacacgtcttatgcggcaaatac

SEQ ID NO: 730688 - DNA, 1218 bp, Homo sapiens; identical to SEQ ID NO: 395758

SEQ ID NO: 730689 - DNA, 587 bp, Homo sapiens
ggagtgaggcaatgcctcgccctgcttcggctcgcgcacggtgcgcgcacccactggcctgcgcccactgtctggcactccctagtgagatgaacccggtacctcagatggaaatgcagaaatcacccgtcttctgcgtcgctcacgctgggagctgtagagcggagctgttcctattcggccatcttggctcctccggcttacattcttgtatagggattactttcctcactttgttatatatcctggaagctatgaacaatgatgcttcttcatactcttcaacctcatcatgataccttgcacgaagcaggagctcaactaatttgggttgaggccagaatgccaatagtgagcaaaaaaggatgatatttgacacttggcattgaatatctgaatcatgatgtccacataactacagctatgcaccacataatgatgttttactcaacaacagaccacatatacaatggtggtttcataaggctataaaggagctgaaaatttcttaccacctcatgtcctcatgtcatagtgcaacatattgctcttgtgtttgcagtgatgctggcataaacaaacccact

SEQ ID NO: 730690 - DNA, 2728 bp, Homo sapiens
tttctcatctgtacattgaggcaatgagtaaccacctcataggtggtaagggttagataggaaagaacacagtagaatgcctagcacacctaagtactcaatcaatgttagttctggacctttcatttgaatactgcttgagctctgtgcccaatctccctttcctggatcaaataagatttttctttgttagtgatttctttctagatacttccttggccagaactatagatcctctgtctttcactaactcttgttgatctatggttctcattcaagtttgtgtagaacatccagagatttcagaggcattgtttactcctgatgaacagggaacattgcgtgtccaggaaccagcacactgcctgagttatgggggatattcaggaagcatgctgaaccaatgaatgaatgaacaaatgaatgaatagctgattctgactagtcaaccaaaacttaattagcgccattgcttccagatgttattgcttctcaagggagtatgcaatgtgaaagaagaaagaaaaaaaggcgcctctcaatcgtcaaatatcagtagatgcattggttttattaactgatattttctcttcaaaggaaaggctgattcagtcttgcacaggcgaaagatccagtgggtcccattggttctctgtgtctcctgctacacaaattactgacggaaagatttgagccttcattgtgaccacatccacagagaccatagtccagagagagcaattggggcctgaatcaactgctggtgtttgttgagcagaaacagtgagtctctgacttcccaccaacagctaacctgatatggaagagccaagaggcatctcagatttgtcaacattgctttaatgagctgaggaacttctcatggtaaactcagcagctgagtaacaggatgatggcaccacaacaggtagataatcaaggcaggaggtcaaagcactggagccaacacccgcccaggatggggtataaaagggttgggaggagaggaggcttcagtctcagtggctcagccttcccagctgatctgaagctcctgtgcagcctcagccctacaccatgacctccttctacagcacctcctcatgccctctgggttgcaccatggctcctggagcaagaaatgtctttgtctctcctatcgatgttgggtgccagcctgtggcagaggccaatgctgcctccatgtgcctcttggccaacgtggcacacgccaacagagtccgtgtggggtcgactcccctgggccgccccagcctctgtctgcccccaaccagtcacactgcttgtcccttgccagggacctgtcacattcccggcaacatcggaatctgtggggcctacggcaaaaacaccctgaatggccatgagaaggagaccatgaagttcctgaatgaccgcctggccaactacctggagaaggtgcgccagctggagcaggagaatgcagagctggagaccacactcctcgagaggagcaagtgccacgagtccaccgtgtgccccgactaccagtcctacttccgtacaatcgaggagctccagcagaagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttactcccctgcaatccctgttccacgcctgcctcctgtacttcttgtccaagctgtggccctgtcaccggtgggtctccctctggccatggagccagcatggggagatgattctgaaggcccgagttaggagattgaggctggttgcactggggtcaggagtgccctcaccttgcccagtcttccttcaagactagactcactgaggcattttccctaaatcaaccggtagcagatacttccaaggagtggctccctgcctatgcctctaagctgtattttttgttgttgctaaaatgttgtaattatcttccatgaaagcaattatttttcctggtgtctcttcttggtacttttagttctattccagtgtttcagaatctccaaaaatgtaactgggttccctgcattaaatggtcaataaacctcctt

SEQ ID NO: 730691 - DNA, 366 bp, Homo sapiens
gaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccaggtgagtgggggttacagagccagggagtacctggcctccatctgagcagggaggtgactgtgtttctctgtgctccagtctgaaggcatcagcctgcaggccatgtcctgctccgaggagctgcagtgctgccagtcggagatcctggagctgagatgcacggtgaatgccctggaggtggagcgccaagcccagcacaccttg

SEQ ID NO: 730692 - DNA, 598 bp, Homo sapiens; identical to SEQ ID NO: 338675

SEQ ID NO: 730693 - DNA, 243 bp, Homo sapiens
aaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttctggagagcgaggactgcaagtacgtgtgatctgggcaattc

SEQ ID NO: 730694 - DNA, 391 bp, Homo sapiens; identical to SEQ ID NO: 338677

SEQ ID NO: 730695 - DNA, 397 bp, Homo sapiens; identical to SEQ ID NO: 338678

SEQ ID NO: 730696 - DNA, 370 bp, Homo sapiens
  misc_feature (15)..(15): n is a, c, g, or t
  misc_feature (19)..(19): n is a, c, g, or t
  misc_feature (279)..(279): n is a, c, g, or t
actctgaggatcccngtancatctatggggttgaagggatcattggccagctcaaggcttaccttctcttgggctgagatgctgctgccagcttctaaaacagcactctgttctcaaaacctgggggaatggagaaggcgcatacaccttagagactgcagatgcagagcaggacaggcatttctgatgacagtcaattaatgactttacaaatttaagtccatcctaacaaaagccccttaagacctaattagaggtaatttttctaagtttttgtanattattgaggactacaaatcttaattagcttctcagtaggttgtaattatatattattattttggagatgcatagatggtaacaggggtac

SEQ ID NO: 730697 - DNA, 382 bp, Homo sapiens
  misc_feature (43)..(43): n is a, c, g, or t
  misc_feature (93)..(94): n is a, c, g, or t
  misc_feature (98)..(98): n is a, c, g, or t
  misc_feature (100)..(101): n is a, c, g, or t
  misc_feature (104)..(104): n is a, c, g, or t
  misc_feature (107)..(107): n is a, c, g, or t
tcgtaatgtatacagacatatataccacgttctagtataaatntttcaaaaaatacaataataatataatttataaagaacactcttctatgnncaancnncancancaaaaaaaaaaagccctcagaaaatttctcacaaataagggcaactaaggccggatatctcaaaatcctttacaaaagggagatagttctagtcaaggagtttggggtatgttacttttttttcttctttttcttttcatctgcctccatcttaagtgcaatttcttcagcggtaagagctcccagtttcttattctgggctttcttaaccttttcctggaggcgggacggaggggtacggagctcggaaatccggtaaatctatgggtctataa

SEQ ID NO: 730698 - DNA, 878 bp, Homo sapiens
  misc_feature (43)..(43): n is a, c, g, or t
  misc_feature (93)..(94): n is a, c, g, or t
  misc_feature (98)..(98): n is a, c, g, or t
  misc_feature (100)..(101): n is a, c, g, or t
  misc_feature (104)..(104): n is a, c, g, or t
  misc_feature (107)..(107): n is a, c, g, or t
  misc_feature (421)..(421): n is a, c, g, or t
  misc_feature (431)..(431): n is a, c, g, or t
  misc_feature (434)..(434): n is a, c, g, or t
  misc_feature (437)..(437): n is a, c, g, or t
  misc_feature (444)..(444): n is a, c, g, or t
  misc_feature (447)..(447): n is a, c, g, or t
  misc_feature (462)..(462): n is a, c, g, or t
  misc_feature (482)..(482): n is a, c, g, or t
  misc_feature (485)..(485): n is a, c, g, or t
  misc_feature (487)..(487): n is a, c, g, or t
  misc_feature (515)..(515): n is a, c, g, or t
  misc_feature (525)..(525): n is a, c, g, or t
  misc_feature (584)..(584): n is a, c, g, or t
  misc_feature (598)..(598): n is a, c, g, or t
  misc_feature (678)..(678): n is a, c, g, or t
  misc_feature (872)..(872): n is a, c, g, or t
tcgtaatgtatacagacatatataccacgttctagtataaatntttcaaaaaatacaataataatataatttataaagaacactcttctatgnncaancnncancancaaaaaaaaaaagccctcagaaaatttctcacaaataagggcaactaaggccggatatctcaaaatcctttacaaaagggagatagttctagtcaaggagtttggggtatgttacttttttttcttctttttcttttcatctgcctccatcttaagtgcaatttcttcagcggtaagagctcccagtttcttattctgggctttcttaaccttttccttgatgctggccacatcaattttagtttcagtagaagcttccttaggtttcacaattggtttttccttagggggaataaatgctttgtttctttccncttgtctctnacnganggcttcngcntgtttagcctttatngcttccattttcggccgccnctncngatttgccttcaaaaaggattcaccacnagccaattcnttatcgatcggactgccggggtgggggggggggaagggcggagatgcggccggaacagngtggggcggggggnccgggcggggaggcacatgggggtgtctgaacggtggcaaaaatcgcgcccaactttgtgatcgtaattcagaatctttngccaactctctcttaatcattaagcttttaatgttataaattggatgaatattcttcatagtatcaaggactacttttctaacctcttttaagccactaaaaggtccaatggctgaaactgtgtttccctgaaccataatgtaacaattagttaagagttccaatgccttcaatgtagaacctttgggaccaanaagccg

SEQ ID NO: 730699 - DNA, 293 bp, Homo sapiens
  misc_feature (164)..(165): n is a, c, g, or t
  misc_feature (210)..(210): n is a, c, g, or t
  misc_feature (221)..(222): n is a, c, g, or t
tagaggatcccgtcgtcagcatcagggagctgtcatcatcatcttctgccatctccttggcaaactccaagtcctgctgttctcgctcacgccgttcctctgcagactccaagtccttgttgtacgatttgggaggaaacctcatggccttgacagacatgttnntggatatctaggcagaaggagatgcgctgtgtggaaggctagctnggggctctcgnngtggaatagatgtcaatcatcgtccttgtgattggacatagcccgttctctgtggttgattgctggacgac

SEQ ID NO: 730700 - DNA, 852 bp, Homo sapiens
tgcgcagctgcagcggcggttgaggtcaagtagtagcgttgggctgcggcagcggaggagctcaacatgcgtgagtgtatctctatccacgtggggcaggcaggagtccagatcggcaatgcctgctgggaactgtactgcctggaacatggaattcagcccgatggtcagatgccaagtgataaaaccattggtggtggggacgactccttcaacacgttcttcagtgagactggagctggcaagcacgtgcccagagcagtgtttgtggacctggagcccactgtggtcgatgaagtgcgcacaggaacctataggcagctcttccacccagagcagctgatcaccgggaaggaagatgcggccaataattacgccagaggccattacaccatcggcaaggagatcgtcgacctggtcctggaccggatccgcaaactggcggatctgtgcacgggactgcagggcttcctcatcttccacagttttgggggtggcactggctctgggttcgcatctctgctcatggagcggctctcagtggattacggcaagaagtccaagctagaatttgccatttacccagccccccaggtctccacggccgtggtggagccctacaactccatcctgaccaccacacgacctggaacattctgactgtgccttcatggtcgacaatgaagccatctatgacatatgtcggcgcaacctggacatcgagcgtcccacgtacaccaacctcaatcgcctgattgggcagatcgtgtcctccatcacggcctccctgcgatttgacggggcccgaatgtggacttgacggaattccagaccaacctagtgccgtacccc

SEQ ID NO: 730701 - DNA, 348 bp, Homo sapiens
  misc_feature (204)..(204): n is a, c, g, or t
  misc_feature (265)..(265): n is a, c, g, or t
  misc_feature (317)..(317): n is a, c, g, or t
ggagaagacaagtgaaggtcaagatgaagaaccatttgcttttctggggagtcctggcggtttttattaaggctgttcatgtgaaagcccaagaaggtgaaaggattgttcttgttgacaacaaatgtaagtgtgccccgattacttccaggatcatccgttcttccgaagatcctaatgaggacatgtggagagaaacatacncaattattgttcctctgtaacaacagggagaatatctctgatcccacctcaccatttaganccagattttgtgtaccatttgtcttaccctgtaaaaaatgttatcctacagnaggggggctggagtatcagaagtttctgtta

SEQ ID NO: 730702 - DNA, 1290 bp, Homo sapiens
  misc_feature (204)..(204): n is a, c, g, or t
  misc_feature (646)..(646): n is a, c, g, or t
  misc_feature (688)..(688): n is a, c, g, or t
  misc_feature (739)..(739): n is a, c, g, or t
  misc_feature (742)..(742): n is a, c, g, or t
  misc_feature (746)..(746): n is a, c, g, or t
  misc_feature (768)..(768): n is a, c, g, or t
  misc_feature (814)..(814): n is a, c, g, or t
  misc_feature (835)..(835): n is a, c, g, or t
  misc_feature (855)..(855): n is a, c, g, or t
  misc_feature (857)..(857): n is a, c, g, or t
  misc_feature (882)..(882): n is a, c, g, or t
  misc_feature (886)..(886): n is a, c, g, or t
ggagaagacaagtgaaggtcaagatgaagaaccatttgcttttctggggagtcctggcggtttttattaaggctgttcatgtgaaagcccaagaaggtgaaaggattgttcttgttgacaacaaatgtaagtgtgccccgattacttccaggatcatccgttcttccgaagatcctaatgaggacatgtggagagaaacatacncaattattgttcctctgtaacaacagggagaatatctctgatcccaacttaaccattggaaaaccgaattggggtacactttggcttgtgactctcgggtaaaaaatgtgttgatccatacgagaagtggagcgtggtataatcagatagttactgatacccagagcaatatctgtgatgaagacagttgctacagagacctgctacacttatgacagaaacaagtgctacacagctgtggtcccactcgtatatggtggtgagaccaaaatggtggaaacagccttaaccccagatgcctgctatcctgactaatttaagtcattgctgactgcatagctctttttcttgagaggctctccattttgattcagaaagttagcatatttattaccaatgaatttgaaaccaggctttttttttttttgggggtgatgtaaanccaattccctgccaccaaattatttaaaatagtcccttggtnatcttaataaggataactcacttcttaattatttgtccatactctaagttntcnaaantcttccaatttatcagtgctcncctgaaagaggtatgcctcttagagaatacagtttctagctttaancaattaaccagggggagaaantaaacctcagggagtgaaanantcaggaggtgtaataaattgttccntcgntttcccccccgttttttttttttttttgggatttgcccttggaaaaacccaaagttcccgatttttctaaacattctccttttaaacaacacgtgttccccttggcgtgacagacgcctttttgtgtcttaccacttggggcaatttttgtttgctcccttaagaaaaattatttcgtgggagacctggtttcccaaccctttcttccacaatactctcgcgggggaagctccatatttttaaaggttgacaaaatatgggcttatcaacatttgcggcctatcccgttggcgccgtaatacacactttttatcaaaaccgcgtgggacaactgcttgaccacaccttgccgcctagatttgttacggcgttccgacacggcaaattgccaaaaaaaaatggcc

SEQ ID NO: 730703 - DNA, 588 bp, Homo sapiens
ggctgatgccattttcagcctcagcacgcctgcacccaggcgctcattaaaacagcatgttgctccccactgcctcgtgtgtctgtggcgcgctgtcggggttcgaaccgatacaagaaccttccacctacctggtgctttggcctcatctataagcttttccactgtcctgaaacaagatagagaatctgagcggccagtcatctgccctaagtgctgccgccgaagactgaatgtcctggaaagtttgctgtcacatctccattatgacaaaagcattgtgccgaacagatgaaaaaatgcattgtcaacggaatcttttatgtttgttgtcttcctttaagcaacattgccttacttgttataaaagataaataaatatttgttcatttcaaaaaaaaaaaaaaaaaaaaaaaaaaaaaacaatggcgccgccactgggaccccagaacaacgtcctaaacacacaactggggagggcacccgggcgccaacaggggagataagcagcaacgtgggcacaaacagtgaaccaaagagaacccgggccaaaacaaaaggagaaggggactcaccacaaataaaacg

SEQ ID NO: 730704 - DNA, 1160 bp, Homo sapiens
  misc_feature (7)..(7): n is a, c, g, or t
  misc_feature (21)..(21): n is a, c, g, or t
  misc_feature (37)..(37): n is a, c, g, or t
  misc_feature (56)..(56): n is a, c, g, or t
  misc_feature (62)..(62): n is a, c, g, or t
gggcgangtcggggccatggngctgggcccggtcttnctcttctggctggcatctncccttntgcacctccgggagctgtgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatgggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgag

SEQ ID NO: 730705 - DNA, 126 bp, Homo sapiens
ggtacggcttccggtggcgggacgcggggccgcgcacgcgggaaaagcttccccggtgtccccccatcctctggcggcggtttagagcagttccgtgttctgagggagcgaaaatccggggcgaat

SEQ ID NO: 730706 - DNA, 119 bp, Homo sapiens
ggaaacgcgccgcagagggtgcggcccagaggaggccgcgggccgggaagggccgggcgggacgggaaacgttagggcagcggcccccggggtgagggggccgagcggacgggcagggc

SEQ ID NO: 730707 - DNA, 1070 bp, Homo sapiens
  misc_feature (33)..(33): n is a, c, g, or t
  misc_feature (45)..(45): n is a, c, g, or t
  misc_feature (65)..(65): n is a, c, g, or t
  misc_feature (70)..(71): n is a, c, g, or t
  misc_feature (77)..(77): n is a, c, g, or t
  misc_feature (107)..(107): n is a, c, g, or t
  misc_feature (113)..(113): n is a, c, g, or t
  misc_feature (122)..(122): n is a, c, g, or t
  misc_feature (137)..(137): n is a, c, g, or t
  misc_feature (144)..(144): n is a, c, g, or t
  misc_feature (150)..(151): n is a, c, g, or t
  misc_feature (166)..(167): n is a, c, g, or t
  misc_feature (171)..(171): n is a, c, g, or t
  misc_feature (181)..(181): n is a, c, g, or t
  misc_feature (185)..(185): n is a, c, g, or t
  misc_feature (187)..(187): n is a, c, g, or t
  misc_feature (193)..(193): n is a, c, g, or t
  misc_feature (196)..(196): n is a, c, g, or t
  misc_feature (200)..(201): n is a, c, g, or t
  misc_feature (204)..(204): n is a, c, g, or t
  misc_feature (213)..(213): n is a, c, g, or t
  misc_feature (221)..(221): n is a, c, g, or t
  misc_feature (223)..(223): n is a, c, g, or t
  misc_feature (226)..(226): n is a, c, g, or t
  misc_feature (241)..(241): n is a, c, g, or t
  misc_feature (247)..(247): n is a, c, g, or t
  misc_feature (252)..(252): n is a, c, g, or t
  misc_feature (262)..(262): n is a, c, g, or t
  misc_feature (268)..(268): n is a, c, g, or t
  misc_feature (271)..(271): n is a, c, g, or t
  misc_feature (279)..(279): n is a, c, g, or t
  misc_feature (286)..(286): n is a, c, g, or t
  misc_feature (317)..(317): n is a, c, g, or t
  misc_feature (320)..(320): n is a, c, g, or t
  misc_feature (323)..(323): n is a, c, g, or t
  misc_feature (338)..(338): n is a, c, g, or t
  misc_feature (352)..(352): n is a, c, g, or t
  misc_feature (383)..(383): n is a, c, g, or t
  misc_feature (389)..(390): n is a, c, g, or t
  misc_feature (393)..(393): n is a, c, g, or t
  misc_feature (397)..(397): n is a, c, g, or t
  misc_feature (403)..(403): n is a, c, g, or t
  misc_feature (408)..(408): n is a, c, g, or t
  misc_feature (453)..(453): n is a, c, g, or t
gagctgagaggggaagccggaaagaggcaagtncctggtgcaaangtggctctgcagcataattnaggcnntggagnagctgtggttgtaacactctacaagatggntttccnggaagccgncagttcttttagaantcatcanattganngctgttccaaccagnnctgnaaggtgatgnattnanggcaantcntgtnntanagggagatngagaagananttngacgaggaaggggancagttngtgangaaaatggtnggtatnttngccttcanggtgaangatggccctgggggtaaagaggccacctggntgntgnatgtgaagaatggcnaaggatcagtgctncctaagtcagataagaaggctgactgcaaantcacannggntgantcaganttccntggtttaatgactggtaaaatgaatcctcagtcggcttctttcanggcaaattgaaaatcactggcaacatgggtctcgctatgaagttacaaaatcttcagcttcagccaggcaacgctaagctctgaagaactccctttgctactttgtgaaaatcaagatgagatatatagatatatatccatacattttattgtcagaatttagactgaaactacacattggcaatagcgtgggataagattgttcctaatgggtgtgaccaatcctgtgtttcctaatgctctgggtgaatagagcctggatggtatactaactgcttgtgggggaatgtgcatacaatgtgtgcattacaaagttaatatgggtacattatggtccggggtaacacatcggagtttcagaataaaattaggaacagtaaaatccaaagaattatgtaaacaaaaaagcttggttgagcttacaaagtcatattcaaggattattctgctgaagattcagtcttaagagttttcctgtgggagaactaagtacagaaacacaatgccaacagctggccagtaattaggtgttgtgcacttcatggtcattaatccactttctcaatagttcttaaaatcagtgaagattaaaaactctaaaaatttctgcatttcct

SEQ ID NO: 730708 - DNA, 612 bp, Homo sapiens
  misc_feature (537)..(537): n is a, c, g, or t
ggcttggtctcttgctccagcgagagctcgaggttagctcttcactgccctgtgtcttctttccaagggtctcggtgattcggccacagcctcagcctccatcacgcggtgaactgatggtgctggaagattcatagactccaggacattcctgaagccgagaaaaggttaagtagggtctggcctggaatactctcctagatgaagatagcccaaccatgagccaccttcgaagcagatgagatgaaattaaagctcttcaactcctaaaggcccagagactatcacaaaagaggtcagaaatcctgaaggtcactttctgacaaactcaggaaccccaggtttatcttggagcctcaagaggagataaattcacccaactcaggctggagtgcagtggaatgatcttggctcacttccgtctccgccttccagtttcaagtgattctcctgcctcagcctactgagtagttgggattacaggtgcctgccaccacacccagctaattttgtatttttagtaaagatggggtttcnccatgttggccaggctggtctcaaactcctgacgtcatgatctgcccgcttcagtctcccaaagtgtgattacag

SEQ ID NO: 730709 - DNA, 579 bp, Homo sapiens
  misc_feature (558)..(558): n is a, c, g, or t
ggcttggtctcttgctccagcgagagctcgaggttagctcttcactgccctgtgtcttctttccaagggtctcggtgattcggccacagcctcagcctccatcacgcggtgaactgatggtgctggaagattcatagactccaggacattcctgaagccgagaaaaggttaagtagggtctggcctggaatactctcctagatgaagatagcccaaccatgagccaccttcgaagcagatgagatgaaattaaagctcttcaactcctaaaggcccagagactatcacaaaagaggtcagaaatcctgaaggtcactttctgacaaactcaggaaccccaggtttatcttggagcctcaagaggagataaattcacccaactcagagttttgctcttggtgcccaggctggagtgcagtggaatgatcttggctcacttccgtctccgccttccagtttcaagtgattctcctgcctcagcctactgagtagttgggattacaggtgcctgccaccacacccagctaattttgtatttttagtaaagatggggtttcnccatgttggccaggctggtct

SEQ ID NO: 730710 - DNA, 1564 bp, Homo sapiens
gcacttgattggccacagcttgggagcacacctggctggggaagctgggtcaaggataccaggccttggaagaataactgggttggacccagctgggccatttttccacaacactccaaaggaagtcaggctagacccctcggatgccaactttgttgacgttattcatacaaatgcagctcgcatcctctttgagcttggtgttggaaccattgatgcttgtggtcatcttgacttttacccaaatggagggaagcacatgccaggatgtgaagacttaattacacctttactgaaatttaacttcaatgcttacaaaaaagaaatggcttccttctttgactgtaaccatgcccgaagttatcaattttatgctgaaagcattcttaatcctgatgcatttattgcttatccttgtagatcctacacatcttttaaagcaggaaattgcttcttttgttccaaagaaggttgcccaacaatgggtcattttgctgatagatttcacttcaaaaatatgaagactaatggatcacattattttttaaacacagggtccctttccccatttgcccgttggaggcacaaattgtctgttaaactcagtggaagcgaagtcactcaaggaactgtctttcttcgtgtaggcggggcaattgggaaaactggggagtttgccattgtcagtggaaaacttgagccaggcatgacttacacaaaattaatcgatgcagatgttaacgttggaaacattacaagtgttcagttcatctggaaaaaacatttgtttgaagattctcagaataagttgggagcagaaatggtgataaatacatctgggaaatatggatataaatctaccttctgtagccaagacattatgggacctaatattctccagaacctgaaaccatgctaatctcagatacagtcttgatggatttctttagtaggagcaatgaagaaaagtgtctccttccacctggcatccagaccaaatttgacccttgtaaatgacttagtcatttacaagggtcttactcagagtcaagtacgggtttgctttttttctgtgtagaatgttcatctaactgcaccttaaaaacacactgaaccctgggacaaaagataattactatgatctgtaggaatctggatatcattgacaaaatagagctgttttggaattttcctgaataagaggaggtgatgcaaatgtatgttgagtgtataaactcactggacaaaagtaagcctctggcttgctgagtttttgaagtatattttcaggtataataatcattgttctaaaattatataaaactatttgttatgttgttaaatcttgctgagacaaattatgactatagtgcatgatatatagtagattataaccttgtgggttgatgtgtctatctagtaataataaaaactaatgagatggcactagtatttccaaggtgttccttggtgttcagggtgtgcacaagagagattttggagcttatctgttatgtgttcatcagttagcaatgggacctgaagttcaacaacccagggtata

SEQ ID NO: 730711 - DNA, 867 bp, Homo sapiens
  misc_feature (191)..(191): n is a, c, g, or t
  misc_feature (212)..(212): n is a, c, g, or t
  misc_feature (217)..(217): n is a, c, g, or t
  misc_feature (243)..(243): n is a, c, g, or t
  misc_feature (247)..(247): n is a, c, g, or t
  misc_feature (276)..(276): n is a, c, g, or t
  misc_feature (284)..(284): n is a, c, g, or t
  misc_feature (293)..(293): n is a, c, g, or t
  misc_feature (298)..(298): n is a, c, g, or t
  misc_feature (300)..(300): n is a, c, g, or t
  misc_feature (343)..(343): n is a, c, g, or t
  misc_feature (408)..(408): n is a, c, g, or t
gagtcttcatacacgcggccagccagcagacagaggactctcattaaggaaggtgtcctgtgccctgaccctacaagatgccaagagaagatgctcacttcatctatggttaccccaagaaggggcacggccactcttacaccacggctgaagaggccgctgggatcggcatcctgacagtgatcctgggnagtcttactgctcatcggctngtggntattgtagaagacgaaaatggatacnaagngcctgtgactgggataacaaagttcttcnatgtgtgngcactcaangtgtngnccttaacaagaagatgcccacaagaagggtaggatcatcgggncacagcaaaagtgtctcttcaagagaaaaacgtgtgaacctgtggttcccaatggctccacctgntgcttactgagaaactctctgcagaacagtcaccacaccttattcaccttaagagccagcgagacacctgagacatgctgaacattatttctctcacacttttggcttgcacatttaatacagacattctaatgttctccttgtggaatggtgtaggaaaaaattgcaagccatctctaataattaagttcagtgttaaacaatttagtaaggtcacgctaagagtactaatcatgtgaggactgatgagaaattattacattgggaaaatccatcattaatgttgccatgcttataaaaaaaaataaagataagaacaaagtaaaaatataaagagaaaaagtaaaaaaagagaaaagaaattaaagcaaacaaagaaaaaaaaaaaagtgaagagagacaaacaaaagaagagatgaaaaaaaaaaaataagagaaaaacagaagaaaagacgaaaa

SEQ ID NO: 730712 - DNA, 449 bp, Homo sapiens; identical to SEQ ID NO: 73459

SEQ ID NO: 730713 - DNA, 487 bp, Homo sapiens; identical to SEQ ID NO: 73461
  misc_feature (319)..(319): n is a, c, g, or t

SEQ ID NO: 730714 - DNA, 514 bp, Homo sapiens
  misc_feature (346)..(346): n is a, c, g, or t
ggagctattgtggctccggccggttgcgcgggccctcggaccctcagagaggcgagggttcgagggcacgagttcgaggccaacctggtccacatgggtcgaaaaaaaaatggtcccaactatgggcgtgtgaaaacaaaaaaaaaaaaaaaaaaaaaaaaaacaatttgtgtggggcgcggcttggggccttggaaaaaagttttttaagaaccatatcgcgtgtgtggggcggcgggggccccagtgtgggtgtaagtgtggacattggggccataacgcgggggtccaagagggagaacccggggcaaggagccaaggggcggggggttctctctcacccaanttaaaaaagcgcgccgggggggagaaacccggaggcggttcctgtggaaaaaatttcccaggtgtgggggttcacgagggggggaaattaaggggggatttatttacaacaggggggttcaaaggggagggtctgagatttaaaatttagggcccgggtcggggggga

SEQ ID NO: 730715 - DNA, 798 bp, Homo sapiens
gccaggcatcctccgcggcgggccggaccgggccggcggaggggagcggaagcccaccggggctggcccgccgctgacccgccgcctccgtctgcctcctcccgggctctgggcccagcgcgcccagatgccgggcaggacccctccgcccgctgctggaacaccaatagcagcgttggagcctctgggccggaggaactggggcctccaccgacacctgcttcttccctcacctcgcagccttccacacctgttgatctgacctctgccccgctgccgcccaggagtaacctaaggcttttggcctgattcgagctcactccgtctaaacctctaaatgcggtgcgaaaaaatcctggggaatgtgccatgcaaagcctgggcatttcaagtgcttttctggattcgcatcaactcctatttacaggcatctttatccggaattcagctcgtcccaaaccccacgtggtgtagctctgcttgtgtttttgaatcccggggcctctttgaatcagaagccctttgtatagagataagtatcctttaggccagaatcagcctccatttttttcgcagtcccatttcctacccgtaatactttcttctgattttaaagccatttgatagagaagggacagggaacagaaccttcgccccccgcctgagcagctggtagactagatatcttccaaacattatctcatttacttccctggagttacaaataggtagatttcatgtccggtgaggggtgggaaaagctgaactttgggactaagaatcctggccgaggtcagc

SEQ ID NO: 730716 - DNA, 370 bp, Homo sapiens
tcgtggtgaatgtgaacatcgacgaaaaaggcaggtcagatttccttgatcaccaaggactggggctgccttgttcaaagcccaactcaggtcccacacatcctagaaacaagcacctgcggcccagcggcttccctcacatcagcctgtcagagctggctcgagctcactggctcactgcagctccagaacttccccgagccccgctcccatgctgctctataggttcacactgcaccctgcagggccagaaaggatgtcgccagcccaatgtgggagatgatggcctggctttactaaaaaactgtgtgatcaaaatcccaactataggaaagacgtaactgagaacgactgggccccatgttctggg

SEQ ID NO: 730717 - DNA, 361 bp, Homo sapiens
tcccgttggccccgctgagcaatactcccagcctcttgcgtggcacccacgtggagtaactgagcaaccggtttattgttaaagctccgattgctgactggttggtgaaaacgaaattgcagttaaaaagaaaattattcatttctgctctccacaccagctcgtcaggaatcagtgacacgggctgactcataagaaaacagtagtaataaaatcgtgtgcgggtagtgactggtgctggtttaggctaagggatcccccctgagggttgcccagtagtgagagagcggagcttggctgcagattcagtcctgtgttacagtgattcgcgaatgggtacacagctcgattcgtatatgta

SEQ ID NO: 730718 - DNA, 528 bp, Homo sapiens
ggctatagacaccctcccttcatcgctcaggggtgtagacaccctctctccatcgctcaggggtgtagataccctctctccatcgctcaggggtgtagacaccctctctccatcgctcaggggtgtggacaccctctctccatcgctcaggggtgtagacaccctcccttcatcgctcaggggtgtggacaccctctctatcgttcggggtgtagacatcctctctccatcgctcaggggtgtagacaccccctctccatcgctcaggggtgtagacaccctctctccatcgctcaggggtgcagacaccccatctccatcacttagggggtggaaacctctctctatcactcagcaggtgtagataccctctctccatcgctcaggggtgcagacaccccatctccatcacttagggggtggaaacctctctctatcgctcagcaggtgtaggcacccccctccatcgctcaggggtgtagacaccctctctccatcactcaggggtgcagacaccccatctccatc

SEQ ID NO: 730719 - DNA, 1521 bp, Homo sapiens
  misc_feature (1084)..(1084): n is a, c, g, or t
  misc_feature (1091)..(1091): n is a, c, g, or t
  misc_feature (1094)..(1094): n is a, c, g, or t
  misc_feature (1128)..(1128): n is a, c, g, or t
  misc_feature (1179)..(1179): n is a, c, g, or t
  misc_feature (1182)..(1182): n is a, c, g, or t
  misc_feature (1197)..(1197): n is a, c, g, or t
aggagaaaggcgagacgacgcgtggaggacgtgggggggcactctagtattattgcggctctgcgataaatctcgcgtgcacaacgctgatatgttattgtcatacagctcgttcagctcatgacaatcagaggtgttctactacgtcagtgattgctgggcgtacgctggtgactcctccgaggtttgcgcttcacgagggtcgtatgaagtacgcgccgagacgtggtatgtacgtcgccgtaccaagagaataagggtgagacgcgtccacgctagcagcaccaataggggtacgacacctgagccaagaagagcatatgaaatatagtactattaggtatatattaattgagagtagggatagtcccgtgagtgtcgtgcctaagagcttagacctttggaagcgtccctgtgggtcttcaaaggcgagtactaacccaaccttcagggccttccctggttggttcgctggggaattttatggacatttggtgtaagccaaccaatggcccaggttcaagagggttgaactccttagatttgagccctgactcaggtctaaagagtggtgttgtgtggacagtcgcgtgccacctggggcagtcacctgcccagatcccagaaggacctcctgagcgatgactcaagtgtctcagtccacctgagctgccatccagggatgccatctgtgggcacgctgtgggcaggagggagcttgattctcagcacttgggggatctgttgtgtacgtggagagggatgaggtgctgggagggatagaggggggctgcctggcccccagctgtgggtacagagaggtcaagcccaggaggactgccccgtgcagactggaggggacgctggtagagatggaggaggaggcaattggggatggcgctaggcatacaagtaaggggttgtgggtgaccagttgctacttggcctctggattgtgggaattaaggaagtgactcatcctcttgaagatgctgaaacaggagagaaaggggatgtatccatgggggcagggcatgactttgtcccatttctaaaggcctcttccttgctgtgtcataccagngcgcccnagnctctgagcccctgggactgctgcttcttagaccncagtaagccactgccacacgtctgaccctctccaacccatagttgaccggntgncttttccctaagccnagggcctcttgcggtcgcttcttactcgcacacaagatgtacccagtatctagggtagtgccctattgtacaatgtgtcacacttgagcgcacgagcaaaagtgaaaggcactgggtcatattccttgcagactggagggtcgggtggtccgggttgagaccgttcatcccaagttgcaccgattcttgttttgacttgagcaagactgttgagcaacatggtgggatctgggccagaaccgcgctggggggccactatcagggtaccatttcccttaaggcgcaaagggtctccctttccaaaatgggtgctcccgcaacctc

SEQ ID NO: 730720 - DNA, 1312 bp, Homo sapiens
  misc_feature (875)..(875): n is a, c, g, or t
  misc_feature (882)..(882): n is a, c, g, or t
  misc_feature (885)..(885): n is a, c, g, or t
  misc_feature (919)..(919): n is a, c, g, or t
  misc_feature (970)..(970): n is a, c, g, or t
  misc_feature (973)..(973): n is a, c, g, or t
  misc_feature (988)..(988): n is a, c, g, or t
ggcggggggcacctactacatcgccctccacatccctgattcctgttgttatggaaactgttgccagagatggaggttctctcggagttatctgggaactgtgccttttgagtttcctcaggctgctggaggaaaactgagactcagacaggaaagggaaggccccacagacaaggtagccctggccagaggcttgttttgtcttttggtttttatgaggtgggatatccctatgctgcctaggctgaccttgaactcctgggctcaagcagtctacccacctcagcctcctgtgtagctgggattatagattggagccaccatgccaagctcagaggattgttctcctaatgacctgatcagtctaagatgggtgggagtctgccacctggggcagtcacctgcccagatcccagaaggacctcctgagcgatgactcaagtgtctcagtccacctgagctgccatccagggatgccatctgtgggcacgctgtgggcaggagggagcttgattctcagcacttgggggatctgttgtgtacgtggagagggatgaggtgctgggagggatagaggggggctgcctggcccccagctgtgggtacagagaggtcaagcccaggaggactgccccgtgcagactggaggggacgctggtagagatggaggaggaggcaattggggatggcgctaggcatacaagtaaggggttgtgggtgaccagttgctacttggcctctggattgtgggaattaaggaagtgactcatcctcttgaagatgctgaaacaggagagaaaggggatgtatccatgggggcagggcatgactttgtcccatttctaaaggcctcttccttgctgtgtcataccagngcgcccnagnctctgagcccctgggactgctgcttcttagaccncagtaagccactgccacacgtctgaccctctccaacccatagttgaccggntgncttttccctaagccnagggcctcttgcggtcgcttcttactcgcacacaagatgtacccagtatctagggtagtgccctattgtacaatgtgtcacacttgagcgcacgagcaaaagtgaaaggcactgggtcatattccttgcagactggagggtcgggtggtccgggttgagaccgttcatcccaagttgcaccgattcttgttttgacttgagcaagactgttgagcaacatggtgggatctgggccagaaccgcgctggggggccactatcagggtaccatttcccttaaggcgcaaagggtctccctttccaaaatgggtgctcccgcaacctc

SEQ ID NO: 730721 - DNA, 694 bp, Homo sapiens
ggcggggggcacctactacatcgccctccacatccctgattcctgttgttatggaaactgttgccagagatggaggttctctcggagttatctgggaactgtgccttttgagtttcctcaggctgctggaggaaaactgagactcagacaggaaagggaaggccccacagacaaggtagccctggccagaggcttgttttgtcttttggtttttatgaggtgggatatccctatgctgcctaggctgaccttgaactcctgggctcaagcagtctacccacctcagcctcctgtgtagctgggattatagattggagccaccatgccaagctcagaggattgttctcctaatgacctgatcagtctaagatgggtgggagtctgccacctggggcagtcacctgcccagatcccagaaggacctcctgagcgatgactcaagtgtctcagtccacctgagctgccatccagggatgccatctgtgggcacgctgtgggcaggagggagcttgattctcagcacttgggggatctgttgtgtacgtggagagggatgagggagtgccggtagctgtgagcagcactccttcatgctcctcacagctaccgccactccctcatagctgtctcctcaagtgtcagctcagccgcctcgtgcctataccttttccagtacaggccactgcttgcaggc

SEQ ID NO: 730722 - DNA, 567 bp, Homo sapiens; identical to SEQ ID NO: 338777

SEQ ID NO: 730723 - DNA, 654 bp, Homo sapiens
ggttatttagcagactaccctgtggtttgaggtaatttcccccaggagggccaatggggactttgaagtatttatgcctctttaaaaacttaagtatccttaaaacagggagggacaataaatgcagcagacaccaagacattatggtccatagaaaggttaagcctggatggaaactagtaaagttgttaaccaacgaccacactagaaatggagtctgagtcattgaacttgacgggtggattcttggatcaagaattttggggagggaaggctatgtcccaaattcactgcaacttcattattgtggcttgtgagggtctgcaaaagtgactgaatctttgtcactggacctctttcacattaatgtccctgtgggaaagaccaagtctttctttagaactcgtgcaatgtcactgccaggtgcttgtaatagtccatggcaggcatcaagagtagaaacttggctagacacagtggctcacacctgtaataccagcactttggaaggctgaggtggccagagatcaagaccagcctgaccaacacgcgaaaccccatctctacaaaaaacacaaaaaaattagccaggtgtggtgtcgagtgctactcacgaggctgaggcaggagaaccacttgaacctgagagcaggg

SEQ ID NO: 730724 - DNA, 497 bp, Homo sapiens
tctgacccacaggagacaaaaataactcagatgcccgggagtactttgagaataatatcacacttgtcaaagtgggtctaatgatgtcagtcatctttttctaccttgcatttcttcattgcagcttacactgacaaatgataccattcctatgtccacagttttctttgattaaaaacccacagagaccacaatactaatatgaccactaaggctgaggcttgaacgaaggttttattctccagaatctgttcaataaaccaatttgatttttataacaaaaaatgtgatacataatttgctcccccattcagtagagattctggacaatggcatcacagaatattggagctagaaagaaacttaaagattactttcatgttattttactgatgagaaaacagatgcccaaagaggaaaaataataactttaaggtcaaaggcaccctgtgggagaggaaaagtaatcaggatggctaacaggccctgtggaaaag

SEQ ID NO: 730725 - DNA, 711 bp, Homo sapiens
cttagcagattccacagggagagggaggtgtcgttagtcatctccacagcaatattccaggaccattaagtttttagaagaaataaagtgtgacccaacaatattatatacagccaagatacagttcaaaaattaaggcaaaaggaaatgttctccattatgaaagaaatcagagaacacaagtcctaagaacttattattgaaaaaagtgaataaaattcagccaatttaagaggaacaatgaacttactggaatagctgtggtaaaaagactaatagtgagcagctaacgaatttaaatacaaaacaaatgcctacacaactatgaggattatgtttacataagagaatgtcactacctgaaaaaatagaaatgtcttcaaaaacaaacaaccctgtcagggcgcggtggctcacacctgtaaccccagcactttggaattttctagctgttctcctcattcttaagaggtattcccttcctgcctttagatgctcaagtgttagaccatgatcctcagaacaactgcagtgtcctggcaaccatgactgcaaaagccaaaaaaatcacatgaaagtcaacaatgctctgccacagctgaattggctactgttaaattaaccaatcttagaaaagcctagcatctgatcttacatgaagtaataaatttccaattgcttcagccactctgatttgcctgtggaaagtag

SEQ ID NO: 730726 - DNA, 519 bp, Homo sapiens
tgcttttccacagggttcttgagttgttgtgaacttattgtttagctagtagctagtttaaccaggattaaacaagtttaatcaggattcttcatggatgtactttttagctaactacagtttttcacatggaaatgaaacttacagtaaacacttaacgtaccacagaatttttttctggatttctggtcctgaagcatgaagtgtactagaaaccaattcttcctgcgctacttgtggaatctttcttactggatcataatcttactttactttatacaatagatgcttaatcagtgcctttaataggaagttagaaactcccaatccaatcaacaaggctttgattctacctcctaagtactacccagatcacagacaatccaaatatcagaactagggggctgggcagagaggacaaatcatctattagggagtgggacagaaagtggaaacattacaaaggagcaagtaggctcagaacagaggggagagtaatactgaccctctctactgagg

SEQ ID NO: 730727 - DNA, 515 bp, Homo sapiens
tactgtatcacagggataagtcatgagtccagttagtgtaaaatactcgtcatgggagtaggattatgggtttataaaggcaagagtaacctgaacatttataagtaaacatattcaaagatattctggcctattttaattccaaattaggcatgtttcacaaactttttaacaaatttttaagtagtcataaaatttcacttcccagttcttatcactttttaattttaatttctttggattaatgtcatcattaaaataggaatacatattggatttttctgactaaaaacctttaaaagaattttttacagaattactgtaagacacaatttctagactctattttataaaattttgctgatttaatcagtgattatgaaattaaagtgacaaaaataagcattacattttactgtattatagtagcaccagtcaaaatttttttttttttaagtggccttatggagacattggcagcatcagccctgtggaaaagtaaggaacggagttca

SEQ ID NO: 730728 - DNA, 562 bp, Homo sapiens
tctctttccacaggccaaggcaagagagaagaaacttcacctaggtgctgagcctagtgatatgttacaaagcttcctattgacagaaccccccccccccaccaaaaaagactcacatcacctgggtgcagtacccagttatgtgtcacaatgcaccataagtgcagggccaaggcaatagaaggaagtcacatcacttacatgatgaatctagataaaagccgcaatgctctgtaggcagagttcaggccaagatttcacatcagctgggtgctggtcccagtgatatgtaaaagtgccctttgtcgcactgccaaagaaggtgttatacattgcttaggtgcttggtccccgtatgtcacaatttcaactgtgctctaggcctagaaaggagagtccaaacactcagatgctgggcaaagtcatacttcccaatcacacacttgaaaatgttcagaaaaaagtttcctagtgccacacaagtcctggcttcgggtatgagagtcaacacctcctatgagttgggtcgaagcacaggagtcacagtccctgtggaaagatc

SEQ ID NO: 730729 - DNA, 604 bp, Homo sapiens
catgatatgacaccgacagaattcaagttcatctggtacatggagtactcacaccgaatgtggggtcgccttgtaggccttgtgtacatcctgcctgctgcctacttttggagaaagggctggctcagccgtggcatgaaaggacgtgttcttgccctctgtggcctcgtctgcttccagggtctgttgggatggtatatggtgaaaaatggactagaagaaaaatcagactcccatgacatccctcgggtcagtcagtaccgccttgctgcccacctgggatcagccctggttctttattgtgccagcttgtggacctcactgtcactgctactccctccgcacaagttgcctgaaacccaccaactcctacagttgagacgatttgctcatggaacagcaggtctggtgttccttacggccctctcaggggcttttgtggcagggctagatgctgggcaaagtcatacttcccaatcacacacttgaaaatgttcagaaaaaagtttcctagtgccacacaagtcctggcttcgggtatgagagtcaacacctcctatgagttgggtcgaagcacaggagtcacagtccctgtggaaagatc

SEQ ID NO: 730730 - DNA, 665 bp, Homo sapiens
tgatcttccgtgcctcagagtgcagttcccaaggaggtttcaagacaaagggccccttacacggcagacagtcgcagcgccgtgttacgtttcatctccctgatggctcccaggaaagctgcagtgacagtggtctaggagaccatgagccggtgggtagtggaaccctgatctcacaccctcttcctctggttcagccacaggacgaattctatgaccaggcctctccggacaagaggactgaagcagatggcaactctgatcccaactctgatgggcctttgggtccccgaggattagctgaagctacagagatgtgcactcaagagtgcttggttttgggtcactctgataattgctggatgcctcctggcttgggtccatatcaacaccccaaatctcctctctcaacctttgcaccccagaaagaatgggtgaagaaggacaagcttgtgaatgggcacaccctgaccagagcctggaaagaagacagcaacaggaaccagttcaatgaccgtaagcagtatggctccaatgaaggccatttcaacaatggcagccacatgacagacattcctctggcaaatctgaagtcttataagcaagcaggaggtgctactgagagtcctaaggagcacaactctaagaaaaggctatatgggacc

SEQ ID NO: 730731 - DNA, 976 bp, Homo sapiens; identical to SEQ ID NO: 170953

SEQ ID NO: 730732 - DNA, 445 bp, Homo sapiens; identical to SEQ ID NO: 171339

SEQ ID NO: 730733 - DNA, 207 bp, Homo sapiens
cggaacctgacaaagttaaatggaagcctacacagctgagccgcatttccatgggagacattttggtcattccaggtgatgatgaactacaccaattgttagtggctgagaagaacctcaggaatgtgccagcatcttttgacttttattttggggggctgcatctactaccacaacatgcaatatggtaacactggcatggctggt

SEQ ID NO: 730734 - DNA, 813 bp, Homo sapiens; identical to SEQ ID NO: 728655

SEQ ID NO: 730735 - DNA, 1018 bp, Homo sapiens; identical to SEQ ID NO: 728656

SEQ ID NO: 730736 - DNA, 906 bp, Homo sapiens; identical to SEQ ID NO: 728657

SEQ ID NO: 730737 - DNA, 701 bp, Homo sapiens; identical to SEQ ID NO: 728658

SEQ ID NO: 730738 - DNA, 1055 bp, Homo sapiens; identical to SEQ ID NO: 176348

SEQ ID NO: 730739 - DNA, 301 bp, Homo sapiens; identical to SEQ ID NO: 176349

SEQ ID NO: 730740 - DNA, 481 bp, Homo sapiens; identical to SEQ ID NO: 728664

SEQ ID NO: 730741 - DNA, 608 bp, Homo sapiens; identical to SEQ ID NO: 392755

SEQ ID NO: 730742 - DNA, 516 bp, Homo sapiens
  misc_feature (365)..(365): n is a, c, g, or t
  misc_feature (416)..(416): n is a, c, g, or t
  misc_feature (479)..(479): n is a, c, g, or t
cagatgcgaccgaatgcgatatcaggagagaaggctggttgtattataagcagattctcaccaagaaggggaaggctgaggaccgggatgacatgctgggctggatcagagcgatccgggagaacagcagggccgagggcgaggaccccggctgtgccaaccaagctctgatcagcaagaagcttaatgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccntggggcatcaacatcatcaagaaaaataagaaggccgctccgagggcgttnagggtcaggctggaggagtgccagccagccacggagaaccagcgcgtccccttaatcgtggcngcatgctatcgcattcggtctgtaacctctaggtcag

SEQ ID NO: 730743 - DNA, 898 bp, Homo sapiens
tctgtgtggtgaggtactgacctgacaaaaatttccttaaatgtctgcagagaaaagagaaaatggtcatgtctcagtaaatctgtgatagatgctacagggaaagctgctcctgcccagaaggctgaaaccaaggaagtgtctgctccagaccagcccaaacacacaatcccaaattttggtaaaagttcctatcagccctgtgtacagccagctgtgccaagaacatagtatgctattcccaaagctgagttgggatgaggaatgagggatagtggctggtttgtactattcacttatgaatgatcaccagcgtctccctggattgctcctgtatttgttttaggtgtacagtcaggttctagagatccaaagtagttggtttcaatcattttttcccactcaatggttgcttgggtggaagtacttatacctagaacttcttgccacaccatttcgcctaaagtctctgtcttcatctgtattttttcttttttaaaaatttgttatttcatctgttttttttatgtcagatttacaaggatcttgtaactttaaaattataaaaataaatgttcggtattcttgtaatttatttttacattaaattttttattaaataatttttaaatttaagactttatcttgtattaacgtttatgtatgatgaggggtaggtggctccccaaatttttatttttatgttggaatttctttcggtgtgagacaagaattcaaagtaatatttctcagttgcttcccagttgttttatactacttttctgaaaaatttatataccctattgaaatttcattgtatactaaattccttgatatattgggtctgtttcagactttttttgtctgtttggtccgtcttttcttattccctacctca

SEQ ID NO: 730744 - DNA, 525 bp, Homo sapiens
cttcacagccaatcagcaacgaagccataattcatgtactttcattttatttctggcttaagttccctctttattttcactgttaggatccttattgcttctcatctaaaccatcaatagattcctaattaatgtcttgcctcttcatcccttcaattcatctatctaggccccttctgtctcataatactaaccatagtctgcctatttatcttttcaagcattctctcttgcaagtgattataagctctctgagaatggagaattagtcttggccatttttatactacctgtttcctgttttcaagtagccccgtccccttgctttgccagcagaatgtgatataaaacagacatttttattaataattttaaaagttgcattagtgaactgtatgaattatttacatggccagaaaggaagtagacaaacattgattaagcaaagacaaaataatctgttacgggaaaaatattctggaaaagtaagaggggtgatcctttgtgctgaaaagtctcatttcc

SEQ ID NO: 730745 - DNA, 278 bp, Homo sapiens
cctggggtttttcttttcccccgttccctggtaacgccttcttagactttttaaaaatggttctcaaaagtcacttgctcctgtgtaatgagcctagacgttggtagtaattgggctttttgatagcacatgtgtaggtgtaatggacattgtaacatacttctcacttaaaatgaaattctgtcataaacctgttttcaaaatttcagaagataaaggtattttgttggtagaatggtttgactcctttacgtactttctgtcccgatctacgaatt

SEQ ID NO: 730746 - DNA, 402 bp, Homo sapiens
tacatgatagaccgagctatacccattcgcgaatcacccaaatagcaaacactgggtgactgccgtgtctacagcactatgccaagcaaggaaggcattagaaagagccagttaaaggcagccacctgatccccatgcaactcttaaccttggaacaaaaatccttccttagtctcaagttcatccatcctaaaaggaaaaaggaggatccaatgagcactcggtttccttcggtttctatttttccagattcttgttagaccacagggtatcccgaaggagttttccatggcatgtcagcaaaatccaaataccactcttcagaaggtaatatacttaaaacagaaataaaacagtaaaattgcacccatatattcacaaaatttacactggaaattatgt

SEQ ID NO: 730747 - DNA, 979 bp, Homo sapiens
agcgggcggtgcacgacggctcccattggctggggctcgggcgtcctagccaatccggccgcggggtgcgtttctcctgacccgggtgggaccgcaccccgcggactcagaagcgagcggcaccccgggaccatcccacagcagatccagtggccgccaacgtcaggctggagttgcctccttcgtggatgttggatgtggaagcccaggagccccccaaggggaaatggtcgacgccgcccttcgacccgcgcttccccagccagaaccagatccgtaactgctaccagaacttcctggactaccaccgctgcctcaagaccaggacccgccgcgggaagagcacgcagccctgcgagtactatttccgcgtgtaccactcgctgtgccccatcagctgggtggagagctggaacgagcagatcaagaacgggattttcgccggcaaaatctgactgccccagcgcggcttcctctgaagatgcagtgatcctgcatctttttgtctcgcggagccccgggtctcggttatccacccctacctcccagtgtctaagccacgaataatgccaccagccttcgagttccttgtttcccttgctctggtctccacgtgtatgatggggttctcaggcccaggcttcgaccagaggaccctctgccaccaccgtttcttcctgtccttgagctaccttggtgaactcatgaccccaggcccctgctccaccaggatgtcccccaggtcctgccagctgggaagtgccagcatgaacgcctccaacttcgtggaagccaggtcccctgcagctgagggacgccaagcagacacacctgccctccccagccagctcctgtctgtatgggcgagatgactgagagcgcccacgtccctaaggctgtcctgaccctccatgctgcgacaaggacagggaatggtcggtcactatgggcctggtgtctcccctcccccaccacccgg

SEQ ID NO: 730748 - DNA, 406 bp, Homo sapiens
gtggagagctggaacgagcagatcaagaacgggattttcgccggcaaaatctgactgccccagcgcggcttcctctgaagatgcagtgatcctgcatctttttgtctcgcggagccccgggtctcggttatccacccctacctcccagtgtctaagccacgaataatgggtgaccctagacaagcttcttgacctgtgtgagcccgaggttccccaaggcaaaccaagatggctcagggccccattatcagaggaggacacaccctagatgagccatcccccaggatgacgccacctctgagatcttggtctcctggctccgtctctgaccacaacccaagaatggggtgagggcacagggtgtggactcaactacaggagggcttcctgttcatgcaacgtcccc

SEQ ID NO: 730749 - DNA, 293 bp, Homo sapiens
caagcaaggaagtggatgagctgggatgcaaccccaggttgtctggctggagagaaaaacacagagaaagatgccagaaatgaaaggtgggggctattttctcacagaacttaaaatgaattgaggagaggaggccaggggttcccaggtggccgcctgcccacagtgccacgggctggtaggcggttttcttcactagtccacaaataaacgagaaggaagactaggaaatatttaccaagtgaactgtgctggtagaggaaggacagtcttggtagcttgttttgcttttg

SEQ ID NO: 730750 - DNA, 674 bp, Homo sapiens
agcggacctgagactgtgggcaaaggtaccatgaagtgttgtggagaggagggtcaccaactccaggcagggctgctaagtttattacaaacaggcaagactagaatatgtttccactttagtgagtggaaacctaatcattcataggtatcctgtacacacagaacaactatgacgaagagtgaggcctaaatcagaggagacgaggacaataatagtagtagtggtcatgatgataataataactaccagacatgaagattaaccatgcctaacattgtgttaaacgtctcacttctttcatttaatccttacaataatccaatgatgtagctgctattatttttattatacagatgaagaaactgagggcttgaggggtatactgctttgccaaagtcgtacaaatggtaagtgcagaaccaggatctgaattccgtcagtctgactgcagagcccacgccgacaccgtggaagctggtgatgcccattaggccctgtctgggcatgaagaggatgccctccctcatgagctggaacacagcatcccctgttgtgggtgtggctctcttaaagaccatctggtgaattttgcttgtgctggtttcttattaaacaaccttcagatttggcttcacgtgcaactcacatagagggaaaggagaccatgatcc

SEQ ID NO: 730751 - DNA, 768 bp, Homo sapiens; identical to SEQ ID NO: 728666

SEQ ID NO: 730752 - DNA, 623 bp, Homo sapiens
gggaaggccgctgtttttccctcctggcactcagctgcctgccccccaacaataattcctcacctcccacgcacccagctcttggcagtttacaaagaccttttgcgtccccattacctcatgtgatccccacaacacccatgagaggaagatgaatcgtccgatccaagtgaagccagctgccagtgagggccgaggaggctcctgaacaggatgatctcagatcccccctcaaacaacagctggaactctgttctctatcttctagaggaccgaaagctgtttgtggggatgctgggcaagcagcagggtgaggaggacgtcagacgcctgttccagccctttggccacatcgaggagtgcacggtcctgcggagtcctgacggcaccagtaaaggctgtgcctttgtgaagttcgggagtcaaggggaagctcaggcggccatccggggtctgcacggcagccggaccatggcgggcgcctcgtccagcctcgtggtcaagctggcggacaccgaccgggagcgcgcgctgcggcggatgcagcagatggccggacacctgggacgccttccaccccgcgccactgccgctaggggcctgcggcgcctacaccacggcgg

SEQ ID NO: 730753 - DNA, 438 bp, Homo sapiens
ggagccattgtggctccggcggttgcgcgggccctcggaccctcagagaggcgagggttcgagggcacgagttcgaggccaacctggtccacatgggttgaaaaaaaaaaaaaaaaaaacaaaaaaaaaatttggggcggcctttgggccttaggaaagagcttttcaagaccccttcggtgtggggggcgcgcgcggcgcacgattggggttagagttaacacgtgtggcccagaagcgggttgccaaaggaaaaactcgtggcaaagaaacaaggctgcgggggattccctcacccaaacttaaaaaggcgcgcggggggaaaccgagagtgttcgtgaaacaaactccagaggggggtccggagaggacacaccgggagctctacccacgagggagcaccaggggaagcggaaattaaattaggcccgggctgga

SEQ ID NO: 730754 - DNA, 1092 bp, Homo sapiens; identical to SEQ ID NO: 125801

SEQ ID NO: 730755 - DNA, 671 bp, Homo sapiens
aaatgtaaacggtgactggatatttgcttatcttaaagaattactattcttaggtatcatcatggtagcgtgactacttaaaaaaaaaaagtcctggccgggctgtggtggctcacgcatgtaatcccccagcacttggggaggccgagatgggcagatcacccgaggttagggattccagaccagcctggccaacatggtgaaaccccatctctacaaaaaatacaaaaattagccaggcatggtggctcatgcctgtaatcccagctacttgggaggctgagacaagagaatcacttgaacccaggaggcagaggttgcagtgagcagagatcgtgccattgcactccagcctgggcgacaagagtgaaactatgtctcaaaaaaaaaaaaaagaggaaaaaaaaggtctttattttaaaagatttttcggggaaattttccctagggaaatttgctatcgggaaattggggtcacaggcgttttggtacaaaggaattggtgcagaatttttttggtttgcacaccactggttggaccattgaacgtgggtatatggctcgaaacatggaagtgaggagcacatgggattcttgaaaaaccactacacaccggttgggggggttttaaattttcctgtgaaaaaatgcttaacacaggtcggggccag

SEQ ID NO: 730756 - DNA, 803 bp, Homo sapiens; identical to SEQ ID NO: 281116

SEQ ID NO: 730757 - DNA, 955 bp, Homo sapiens
  misc_feature (437)..(437): n is a, c, g, or t
ggtgagctgctcgcaagaggacggcagaggcccggcagctcggagctccgggaccttgtggcgcatcaggacgctggctgtccctctgcctgggacccatgagcctgccgcctgcctgctctgcctcctgcgtgttagcctcctctgctgcgctcctgggcaggcggcctgtgggatgcctgtggggcgatggacgggcgctgaggctgctgctgcttgccccctggccctgcgcggctgtgaaactggaggaggcctgagccaagcggatggcccctcttatgctgggaggatgctggagagtagcggctgcaaagcgctgaaggagggcgtgcttggagaagcgcagaggaacgggtagttgcagctctggcaagaaaagcgtgtatgcatcctcacctgaggaaggggctgctgcgttatccctgcccaatgcnagcgtgcaagcacgcatgcatgcatgcgagcaagacaggcagcgagcgagcatgcacgcgaacaacaagccccgtggcatgggtgccaggccggatgccagtccacaaagccagtggtgccccggctggtcgccaagcctcagatgccgccgtgtcagagctcaaaggaagctgcacttactccaaacatgaaggaccgttggacttgtgtggaagcgcaaggggcaagtacatgtacttcactgtggtgatggcagagggcaaggagatcgactttcggtgcccgcaagaccagggctggaacgccgagatcacgctgcagatggtgcagtacaagaatcggcagggcatcctggcggtcaaatccacgcggcaagaacgcagcagcacctggtccagacaagaagcccccatcgcagacgaagcggaaccgagagctccggcacgaaaccgaggtaagacttaggcggaaaccaagccaagaacaacccaagctcaagccacaaccaggataaccg

SEQ ID NO: 730758 - DNA, 793 bp, Homo sapiens
  misc_feature (605)..(605): n is a, c, g, or t
ttcgctgtcatcaaagtcgtcgcgattcttgcgatgatcgtgctgggtgtccttatcattgcaactggcctgggtggtggccctccgaccgggataggtaacctgtggcgacacggaggattctttccaaccggcatcagcgggatgctgtgcggttttgtcgtggtgatgttcagctttggaggggtcgagctcatcgggattacggcaggggaggctgacgatccgcgtcggtctattccgcgagcgatcaatcaagtcgtgtatcggatcctcattttctacatcggtgcaatttcggtcatgttgtgtctttttccatggaaccagatcggcaaggcaggcagccccttcgtgacgatcttcgacaaaatcggagtcgcaggtgcggcgaatatcctcaatgttgtggtgcttaccgcttccatgtcggcctacaactcgggcctatactccaacgggcggatgctttacagcttggccgctcagcacaacgctcccgggatcttctggaagacgaatcggctgggggcgccgtgggtgggagtgctcgctcctcggtggtgacggcaacggcggtgctgctgacgtacttgattcctggnaaggtgttttgtacatcatctcgatcgccttgatctctggggtcatcaattggacgatgatcatcatcaccaacctaaagttcggcgaaggatcggtcctgaaggtgtcgcagcggttggaatttcggatgccggtaatcccgttcacagtacgtggtgtgggtttctggcgccgggcgtggcctccg

SEQ ID NO: 730759 - DNA, 1763 bp, Homo sapiens; identical to SEQ ID NO: 546737

SEQ ID NO: 730760 - DNA, 705 bp, Homo sapiens; identical to SEQ ID NO: 125380

SEQ ID NO: 730761 - DNA, 798 bp, Homo sapiens
gggcttcgcagtctccacgatcacgatggtcctctggtgtcccatctttctctctcaaactgtcctttcctcaatcctttgactctgccggacttgtcacccccacaacctggttttgggtctggccaccccaacattaagaaaaaaatcactggatattttcccagaagcttcaattttgtgaagaggagatactgtttttttttcagcgttaatatttcaaacttaaaaaatacaaagcaaggtttcaaaaggtcaactttctggtaactacaagtcttcagattgtgagttcaaaagcaatactgaatttcaaagagaaaatttttttttcctttcttaactccagattcaagaacatgacaacttaaaagtcaatcttaaaagtcatggtaaagaacacctggcagtgaaatggaaagtgctcactgtgctcagttgtacctagccaaaacgagcaacacatacctgtataaaacattcatgcatggagacacagctagtactaatccatctgttgttgaaaaatatataaatgaagtcaaagaagatgaaataaacaatccgaatatccctctgaaggaacttctccgctcaacgttctgtggcagctggtctaatatgattcaactggtcttctgttcatgtttcttacattctaattttgttttgttttgtccatttttccctgtgaaacatgacatatttttcagaagacttctatgttgtttacaaatatgatgtcagtgtgattaaaatttcagtagatggaaaaagcaaactaaagcattctttaaa

SEQ ID NO: 730762 - DNA, 913 bp, Homo sapiens
gggcttcgcagtctccacgatcacgatggtcctctggtgtcccatctttctctctcaaactgtcctttcctcaatcctttgactctgccggacttgtcacccccacaacctggttttgggtctggccaccccaacattaaggtttaattatgacaaacatattaaacacagaaagaccctactttacttgacatctaaatgtgaatgaatttattaatgtcacatgttgcaacattaaagggacaacttgacacagaaaaaaatcactggatattttcccagaagcttcaattttgtgaagaggagatactgtttttttttcagcgttaatatttcaaacttaaaaaatacaaagcaaggtttcaaaaggtcaactttctggtaactacaagtcttcagattgtgagttcaaaagcaatactgaatttcaaagagaaaatttttttttcctttcttaactccagattcaagaacatgacaacttaaaagtcaatcttaaaagtcatggtaaagaacacctggcagtgaaatggaaagtgctcactgtgctcagttgtacctagccaaaacgagcaacacatacctgtataaaacattcatgcatggagacacagctagtactaatccatctgttgttgaaaaatatataaatgaagtcaaagaagatgaaataaacaatccgaatatccctctgaaggaacttctccgctcaacgttctgtggcagctggtctaatatgattcaactggtcttctgttcatgtttcttacattctaattttgttttgttttgtccatttttccctgtgaaacatgacatatttttcagaagacttctatgttgtttacaaatatgatgtcagtgtgattaaaatttcagtagatggaaaaagcaaactaaagcattctttaaa

SEQ ID NO: 730763 - DNA, 715 bp, Homo sapiens
gggcttcgcagtctccacgatcacgatggtcctctggtgtcccatctttctctctcaaactgtcctttcctcaatcctttgactctgccggacttgtcacccccacaacctggttttgggtctggccaccccaacattaattattctttgatggacacttgagttgcttacacctttcactattgtgaataatgctgctgtgcatgtacagtggctcatgcttgtaatcccagagtttttggaggccaagacagaactgcttgagctcaagagtttgaaaccagcctgggcaacataatgagatctcatctctacaaacaattaaagtattagccaagcaaggtggtttacatgactggctactagggaagctgagtctaaccatgagaaaaacaccaaatcatcccaaattaaggatgttggatgaagtgcctgtccaatacacaaaaccgtcaagttggtgaaaaacaaagtctgagaaacagtcacagtcaaaaggagccaaaagaaatctgaatactaaatgttatgtgctaccttggatgggatcctggaacagaaaaaaaaaaagaggcattttcccaacgcaaatggcagcataagcatctgagaatctgagcagcccttgcaagcacctcacagaagctgaagaaacaaaagttggagttcagaacctatcaatgtggaggcattctagcaatgaactctagagtta

SEQ ID NO: 730764 - DNA, 523 bp, Homo sapiens
  misc_feature (134)..(134): n is a, c, g, or t
tgccaaaaaaggcagcacgcccctgaggctgactggcacccagagccaaagatcagcaacggacaagaagaggctggcgagggcttgaggtgcttcaaagaggaagctacacagatagtggataaatagcaggnatttcttgtacttttgccaccagaaaactcatagtgggttggcctatctatcacgctttttaaagaacaggcaaaaaaggattaactagggacaagtgctcttccacccacccctcaggagatcaatttcctctccctgacacatataaatacacacatcctcgaagggtgagttagaaagtgcaccaggagctcgatgctttgggaggcaggggtgagaggattaatcgcctgaggccaggagttccagaccagcctgtgcaacacagcaagaccccatctctacaaaaatatttaaaaagttagccgggtatggtggtacaggcctgtagttccagctacttcggaggctgggataggagatcacttgacgccagggtaccgagctc

SEQ ID NO: 730765 - DNA, 525 bp, Homo sapiens
  misc_feature (283)..(283): n is a, c, g, or t
  misc_feature (486)..(486): n is a, c, g, or t
atcggccagcttaccttactgcgtcagtagcgggttacgtgattgcaaacgagcagtttaaaacggagtgggctttgggctgcagagccgcctggcattctgacagctgagcaggaggcagaggtgagagtccaagatggactaaaaatgtcccagcagctgggagcccaacctcggcccaacctcgttgaaaggaggaacattcggtgcagccgtcggaaccttattatttatgaaaggggacagctcacaggattacatttttctaagccaatcctgtgancatcctccatgaaattctctattttggttgcatgtggtcaaaactgagcctcactgaaacaattgaaaacaaatactcccgacaaatcttaagaatcgttttgaaaatcaaaaggtggggaaaatgttgtggcttctgagctttcttcagcccatattctattattctctgatgttttatggtgtaaaatcataccattccanttatgtattgattgtcagtagagggtaaggctgggtacc

SEQ ID NO: 730766 - DNA, 415 bp, Homo sapiens
tagctcccatcttactgccaatcacccaccttaagtccaaggaggctttacaactattagatctctaggcatctccttagctagtaacatatttatattgatccacctaagttggaaatatgagttgttaagacagccccatgtttcttctgggttttttcttttttctttttttcttttttttggagatgagtttcactcttgttgcccagtctgcattgcaatggcatgatctcggctcactgcaacccctgcctcccgggttcaagtgattctcagggctcagactctcaagtagctgagattacaggtgcatgccaccacgcctggctaatttttgtgtttttagtagagacagggtttagtcatattggtcagtctggtctcgaactcctgaccccaggtgacgtgcctg

SEQ ID NO: 730767 - DNA, 400 bp, Homo sapiens
atccaaagcctttttgttaacatggctgaacttctttaattctgtgttgcactgctcaagttttcgaaacaactgtttgaggctcagtgtctggtacttttcaaatgcttcctggggaagtgatccaagttctcgaattttcttcatacactcttctttcttcttcaatagcatgccttgccgatttgtcatcttttccagttctttagtatcatgatttatagcatccatatgttctttttccatatttttccagcgctccatactcttctgaagctccttaattccagcttctgttttatcaatggaattgtccaaatcttctgatcgtgccatagtgtcttttactcttttattgatggcttcaagttctgatgttgtggctgtgagaacagtaccc

SEQ ID NO: 730768 - DNA, 639 bp, Homo sapiens
  misc_feature (24)..(24): n is a, c, g, or t
tgttctttttcttctttcatagcngaaatttttgttttcaattctctaacttggcgttcgatatcctccattttatctcttgcatcctgctgagcatctcttaattgtctggatttttctccactagtctctcgcttagcagaaagctcatcaagtttggcacgagtctcgttaagttcctgattgtaaatggtatattccagggctcgtctcattttatcccacttctgatactgagctagttcttccttttcttcctctagagtatgtaatctctcttcaatgtattttaacaactcattgattttttcccgtttgccctctgtttctttcattaaggagatgctttcttcctttcgttcgtcatacactctagtaccagctacttctcttaatagctttaatctctgagaatctggtgctgttgtcatcttttccagttctttagtatcatgatttatagcatccatatgttctttttccatatttttccagcgctccatactcttctgaagctccttaattccagcttctgttttatcaatggaattgtccaaatcttctgatcgtgccatagtgtcttttactcttttattgatggcttcaagttctgatgttgtggctgtgagaacagtaccc

SEQ ID NO: 730769 - DNA, 417 bp, Homo sapiens
agtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcgaagatctgaaggcccagctgcagaatgccaacaaggtcattcaaaacctcaagagccgggtccggtccctctcagttacaagtgattattcgtctagtctggaaagaccccggaagctgagagctgttggcaccttggaggggtcttcacctcatagtgtccctgatgaggatgaggggtggctgtctgatggcactggggctttctactctccagggcttcaggcca

SEQ ID NO: 730770 - DNA, 129 bp, Homo sapiens
  misc_feature (92)..(92): n is a, c, g, or t
acaatggtggtctcagtcacctcggtgttgtaaggtggaatagagctcccaggctgcagtgtggtaaagactccagtggctttgggctctcnttgttgccctttatgccccgggtcctctagacgccat

SEQ ID NO: 730771 - DNA, 414 bp, Homo sapiens
  misc_feature (385)..(385): n is a, c, g, or t
  misc_feature (394)..(394): n is a, c, g, or t
ctgtgcccccctctaaatctacataaagagaaaaaaagaaaagaataaaaccaagtaatgagttcacatcctgcaaaatgtgaaaaattaaagggctcactaagtataacaaatacaaaataggccgggcacggtggctcacacctgtaatcctagcgctttgggaagctgaggtgggtggatctcaaagtgctgggattataggcatgagccaccacatccgtccttattttcatgttttagagattgtgtctcattctgtcaccccaattggagtgtagcagtgtgatcacagcttactgcacccttgaatttctggacttaagtgattctcctgcctcagcctcctgagtagctgggattacaagcgcctgccaccacactnggctaattnttgatttttagggggaacga

SEQ ID NO: 730772 - DNA, 600 bp, Homo sapiens; identical to SEQ ID NO: 158784
  misc_feature (566)..(566): n is a, c, g, or t
  misc_feature (578)..(578): n is a, c, g, or t

SEQ ID NO: 730773 - DNA, 971 bp, Homo sapiens
aactcccactttccatcctccccagtaatttccctgtgctcctctgaagataaaccgctgcctgcaccagcctagcagcttccagaagctgtggatgagaagcaatctcccaccaaaagccagagctcacctgcaaagcttcaatcccaagcagaaggaagcctccgttttttccccccagatgagcctgaattcacctccagaaagtctcaatgcatcacaccaagggtcacacacctgctcatggttcttcttgaggcaaagcagctcctccttcagggactccagctgggcctccaggtcacacttggcgagggtgaggttgtctagcaccctgcgcaggccacagatgtcagcctccaccagctgttgcagcgagcgctctctctcgtacctgtaacagggaaagtgcaggagtgacagttagagggcaggaaggggcaccaggacatgactcccagctcgcagctgtaagtccactggcctgccctttgccatctaattgtgagttggcttatcctgtgtagtgtgctcaaagcccagaaagcaacaggatgttccccactcagtcaatactaagcacctgagatgaaccaaggggagcagctggtactgaggatactgtgatggacacacagccagcacctgcctttacacacaatggcccaaaagggaggtggcaaagtaaccaggcatttgcaacacagtgcaatcactgcaggcccctctctacaagccccatacccaaagggaccctggattccctattagagtaaaagccacattgccagcatgagaggaaggaaatggctttctttagctctagaagagtgagacttgcacagtgccccgaagaaagatgataaaacacaatgcccttccagcacccagggtagaccctcctcaggtggtgtcaaccctttgactttcacatgttttcatcttaggctatggagcatgatttctgctat

SEQ ID NO: 730774 - DNA, 993 bp, Homo sapiens
aactcccactttccatcctccccagtaatttccctgtgctcctctgaagataaaccgctgcctgcaccagcctagcagcttccagaagctgtggatgagaagcaatctcccaccaaaagccagagctcacctgcaaagcttcaatcccaagcagaaggaagcctccgttttttccccccagatgagcctgaattcacctccagaaagtctcaatgcatcacaccaagggtcacacacctgctcatggttcttcttgaggcaaagcagctcctccttcagggactccagctgggcctccaggtcacacttggcgagggtgaggttgtctagcaccctgcgcaggccacagatgtcagcctccaccagctgttgcagcgagcgctctctctcgtacctgtaacagggaaagtgcaggagtgacagttagagggcaggaaggggcaccaggacatgactcccagctcgcagctgtaagtccactggcctgccctttgccatctaattgtgagttggcttatcctgtgtagtgtgctcaaagcccagaaagcaacaggatgttccccactcagtcaatactaagcacctgagatgaaccaaggggagcagctggtactgaggatactgtgatggacacacagccagcacctgcctttacacacaatggcccaaaagggaggtggcaaagtaaccaggcatttgcaacacagtgcaatcactgcaggcccctctctacaagccccatacccaaagggaccctggattccctattagagtaaaagccacattgccagcatgagaggaaggaaatggctttctttagctctagaagagtgagacttgcacagtgccccgaagaaagatgataaaacacaatgcccttccagcacccataccatgcgctcatgcctgcagttcgattgcattcgttggctacagctgtttcccagaccactctcttatgatccatgtgtatattcagcgatgctacgtttg

SEQ ID NO: 730775 - DNA, 397 bp, Homo sapiens
cctagttttagaagtttcaatagcactgtgatggacacacagccagcacctgcctttacacacaatggcccaaaagggaggtggcaaagtaaccaggcatttgcaacacagtgcaatcactgcaggcccctctctacaagccccatacccaaagggaccctggattccctattagagtaaaagccacattgccagcatgagaggaaggaaatggctttctttagctctagaagagtgagacttgcacagtgccccgaagaaagatgataaaacacaatgcccttccagcacccataccatgcgctcatgcctgcagttcgattgcattcgttggctacagctgtttcccagaccactctcttatgatccatgtgtatattcagcgatgctacgtttg

SEQ ID NO: 730776 - DNA, 161 bp, Homo sapiens; identical to SEQ ID NO: 158787

SEQ ID NO: 730777 - DNA, 255 bp, Homo sapiens
cgactcgagccggtaccctagtttagaagttcatagcagcaactctatttcttagacatggaggcatgggttgccagctagaaccaactgccctgatactcttcatccagttaagtggaaaccttagcaactataataaactatgagatgggtaatcagtgggcattattatctcatgttttcatttgtcactttatgtagcaattcagggatccttattttttcacatatgctatggaaacttctaaaactagg

SEQ ID NO: 730778 - DNA, 460 bp, Homo sapiens
ttgaaatgggcacagaaattttctggtgtttcagaagtatggtgtaaacagcattttgatccgtgtgcagtctgtgggcagggacacctgcctgtcagcctgctattatgatgaggctcttgaagaaactaccctctttctaagaactggaagaactcaaataatgaagagacaatagaggtttgggcagtaatggaaagaagaaaagacagtgcctagccaagcagatgaatgaggtagaacagtcttgttcatacattgccattatatctagtgcagttgaatgaacattttctgtgtctgggcttaggtgcaggcaaatagttatctgtgttgtattcagataaggggttagaagaatctttatttttctgtgtcggtcatctctttcttgctgtaaaatgaaattgtttaaagcttacattatgacattagtgttgaatttctgtgcccatttcaa

SEQ ID NO: 730779 - DNA, 736 bp, Homo sapiens
tggaccccttccttacaccttatacaaaaattaactcaagatggattaaagatttaaacataagacctaaaaccataaaaaccctagaagaaaacctaggcaataccattcaggacataggcatgggcaaggacttcatgactaaaacaccaaaagcaatggcaacaaaagccaaaattgacaaatgggatctgattaaactaaagagcttctgcacagcaaaagaaactaccatcagagtgaacaggcaacctacagaatggaagaaaatttttgcaatctatccatcttacaaagagctaatatccagaatttaaaggaacttaaacaaatttaccaaaaaaaaaaatcaaacaaccccatcaaaaagtgggcgaaggatatgaacacacacttctcaaaaaaaataagatatttatgcttccatttctttagaggtgagtgaccaaggtttggaaaagaggagatgagtgtctgctggagcttagccatctgtggcaccagcgctggtccacataagcagctggccagcggtgcagtgtgaggtagaggggtgtctgtgagtggtgctggaaagagggaagacaaggggtccgggttccagggtccaggtaaggtgaccttggataagcgattcagaccagcctgtctcctacggggcctctgccatcctgctgcccctaaaggcagctgccgtctcccctctgatagggttacccaggtacccaggtcactc

SEQ ID NO: 730780 - DNA, 449 bp, Homo sapiens
  misc_feature (370)..(370): n is a, c, g, or t
  misc_feature (395)..(395): n is a, c, g, or t
  misc_feature (402)..(402): n is a, c, g, or t
atcctagctcagacagttagatggaccctatcccctgaagagaatcagagggatgggtgggcgtgaacaagtgcacgtgtatgtgatggtaatgagtccagttttggataggctgtgttagacattcagtaagactaccaagtggtgatgtgctatatgcagtaagcagctgtcacctgtgtgcagtacgcagaaattacctagagaaaactggccggggcagtggctcacgcctaggtcttctgaagcgatcctctcgatccacatctctctctctgtccctttctctcccaggttcaagcaattctcctgcctcagcttcccaagtagctgggactacaggcacatgccaccatgcatggctaatttnttttttttttttttttttgggaaanggattcncgctctgtcatctggtttgattgcagtggcgcgatttccccccattg

SEQ ID NO: 730781 - DNA, 779 bp, Homo sapiens
gtctgctctagaggatcaccctaacaggctgagcaagactgagctgagggatcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacaatctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagac

SEQ ID NO: 730782 - DNA, 703 bp, Homo sapiens
  misc_feature (35)..(35): n is a, c, g, or t
gagtcggtacccttttaggcttggagcagactganctgagggagttcagatcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatgggtgaaaaggaaggatggagaaattcaatggagaaacaatctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagac

SEQ ID NO: 730783 - DNA, 778 bp, Homo sapiens
  misc_feature (35)..(35): n is a, c, g, or t
gagtcggtacccttttaggcttggagcagactganctgagggagttcagatcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacaatctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagac

SEQ ID NO: 730784 - DNA, 261 bp, Homo sapiens
  misc_feature (139)..(139): n is a, c, g, or t
  misc_feature (178)..(178): n is a, c, g, or t
  misc_feature (186)..(186): n is a, c, g, or t
  misc_feature (194)..(194): n is a, c, g, or t
  misc_feature (196)..(196): n is a, c, g, or t
  misc_feature (206)..(206): n is a, c, g, or t
  misc_feature (211)..(211): n is a, c, g, or t
  misc_feature (216)..(216): n is a, c, g, or t
  misc_feature (219)..(219): n is a, c, g, or t
tcggtacctctcctactgtatcctaggttacgagagagtactctttttaacctaggaacactttaagattttagaaataagaatatgtttctacagacctgaacattagtggtttttttttttttttttttttggaaanaaattttggttttggtggccggggtgggggggaaggggnagaatctnggttcacnangacctcggcntccanggtcnaancaatttttcttgcctcagcctctgtgaatgggcgggaattac

SEQ ID NO: 730785 - DNA, 896 bp, Homo sapiens
cacaggtatcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctcttgactggattcctaccacaaatcgtccaactgaaaagccttgtgcctgctctccaggatgtctcaacaattgggggtattgggtaccggtcctgttggccagtggagactggtgttctcaaacctggtatggtggtcacctttgctccagtcaacgttgcaacaga

SEQ ID NO: 730786 - DNA, 1294 bp, Homo sapiens
gcaaccgggccgcgccgcgagaaggtcacacgattctccaacatggcggcggcggccctgcggagtggctggtgccgctgtccacggagatgcctcggcagtggaatccaatttctttccagccacaacctaccccatgggtcgacctatcagatgcgccggccgggcggagagctgccactgtccaaatcatattcttctggaaacagaaaaggctttctgtccggcttgctagataatgtcaaacaagaattagccaaaaacaaagaaatgaaagaaagtataaaaaaattccgtgacgaggccagaaggctagaagaatcagacgtgctccaggaggccagaaggaaatacaaaaccatcgagtcagaaaccgtgcggacgagcgaggtgctacggaagaagcttggggagctgacgggcaccgtgaaggagagccttcacgaagtcagtaaaagtgatctcggccggaaaatcaaggagggcgtggaggaagcagccaagacggccaagcagtcggccgagtcggtatccaaaggcggggagaagctgggcaggacagcggccttcagagccctctcccagggggtggagtccgtgaagaaggaaattgacgacagcgtcctgggacagaccgggccctaccggaggccccagcgactccggaagagaacggagtttgcgggagataagttcaaggaggagaaagtgtttgagccaaacgaggaggccctgggggtcgtgctgcacaaggactccaagtggtaccagcagtggaaggacttcaaggagaacaacgtggtgtttaaccggttcttcgagatgaagatgaagtatgacgaaagcgacaacgcgttcatccgggcatcccgggcccttacggacaaggtcaccgacttgctggggggcctgttctccaagacagagatgtcggaggtgctcacggagatcctccgggtggacccggcctttgacaaggaccggtttctgaaacagtgcgagaacgacatcatccccaatgtcctggaggccatgatttctggagagcttgacattctcaaagactggtgctatgaagctcatgtgacacatctgggctctcaggctggacaccgggtcacccgccagtcctttgctcccagactgtaaactttgttagggagaatccttctctgggctggtgtctaagagatggctggttgggggtgtcccctgggcctgtgagagatcacaaagctgccaattttactgggccttttttttccctccaatcttaaaataattttggttaggt

SEQ ID NO: 730787 - DNA, 1318 bp, Homo sapiens
  misc_feature (1316)..(1316): n is a, c, g, or t
  misc_feature (1318)..(1318): n is a, c, g, or t
gcaaccgggccgcgccgcgagaaggtcacacgattctccaacatggcggcggcggccctgcggagtggctggtgccgctgtccacggagatgcctcggcagtggaatccaatttctttccagccacaacctaccccatgggtcgacctatcagatgcgccggccgggcggagagctgccactgtccaaatcatattcttctggaaacagaaaaggctttctgtccggcttgctagataatgtcaaacaagaattagccaaaaacaaagaaatgaaagaaagtataaaaaaattccgtgacgaggccagaaggctagaagaatcagacgtgctccaggaggccagaaggaaatacaaaaccatcgagtcagaaaccgtgcggacgagcgaggtgctacggaagaagcttggggagctgacgggcaccgtgaaggagagccttcacgaagtcagtaaaagtgatctcggccggaaaatcaaggagggcgtggaggaagcagccaagacggccaagcagtcggccgagtcggtatccaaaggcggggagaagctgggcaggacagcggccttcagagccctctcccagggggtggagtccgtgaagaaggaaattgacgacagcgtcctgggacagaccgggccctaccggaggccccagcgactccggaagagaacggagtttgcgggagataagttcaaggaggagaaagtgtttgagccaaacgaggaggccctgggggtcgtgctgcacaaggactccaagtggtaccagcagtggaaggacttcaaggagaacaacgtggtgtttaaccggttcttcgagatgaagatgaagtatgacgaaagcgacaacgcgttcatccgggcatcccgggcccttacggacaaggtcaccgacttgctggggggcctgttctccaagacagagatgtcggaggtgctcacggagatcctccgggtggacccggcctttgacaaggaccggtttctgaaacagtgcgagaacgacatcatccccaatgtcctggaggccatgatttctggagagcttgacattctcaaagactggtgctatgaagctactacaggcaggtggccacccatcaggcaggcaggctggtttccgttccttcgtcctgacttgacttcgctggcggcaatattgggcgggccgggtgtcaccctccggccttgggtggtcggccccgcgcgggggggccgcaactcgcgtttttggctgcccgggccccggggggcggctccccactttgggagcgctacgccctctagtcccgcggcgggccccccagccgcgcngn

SEQ ID NO: 730788 - DNA, 580 bp, Homo sapiens
atccacccaccttagccttccaaagtgttgggattacaggcatgagccaccgtgcctggctggaatattttatttttttaatttgctagtctcactggataactgagtcttgacttatggaatggcataaactcttgatgcaggcatgaagaataaaattagtttttgtaaacaagagaatttgaaactgcttagagaatagaggtaaaaaggaatttccttctttgggtaagagtggatccaaaccatatattctctggctattagagtctccagaggtgtgtggtcattttttgttatggtgattcccaaagatttgcagtgttggcaagtacccaaaatttatctcagctggtcataaaccttagtgccttttgatggttttgttttatagagttacttattaaagttctatgtaaatcattactgttatccttttaagtttctgtatttaactattaccattttttattttatagtcattacatattggatattatgtagaatgtagttatgtatagagtgttttatctacttatttgttgctgcccttttctgagagttatttaatacagtttga

SEQ ID NO: 730789 - DNA, 533 bp, Homo sapiens
  misc_feature (489)..(489): n is a, c, g, or t
caacgatggtcctcagcttctatttttctcagaaaaacagaagctgaattttcaaaatatccggggagctgtctttgagattgttttgagaagaagccagcatcacgagaagtggaggtggtttcatgcctcctggagacagggcttaacttcatacagtttggttttgttgcagtaaaatgtcactgggatcctgtaaagacaagaaggagaaatggtgttttgcctttctttcatttccttttttttttttcaaagacagggtctcgcctaggcaggatgtagtggtacaatcataactcactgcagccttgacctcctgggctcaagcaaccctttcacctcagcttaccaagtagctgaggaccatcgttgcaacgagggtcctcagcggcattaaccagccccagttccgggcggtctggggggaagtgaaccggtgtgagaagatgcgccagttggatgctaaaaagttggcagagacccaanctataaaggacacaccacggaaagagaagggtcacgggaagaga

SEQ ID NO: 730790 - DNA, 545 bp, Homo sapiens
ctataacccagtcaaacccatagcacctggctgtgagttgtggattaattctctgcccatgtttgcaccccccaaaatagctgggatttgacatttctgagacctgtggaataaagaaatgcatccctaaagcacagggccaaagccagtatgagcaaatccctccgatttcggttttgtattgtcttggggattagaatcttttgattcctgtgtgtgtgctgaaactgccatcttattgcttattatgtatgaaaatttggctcagttgagagaagagtcattccctgatattggcaaggtcctaaaacactgtcactcagttcagatcatctttctgggtgcctgttctgtgctaggcagggagctttggggagaccaagaaaaatgggagccagtccctgtgttcagggagcccatggtcaacaagtgaatgaggaatgaaatactgaggcagaaccttgtactacgacaggtgttcggagggatggaggaaggattcctgggtctgagctgggctttgaaggtctaccaggagtttgcta

SEQ ID NO: 730791 - DNA, 594 bp, Homo sapiens
aaaacttctatgttcaataatgcacataataaacttgtaactgcaattcaaaatattaataataccatcactattcagaagcaaacaaaatagcaacaagtttcctaaaagaacaatgtctaaccctctgcggcgctcgcaaattccaaaatgaatcactgaccagtttataattcaagtaaggatatgaaaatacaagagtcctgatttcatcaacatctaggactccccataacatgttagtttcaaacagcctttttctctcagcaagagtgctttcttgcctcttatctgtagccacttctcaaaatgagaacatgacattactatagccaaaagtcaatctccttgtctcatggtcacaagctaggtccccagccaacactgctctctcaaaaatggaagacaacaaaacagggccaggcacggtggctcacacctgtaatcccagcactttcggaggcagaggtgagtggatcatgaggtcaggagatcgagaccatcctggctaacacagcgaaaccccgtctctactaaaaataaaaaaaaattagccaggcgtggtggtgggcacctgtagtccccgctactcgg

SEQ ID NO: 730792 - DNA, 529 bp, Homo sapiens
aaaacttctatgttcaataatgcacataataaacttgtaactgcaattcaaaatattaataataccatcactattcagaagcaaacaaaatagcaacaagtttcctaaaagaacaatgtctaaccctctgcggcgctcgcaaattccaaaatgaatcactgaccagtttataattcaagtaaggatatgaaaatacaagagtcctgatttcatcaacatctaggactccccataacatgttagtttcaaacagcctttttctctcagcaagagtgctttcttgcctcttatctgtagccacttctcaaaatgagaacatgacattactatagccaaaagtcaatctccttgtctcatggtcacaagctaggtccccagccaacactgctctctcaaaaatggaagacaacaaaacagggccaggcacggtggctcacacctgtaatcccagcactttcggaggccacagcaggaggatcgcttgagtccagccaggagttcgagaccaacctgggcagcatggcaaaac

SEQ ID NO: 730793 - DNA, 584 bp, Homo sapiens
  misc_feature (12)..(12): n is a, c, g, or t
ttgagctcggtnccagttcgacggagactctcgtcattgtcctattatagtcacaatgacgagagtgaattaatttttagttagcatctacaggtgcaaagctgaagcagagttcccaccatcatactgtgagctccctcgaaggctatatgtaccctatcttcccatccccattgctctcccacagaaggaaggctgcgttactaatgacagatcagcatcagtctgtcagcctcagtcttagcatttagcacctggctagtgcaaaaagagctcaggaaacagcccagccaggagacaggccctcaggagagagaactgcccaggtctgtggcaggcatgagggcagtggcattgccaccaaatgaggaatccgttattggaactccaacctgagaggtagtgagcttggagggtttctttgtttgtttgtttgtttgtttgtttgtttgagaattgcacacaattacgacagtcatttttcccagaagtcctctctaagagcctgtgctcattcatggtaagttgacgccctgctctcagtgacacccttcagagagagcgagcctggggcctgagatgct

SEQ ID NO: 730794 - DNA, 315 bp, Homo sapiens; identical to SEQ ID NO: 728679

SEQ ID NO: 730795 - DNA, 339 bp, Homo sapiens; identical to SEQ ID NO: 728680

SEQ ID NO: 730796 - DNA, 536 bp, Homo sapiens
ttccatgatatccacggtgttctaaactctcgctgtcagtgccatttccatgatatccacggtgttctaaactctcgctgtgggtgccatttccatgatatccacagtgttctaaactctccctgttggtgccatttccatgatatccacggtgttctaaactctcgctgtcagtgccatttccatgatatccacggtgttctaaactctcgctgtcagtgccatttccatgatatccacggtgttctaaactctcgctgtgggtgccatttccatgatatccacggtgttctaaactctccctgttggtgccatttccatgatatccacgacgttctaagctctccctgtcggtgccatttgcatgatatccatggtgttctaaactctcgctgtgggtgccatttccatgatatccacggtgttctaaactctcgctgtgggtgccatttccatgatatccacggtgttctaaactctccctgttggtgccatttccatgatatccacgacgttctaagctctccctgtcggtg

SEQ ID NO: 730797 - DNA, 332 bp, Homo sapiens
aggaagcacactgcaacaacgtatttaatacaaagcagcctttgggcggggcggggcggttaacaaaatgcatctcagcaccagcctagagaaacttttctgtgtgtaaacagaagaggggttaccatggagaaattcattacggatttcgggagggctttttcctcagacatagagtgaaaagaataagtcgttgtgcaataaatctgatactgacgctgtgtgacttagaagttggtccaaaagttcatcttaggcaattatgcctagatgatcaactacacatcttctgcaacaggtgacacgaacctgttgcagtgtgcttccgagca

SEQ ID NO: 730798 - DNA, 315 bp, Homo sapiens
  misc_feature (55)..(55): n is a, c, g, or t
ggggtggggctggccctcacaggttgttgagttccaccagggtctggtccaaggnctggggaatctcgacgttctcctccttggcactggccaagggctcttttaggtcatcgatgggtttctccaactttgccacagacctctcggcaaactctgctcgggtctcagcctccttcagcttctcctccaacagttagatctcctcttcatatttatcttctttgggggaatactcctcccctagggccttcagggacttaagggcctcgaccacaattcgaaggtcctcctctaggtgcctgaataggctcttgg

SEQ ID NO: 730799 - DNA, 881 bp, Homo sapiens
  misc_feature (857)..(857): n is a, c, g, or t
ggtggaggttgcactgagcccagataatgccactgcactccagtctgggtgacaagatcgagactctgtctcaaaaaaagagaatacttccttccaacagaaacatatctaaagatctgtggtaaacaaatacaaatgtagggagagagaaaagacaaaaaattaacaaagacttcttaaagaattagttttgttgataaaaagtgttaacgataattttacttttttggtaaaagaaagaattgctgcccaccaattcggtgtgatcacttgaaaacacaacttaagagaaaattcactgtaaatctggaattaccagatttcaggaaaaaagcaatctaaagctgtcaatctagacagacatccaaacacctattcatccactccagagctggccaaaaaagtactgtttattaacacatcaagagaacttaattcctttgataaaagaaccacacgggtaatagcatctactgacggatcactggtacatatgattatctctggggctatgttccacatgtgaatataacatttgtactcactgaagctgtctgttgcttccctacagagagacagaggctgctcacgtaccaaaaaatagaaaggagacaaagaggaaaaaccttacagggagaaactcataaccactaatgtgctttcactgggcttaagtccaaagccatggattgttacagaagcaacatgttacagggtgtctgaattgttaaaactgctgtccaaattggttctgcctctagggcaagacctactatgtgtaaaatattggcaggggcgatgaatacatataaggcattgttcttgtactcaaaaaagcttaagagtctcactgggcnctcattatgaggggtcggagctgc

SEQ ID NO: 730800 - DNA, 662 bp, Homo sapiens
tcagtgtgtgctactggggtgcagtcaggcacagtggtttcaagggagcacagcaaggaacccaagaaggccccgcatgtctgcagttggctgactattgcccgggactccagagcatccatggagggccccacaggggaaggcaggagcaggacgggtctagggaggtgaaggccgacctgacctgctaagagacgagaagagagggaggggaaagtcttgttcctgccaggacattgttaatgagaggagtgagaaggcagcaggtgaagagagtgtggcatggaaggcagaaatcagagcgtttttgggtttcgtgctgacctgctattgggaatgaaaatcaagactcaggtgcattctggtccctttctcagggttagccgaacaccacccgcatccctgcctggcctgttgatgccattcttcctaggcccactcaccgctgcagctgctttacttgcacttcctctcgtcatccgaccacagatcagacctctgctgctcgctgccgcccagggagagtgtgcacctacgtgcacattgcaccccactgcccagcacacccaggagtgagagtgaggagcagctgagagagttggaaaagggagcccttatgtggccaccaagggcttccctgctagcagccacacggtggctat

SEQ ID NO: 730801 - DNA, 671 bp, Homo sapiens
aaccgctcccacttggttgcggtggttcggggcaggagacgacgcagcgcggagcggaaagggcggttacccaacggccttagctctcatggcgtcctccgtggtgttacctaaaaataaagttatttgtgattagaaggtaatcgcctcctggtcatgcttccgctggtcaccagtgtctgcggggcgaccccatccttgtggccagagagggcctgtggctgcgctcaaggcgggagcggtccttagcggggccctgcgggacgcccaggccgcgctcctttcccttgctcacctggccttgaagtgaagggggaggtttaacaatgcagtgggaaccccaaagtttgtctcggccgtgctgctcacattccaaacaatgcaaaaggttgcggaaaacctcagcagttgaaaccgtgatgcatttcagcaaagaagtagctcctgtcctcgtaaaatcagtgaagttctcacggacgacctcattgagtgagttgtgaagcttgttgccttaatcagaatgatcagccagcatgcatgctctaatatgctcgtttgtccatgatatgagcagctgccaagtggaagaagaggcctttactcatagtctgttcacttggtagcacaagttggttgtgcaaccaagtgggaggccaggatcctctagaaaa

SEQ ID NO: 730802 - DNA, 260 bp, Homo sapiens
agcaaaccttccttttccagggccactggctcctctcaggacatctcacatgcagtgcaagtggccccactgagaaacattccacctatccagctgcacttctttctaaattggaagagtaaaggcaaaagaacagtatctactataagatccctgagaaaagccatcaagagacacacattctaatgccactgagagttggtctcttaaatattaagattggaccacaaagctgtacagttattctatttagacggtac

SEQ ID NO: 730803 - DNA, 225 bp, Homo sapiens
  misc_feature (18)..(18): n is a, c, g, or t
ccagaggatcccagtggnagatgtgctacacacaggatctagaagaatatgtcaaactataaacggctgtgatgtgaatgacttggttcttggcttgtgtttttcaatttcctataatgcacattcttccaaggcttttttaaaaatataggactgatggatggattgataatagaaggtatacgtccatataaaatattccagcttcctgacaaccagttattt

SEQ ID NO: 730804 - DNA, 249 bp, Homo sapiens
atacatagctcggttccccttttggggtctttgctagtaaactgtaattctttcagtaagtcactgctttactgaatggtgaagatttggaatgtcttctttgatttccaggccaacaatggatagatttggtcgtccttgaagcatttagagacctgtagaatgaacttaacttctgaaaactgggtgcggggccaatagaggggctgctcaatacctcaccagcctgctacgcggaaggctagatgg

SEQ ID NO: 730805 - DNA, 154 bp, Homo sapiens
gagaactgctgttccacctccgcctcctccctgcagtgtggcttcttaggcaagtcccagtttagaagtcatctaactaagtgaacattcttgaactgccaccagacctctcctaaaacttttttctaagcaaagaccccaaaagggggatcct

SEQ ID NO: 730806 - DNA, 850 bp, Homo sapiens
agatgatgatcatgggaggtcctgtcctttcaaatatgcgtgtgagttgatcagagcaggggctctgggtacatctctcagtgtcctaaacatcatgtttcagtcatccctttgcagctctgaatgctctgagctttgtcaagcctcactgactaatacatttcattaggttcatttcaaatgacatgcatttgtatacattttaccaggttggttgtatgaatttattttagctgggtgtggtgatggatgcctgtaatcccagctactcgggaggctgagacaggagaatcacttgaacccaggaggtggaagctgcagtaagctgagattgcaccattgtactgcagcctgggcaacgagcaaaactctgtctcaaaaaaacaaaaaaagagcagcagcaactgactggttggatcaggaaagactctgagaaaggactcctgacctggctcttccagaatgaggatggattttccatatgaaggagccgggggcaggaccttctgggtagagcgtgaaaagaacacagtatgtgtggagagcgggaaattgtgttgaactgtctagaaaacagagccacaggaatgcgtgttgagggcttgggctgtacagtggagagtgccctccctggccaggagttggacattcatcccaccacaagaccccatgaagagttcctcaacagctctgtgtcctcatcaaacctgtgtttgcagaacagtggaggaagagagctgaaggaggggagaggccctgcacctgccaggccctggctagactacaagggtgagcactgagccatgctctcggggaaccttcactggagttgagggcagtgagaatgttt

SEQ ID NO: 730807 - DNA, 301 bp, Homo sapiens
ggcggaccttatttccttctttatgacaacatagtaaaacccgtcctacaaaaataaaaaaataaaaaaaataagccaggtgtggtggtgggcacctgtgatctcagctacgtgggaggctgaggcaggagaatctcttgaacctaggaggcagaggttgcagcgagccaagattgtgccagcctgggcgacagggtgaggctcttgtctcaaaaaaaaaagtccacatcttcatgaaccctcagactcgggagtggggtgtcggcttttttagccagctttggtgggaatggccttggac

SEQ ID NO: 730808 - DNA, 560 bp, Homo sapiens
cttgtcttagaaaggcaagttcttgggccccaccccacatatactgaatcagagaccctgggagtgggacccagcaatctgtcttaatagaccttctaggagattctggcactaaggaaagagaccacaggtcttgtctatctctgtagttggctgcgtctgggccagagtaactgcttgttgaaatgatcagagatctcaaatgaggtcatgcatgttggggtgtgtgtgtgtgcatgtgtgtgtgttgtgtatctttatgtgtgtatgtgtttggtctagggtccagcacatagtaggtgttcactcttgggggtgggaataatcactctaatgtccgtgtttgaggactgcattgctggtgaccgctgagcctgcagaggaggaagagagcagggcagaagattcaggagggggtgcatggcaacttctgatgtcacagtgccccccttcactcctgacttctggctcatgggtcactttggggcaggggcaagaggatggttagctgcagcaaagagaagcaaaagagaagtgggattgagagcacaggggacagc

SEQ ID NO: 730809 - DNA, 767 bp, Homo sapiens
cctactggagggtctaatgaaggtctggtgtttgtgggtgtcctcctcccttccctacacacccgccggcccactttccctctcttttccccttccctctgtggcctggccacctgggctttcgcagaatatgtagacaggacacgagggagaagtgaaggacaagagggcaagggtcttcaggcctcaggtttgcagtgggtctacctctctcccccttcctcatttcccatatcctcgttgctaggactgctgttttaaggaatgttttccaaggaactgtcgaggcaggaaggcagctatgacagacatttactaagtgtgtgccagggcacagggttcgcgtctgggtttgtttcggaggatgcattgatttgcaagacctgctgggatctctgtcctcagagagctgactgtatagacaagtgattggacaactaccacacagtgacacaaacacagtgacagatgcctcagcaccttacctaacccacctaacagtcagggaaggcttcctggaagaagcggtatccacactgagtcccaaaggataggcatgagttagtctggtgaagaggcaggaaaatgagtgtttaaggctgaaagaatagaatgtgcaggggctcacaggcaagagaatacatggttgaaaaaatatacttgggttgagaacctgatcgggggaggaatgtatagcggggctggagggtgctgcgcagggaggccgcggaggctttcttaagaaacttgaacttgagtgaagggca

SEQ ID NO: 730810 - DNA, 577 bp, Homo sapiens
tgagcctcagtgtttctcatctgcaaggtgagatagtaactctaacctctccaggtggttgagaacataaaacaaaatgaactctgcctataaagtcccttactaatggctggcatataacaggagtgcaatgagaagtagtccttattatctccccctctatactcgcccatacagcagagagctgggcaataggaccagcttgttcctgagtgcagaaataaccacagtggggtgttcatgcccaggttatgtatgggcttggtcatcttcatgaaaagatgtgtgcacagtaaagagagaacacatcactggggccaggaaggaacagtggtagaaggaaccccaagcttccccaaaactgcaaattccctgcctccaacctggggcacctctggcagccagccacgttggcagcctcgtactttctcttgggctcttcctgttggcatagcccaccctgttttacaaagctccagtggttttttttttttttttttttcaagggctccagctgttagataaacttttcaaggatatttctgtggcaggtacaaacctggacaggaagacttgg

SEQ ID NO: 730811 - DNA, 671 bp, Homo sapiens
  misc_feature (639)..(640): n is a, c, g, or t
agttcgacggagactctcatagacgtatgatcatttcttcctaaattaaatgtcctataagcaatcttacaacattaaaatcaatgactggcaatggctttgactacaagtgacgttttccaattttgtaaaagtagatttttcaaaggccttggcaacaggtaaagtaacatgtttctgtgtattacctaccctggaatgaagaatgtaattcatggagggggtatctccacactacctggtttgagattcagttactttctagtccaaatatactacagcctttcactagttctccctgaacagactgcaaacaagatgcaaagtatcttactaggaggatttcaaacttttgtggctccatgacgaaacagtttaaacaatcccaggggtagcgattaacaatgtgtaaaatgtgttacggtgatccaaaattccttaaaagatggtcgttgacatttatacttacttcacttgaagagctactatttaattccacataatagtttaatgtgtataccatatcaagatgtccactgtaaaatcatgccgtaccatatagttcaagggattaaaattacagtacataatacattatagcgcattttgggtctttataacccaaaattcactaatggnncatattatatatattctgtgccatctttaaa

SEQ ID NO: 730812 - DNA, 561 bp, Homo sapiens
gcaatctgaaggcaaatcctgtttagacccaggcgaaggttcccggtgacccgggctctcaccagccaattgtcccttgccgtcctcctgagggtgcctggagcttaagcactgtgtgctcttggcctccacactggggatgccgctgactcccactgtccagggcttccagtggattctccgaggccctgatgtagaaacttccccattgggtgcaccaagagcagcctcacatggtgtgggctgacatcaagagctgccagatccaacaggtcctgggggagtaggagccagtgcaaggagagaagtccattgagaaaggcaaatggatgacatcagacccaggggctgaggtccccaactgcagctgggtagcttctggagtggacaaggagcaacagggaagttcgtggcctggtgttctgggatccactgtctcatctcattcttgtgggcaccagaacgtatccaaagacaagactcagtgtctctggcaacagtgagccagagatagaatgtgtttcagaggaggaggaaggggttgttgtaccccatggaaac

SEQ ID NO: 730813 - DNA, 561 bp, Homo sapiens
gcaatctgaaggcaaatcctgtttagacccaggcgaaggttcccggtgacccgggctctcaccagccaattgtcccttgccgtcctcctgagggtgcctggagcttaagcactgtgtgctcttggcctccacactggggatgccgctgactcccactgtccagggcttccagtggattctccgaggccctgatgtagaaacttccccattgggtgcaccaagagcagcctcacatggtgtgggctgacatcaagagctgccagatccaacaggtaaaaatcccgaggcattgccagctcagtggggtcagagagtcctctttgtattatgactcagatgtgaagggaagatgtcaaggtccctaaacatcacagggccttgcttggcatgcaacagatattaaataaatatttgttaaatgaatgaacaaatatccacagcatgtgctgcccatgagctgcagtgccgtggtcaggtagaagtgattttacttcaggagaggacagtgttctctccaggacttttccttactagctagatctgcgtcccgaaactgagaca

SEQ ID NO: 730814 - DNA, 673 bp, Homo sapiens
cagtagaagtgggcgagagagcgttgggtgggaacgtggcacgagagagagaaattatgagattgagagagagagagagagagagagagagagagagagaaagagaaagagagagagaaagagaaagagacagagaaaagaaactatgttgtttaaaatgccagcggaaagtccatgggggtgaaagagtccggcaatggccagggagttagcagcttggcgtagtgtcttcccactgttttgtctgtcttgagaatagcattcaacgcgactgtgttcccgcagcagacgttaggccgctgcccacgccttgagtgccggacgaggtcaacataggctttccgtcacagaatatgtttgggcaggaagatcggaacacttggggctgggccatctaccgctcccccacggcacacacgagtcgtcagggaaatgcccgcctctgtgtgtgttgtacgtgcagccttctgggcagagccgtggagagttggacgtaggccaggtgtgaggaggagaggtgtgtttggggtggccactggctcccttcctgcgtgacgtaggctggcgtgggctcttcccccagccccttgccggtgctgccacgtgagaagggcccgggtgccgtcccgctattccggtagtgcctcccgaattcggtaccggctcgactcga

SEQ ID NO: 730815 - DNA, 467 bp, Homo sapiens
  misc_feature (1)..(1): n is a, c, g, or t
  misc_feature (59)..(59): n is a, c, g, or t
  misc_feature (235)..(235): n is a, c, g, or t
  misc_feature (241)..(241): n is a, c, g, or t
ntagaggtatcccaaccgactcctttgtgctctgtcctacggtgacacaggcggcgtgnggttagacaggtaccggtcagactacggtgacacaggcggcgtgcggttagacaggtaccggtcagattacggtggcacaggcggcgtggggttagacaggtaccggtcagattacggtggcacaggcggtgtggggttagacaggtaccggtcagattacggtggcacaggcggngtgggnttagacaggtaccggtcagattacggtggcacaggcggtgtggggttagacaggtaccggtcagattacggtggcacaggcggtgtggggttagacaggtaccggtcagattacggtggcacaggcggtgtggggttagacaggtaccggtcagattacggtggcaccggcggtgtggggttagacaggtaccggtcagattacggtgaccacagcggtcccgggt

SEQ ID NO: 730816 - DNA, 528 bp, Homo sapiens
tacttcacaggggggggggaccccggtacggacctgtgcagatgtatccatttttgcctcatgtattttgaagtgctgttattagaagtctggcaagttgatgagcagatagatcactacaaggaaagccaagacaaacttccttggcaagctgcattcataggcaaggaaacactgaaggatgaaagcggtcaagaatccagaacatgtagaaaaagcatttatctgagcacagaatttgattctgtaaggcaaagactccctaaatattattcgtgggaaaaggcattcaaaacatcatttaaactttcttggtcaaaatggaagctatgtaagaaagaaagatgatggatgtaaagcatattggaaagtatgcttccattataatcttcataaagctcaacctgcagagagattttttgaccctaatcaacgagggaaagccctccaccaaaagcaagcccttagaaaaagtcagagaagtcaaactggggagaaactctacaaatgtacctgtgatacctcgtc

SEQ ID NO: 730817 - DNA, 812 bp, Homo sapiens
ctggcatctatggtgtttatgaagtatctcctgtcattgtaattgtttcttttctctggtagcttttcacattttcttttgattcttgatgttctatcttacaaaagatgtgtcaaggtatgaatttactactttttgttttgttttgttttttgagatggagtctcactctgtggcccaggctggagtgcagtgctgcaatttcagctcactgcaacctccgcctcctaggttcaagcaattctcctgcctcagcctcccaagtagcagggattacagatgtgcaccaccatgctcggctagttttttgtatttttagtagagatggggtttcatcatgttgaccaggctggtctcaaactcctgacctcaagtgatccacccgcctcagcctcccaaaatgttgggattacaggcgtgagccaccatgcccggcctgaatttactattatttttcctgtttggtactcagtatttatgttaaggactcacattttttattagtaaaaatctaagttattatctcttcaaatattctttactattccttccattctcttcccctggaactcttttcagatgtgtgttgaaggctcttaattcatcctctttgtctttatattctttcatatttccctctttgtctcactaggaggaagaactcagtactggtttctaatttactaaaacctctgtatcgtctctactggttaaatctattagcaaaaactattttaatttctaatcgtttgtttacagtattactaatgggttttgttaattttatactactctgttttcatttccctatc

SEQ ID NO: 730818 - DNA, 429 bp, Homo sapiens
gaaggcaacaggggaacacacatggccagagtaggagagagacagagagcagggaggtttaaacaatcagatctcatgagaactcactaactatatagtagcaaggggagatggggctaaaccattcatgagaactccactcctatgatccaatcacgttccaccaggcccctcctccaacactggggattacaattaaatgtaagatttgggcagggacacaaacacaaaccatatcagagtatgttgaaccatccttgcatccctgggatgaatcccacttgattacaatgaatgatcttttaaatatgtagttgaatttggtttaaggattttgcatctctgttcaaagatactggcctgtagttttctttttttgttgcgtctttgtctggttttggtaccagggaaatactggccctgtgaaat

SEQ ID NO: 730819 - DNA, 598 bp, Homo sapiens
agactcactttccacagggcacatcagttcagaatactgccaaaaataagttttacaaagcttctgcaagttagaaagaaagagagagggagaagaagccacgtggaaagcagcaggattcagaatggctttgtacttctcaacactagccctggaatccagaagaccatggagcaatgccttccaaattgtgaagaaaaattacttccaaccttgagttcaatactcagccataaattggaggggaggtagaactaaaacacttttagaaatgtaaggtctcaaaagatgtgcttttcgtgcacactttctcaggaagctattgaagatgccctgtattagtctgttttcatgctgctgataaaagacatacctgagactgagaagaaaaagagatttaattggacttctagttccacatggctggggaggcctctgaatcatggcaggaggtgaaaggcacttcttacatggcagccacaagagaaaaatgaggaagaacaaaaagcggaaaccctgataaacccatcagatctcatgagatttattcactatcacaggaatagaacaggcccctttgattcaattacttcccccg

SEQ ID NO: 730820 - DNA, 438 bp, Homo sapiens; identical to SEQ ID NO: 728698
  misc_feature (72)..(72): n is a, c, g, or t

SEQ ID NO: 730821 - DNA, 642 bp, Homo sapiens; identical to SEQ ID NO: 112778

SEQ ID NO: 730822 - DNA, 752 bp, Homo sapiens
ccactgcccggtggcagaacatccaggcatccgagtcagtggggagtgggaaaacggaggggtggagtagaagagagggaggaggttggggaaagaggggacccagtggtcttccgcggaggggaggggagctcttcccagccgagtcccctcctccttctcttatcaggcaaacccacttcctaggcgcggaagcaactttccttcaccttgaccaggctgaagccgtcgcatctaattgggactcttggcagaagcacggacctcctggcatcctctccttttcattctttcctccctctctcgttcttttccctcccccaccctccctcttataagggtatatctgcagagtcttcagtgagccagggtacctagacgagaggatttttatacgaaaagccagggtagatttgccgactgctttgcctcactctgaaatccttaggcagtgcatgcaaaggtcggtgaatttcggagtggggtgaaggggcatggggcggtagggagggtggcggctccaactttaaagctctgctagagcgcttggctttcaggtaagcagggactaacagtccttacaagaactctcctgtggtccctgggcagggggctgaccgcatgccagaggagattaggagagcgggagcagagagggagtgtgagagccagggaggccggtacgcagctcagccgtactcgcgactcaactgcacactgcgagcccctggagagggtttgtgcagaacaat

SEQ ID NO: 730823 - DNA, 671 bp, Homo sapiens
ccactgcccggtggcagaacatccaggcatccgagtcagtggggagtgggaaaacggaggggtggagtagaagagagggaggaggttggggaaagaggggacccagtggtcttccgcggaggggaggggagctcttcccagccgagtcccctcctccttctcttatcaggcaaacccacttcctaggcgcggaagcaactttccttcaccttgaccaggctgaagccgtcgcatctaattgggactcttggcagaagcacggacctcctggcatcctctccttttcattctttcctccctctctcgttcttttccctcccccaccctccctcttataagggtatatctgcagagtcttcagtgagccagggtacctagacgagaggatttttatacgaaaagccagggtagatttgccgactgctttgcctcactctgaaatccttaggcagtgcatgcaaaggtcggtgaatttcggagtggggtgaaggggcatggggcggtagggagggtggcggctccaactttaaagctctgctagagcgcttggctttcagttacggaggctgggaagtacaagatcaagttgctggcagatctggtgtctgtagtaacaaattggaagcacttatgttagaactgaagagaaaatatggaaaaacttaaacatg

SEQ ID NO: 730824 - DNA, 739 bp, Homo sapiens; identical to SEQ ID NO: 728700

SEQ ID NO: 730825 - DNA, 486 bp, Homo sapiens
ttccaggtaaccaaacatggtacaggggactgaatttgtacatttaggtaacggggaaaataaaaatactacaacataaactaagagaaactttcaaaagcaatgttcaacttacctttagaaaaatgctctactgaaataaaatcaattgacatatcctctgtttttcatactaattcctctggcccaaacctctctcttgagctctagaattgaacaaagtacctccatgacatctccattggactatgtcaaaatctcctcgtctttatcacgtctaacaccacactcaccgccaaagcaacttgcattgtctcttgtttcaggcaacgcccccaacatgaagatatttgtgcatccagaaatctaaacattcctctgagacctcctaatcccttcagcaaatcctgaccctctacctcaatcactcctgaaacctgctaaatttcctccatctctgtggccactcctgcctgtggaaaagta

SEQ ID NO: 730826 - DNA, 554 bp, Homo sapiens; identical to SEQ ID NO: 122762

SEQ ID NO: 730827 - DNA, 510 bp, Homo sapiens; identical to SEQ ID NO: 126147

SEQ ID NO: 730828 - DNA, 235 bp, Homo sapiens
ctgcaacagtgggagggaagagccagatgcaaactcgttctgcgagcccgaggttccgttctcatgatccttgctgtgatttctcttttgatgttggcaattttaaaatgacatcagtctatctggacctttttcctaaggctcttgctcagaccactcagtagatagccgccacctgcccagtgaggtgaatcaggcccattaggccatttgtcaggggtgggtggagagcggc

SEQ ID NO: 730829 - DNA, 751 bp, Homo sapiens
cccagatttcaacatattgttttcagaaagtgttctttctaatgatgaatgctgatgattactagaaattaaacatttattcagttgtgctaaatggatgaccaagcatcttttaaacgacaacatgcatgagctctttccctcatttagaatttgatttggaggatcagcggtccttgatattggaaccatcttaatccaaaacacagtaaaagcaccaaggacaagcaccggtgccaccgccgggctggaagaatcacccacaagagcggatgccctcacagctgggctcctgaggcccagggcccggaccctctcaccatcttctagcttgtctacgatcgaggcaaaagagtgagatgcctaaaggggtgtgctgtgagcatccacagcctacgggaagccctgttatttatcctccatctctgccttccaaggctccaggcatcctttccacccttaccacctaccaaaggaaggtgttcagaaagaaatggctgcttgactatctggttttcataacctcctctacagtcttcaagtatgtgtatataacatggaagaggcttaaacagtgcgtgtgctgaaaaagactgccactagtgtcaccacgaaaggaaactactttatttctcctcaagcttcaggtgtgtgctgatcaattaaactgactttaattatttattcctgattctaacctatggtgaatttaatcaatttcagcagattacctgccctcgtgcctgttgaa

SEQ ID NO: 730830 - DNA, 548 bp, Homo sapiens
agaagttgtaaacatgggcaagagtagagttgacatggctctgtggacaggtggcaggaaagggtgagaagatagctgaatgtactgtgggtaagtggcatatgagataatcttcgtaactgccttgggtgagcccgctgagggtcccagtggaaggtgctgagtgggcaggcaggactcaagctgctgtcttcccatagtgccttgcagttcctgccctggatttctggtgggaagtccagaaggccctgggagggaaagcagcgaattaacaatatgggaagcattagaggaaatctcctccattgcctcctctcctggctcgacatgctgcctacataatacccatgtatttgccaaaggttgagccaagccagggccctttcttttcacagacttatacagctgtttcactatagagccaggctaaataaacaattctttttcatttcctgcctttctcctgaggacttggtgctgtagatgacagtttctttctttcctatagtgtcttcacagggctaaatatgggaataggcattgtgttc

SEQ ID NO: 730831 - DNA, 518 bp, Homo sapiens
atgccatagctgactcctgaggataaaactacttcagcgagagagggaacaataggccaggcgtgaaccaaaactaaggaagagggggtttcaagagggagggagtgtcaacgctatcgaaaaaatcagataagaacaaaactggccattggatttggcaagacggagatcaaacgaagagcctttcagtaaagcaatgaagacgtatgtttcccacgtgggatgagtgaaagtgagaacaggaggtagggctgtggagcctacagaacagccatttctttcaaggagtttttatagaaaggggcagagagaaggcaaagtagctgaagacaaatatgggctcaaagaaggtctgctcattttttctttcttttcgttcacaaggaggatgttgcaacatgctaggcaatgctggggataattctgtattgaggggaagtgctgatcagggaagaagggatgggatctaaggcacaagttgaggggatggcagccttacacacgagcagggacaggaa

SEQ ID NO: 730832 - DNA, 878 bp, Homo sapiens
ctgtacaatgacttaagtaatggactaggaaacctagcccaatctagctctgcctctcactgaatgggtgagtctgggaaggccgtgctctgctgagctacacaggtaactcagcttggactagggggctggcatagtgatgaagaatatagtcagagatgtgatttattatggaaaaagaatcaacaggactcaataaatagatgtatcactggcatccagctcaaatgccacgttctcagaccctccctgaccaacctaaggtaggactcccctacacctacaagttcactctttatctcatttcatatccattcaaatcctggtttcgtgttactgacggctcttatttgaaagactccaatttatttccttacgtgtttgttgtttgttttcccctaccttctttgttctgttgttgatttaaatactgtgaggactaagggagaagactaagtcaaggacgatcccccaagtttctggtttgggcaactgggtggaagatagtgccattcactgagatggggaacagatttgggactgacagagggaagatgatgagctctgttcagggtacctacctgatgtaaggtacctgtggggcattgagaaagagatattagtaaatgactggatgcgaaggaagcactgctctggattggtgacttgtagagagggtaactgaagccacagggttcatactaagaaagtagagaacaagaagactagagcacctaggatacagctctgaggaacagcaacatttgaaagaccaagaaaagccatgaaaaaccagagcaggtccgggaaagaacaggatcccttgggcagaaaagacccacagagtcctactctgcatgcatttgccacgaggattg

SEQ ID NO: 730833 - DNA, 557 bp, Homo sapiens
aaggaaacagggataatgcagggagcagaataacacagaaagacactataattaacatgctcagagaaaaaatatttcacctatgaaacaaaaccaattagaaaaaaggaagaaagaatcagataatgcacttggaaataaaaatatgacagcagagataaaaacattcacaacatttaatagtagagctggaagataaagttgaagaaatcttcaagaaagcaggaaaaatcaaagacatggatagagtggcccaggaatccacctctccacctagataataattacatcggcagaaagttcctaaagtgattattttgggagcacatgagtccatctgaacacttgtagcttctaggggaaattctgagtggtaaattgcagttaacattggtggatttcagccttcagtgaagtagcagctacccatccccacccactccatggcaggcagctgtggagacacaaccccacatttctgggtcagcttgctgcagccagggtggacaataatagccacttcctccaaatatcagggttctgattgcagatatcta

SEQ ID NO: 730834 - DNA, 732 bp, Homo sapiens
tctttttcccagagcataagttttaaattttgatgaagtctgatttaccacattttttcttttacacatttggtgttcatctaacaactttacctaacccagaccttgccagactttttctgtaaaaggtcagatagtaaatatttcagccttgctgtccctgttgcagctctgccattgtagcaatgaaagcagccatagacaatatgtaaatgaataatagctgttccaataaaactttatgaatactgcagtttgaatttcacataatttacaaattatcaattatattgttttgattattacaaaaacaggtagtggattggccatggtttgctgattcctggcctgacaaacccaagttcacaaagagtttcctctttgattttgttgtggtcgttgttccacaccttcttttttcactgtttccttaaggtagagtgtacatatttataagggtacatgtaatattttgatagattcatacagtgtgtaatgatcaaatcaggttaattagggtatccatcatctcagatgtttatccttttctttttgtattgggaagataacaaatgttctagctattttaaaatatacactaagttattgttgactctagtcaccctactgtgcaaacaaaaactaaaacgtattccttctatctgactgaatttttatgcccatgaatcaacttgtcttcatccctacctgcttcccagcccccggtaacca

SEQ ID NO: 730835 - DNA, 376 bp, Homo sapiens
  misc_feature (1)..(1): n is a, c, g, or t
  misc_feature (18)..(19): n is a, c, g, or t
  misc_feature (23)..(23): n is a, c, g, or t
ntgctagaggatcctccnngggncccttaaccctttaaggtgaaatacaccatctaaatgtaaatataaatgatacttcctcaacataagtttcttcttatactatttcaataaatctcagatctgcttttattctttctcttccatgccaccaataccacttttcttcttaattttactgttagatatgttgtttttggaagaagtatagagggaatggtagtaaagagagagtgctttaggattcaatacattcttttgaacagtaacatttagagaatctgtactccatagtggtatcactgcacatttttaagagcatcttgtatctagaacagataaggaattcatgtgacgtaagaaaaggtgtcactgt

SEQ ID NO: 730836 - DNA, 683 bp, Homo sapiens
  misc_feature (81)..(81): n is a, c, g, or t
  misc_feature (581)..(581): n is a, c, g, or t
  misc_feature (670)..(670): n is a, c, g, or t
  misc_feature (680)..(680): n is a, c, g, or t
aagagggaggtgtcgttagtcatctccacagcaatattccaggaccattaagtttttagaagaaataaagtgtgacccaanaatattatatacagccaagatacagttcaaaaattaaggcaaaaggaaatgttctccattatgaaagaaatcagagaacacaagtcctaagaacttattattgaaaaaagtgaataaaattcagccaatttaagagtaacaatgaacttactggaatagctgtggtaaaaagactaatagtgagcagctaacgaacttaaatacaaaacaaatgcctacacaactatgaggattatgtttacataagagaatgtcactacctgaaaaaatagaaatgtcttcaaaaacaaacaaccctgtcagggcgcggtggctcacacctgtaaccccagcactttggaattttctagctgttctcctcattcttaagaggtattcccttcctgcctttagatgctcaagtgttagaccatgatcctcagaacaactgcagtgtcctggcaaccatgactgcaaaagccaaaaaaatcacatgaaagtcaacaatgctctgccacagntgaattggctactgttaaattaaccaatcttagaaaagcctagcatctgatcttacatgaagtaataaatttccaattgcttcagccantctgatttgncct

SEQ ID NO: 730837 - DNA, 881 bp, Homo sapiens
agcggagttcctcatctggactcactgggagaagtgattcactagaattctcattggaagaaatgacaggaaagctccctccaatatctcaatttccaccccactcagtacctggttttatgattccacaccctcctaatccatcctgccctcctaacacatcccactctcgtaagccatcccactctcgtgcccgcgaatccctccctcttcttccatctgccaagccccttcctcctctccagaagtacgtggatttttcagttttctgccctaactgttatcccactgtggctcatacctgccctccccactaccctaccctaatactctacctgcactgctcttctgctattcattacaaaccatccatttgtcaatgctctagtcccagaactctttctggtaactcccttatcgatcaccctagccctccttctagccctactggtcaacgcttgggtcccagaactcttccctgtgattcccttatccgttctcctgttcctcctcctagccctccttgccaacgctctggtcccagaactcttttctgtgactaccctgtctgtccccctactcctcctcccagccctacttgcaaatgctgtcgtcccagagctgtttcctgggactcctctacctatgcctctacccctcctccttagccctacttctttctagtaccctgtactctaagtccccagcccccagcctgcatccccaaccagaccttatggttcacaagtctcatcttggagaaggtttccctggtcccggggcagttctggaacagttcaggatggccaggactgtggattcccagcagtctgacctcgtggacaaaggaaatgcaagacgatggcaaaccagcattcagc

SEQ ID NO: 730838 - DNA, 879 bp, Homo sapiens
  misc_feature (723)..(723): n is a, c, g, or t
  misc_feature (728)..(728): n is a, c, g, or t
  misc_feature (744)..(744): n is a, c, g, or t
  misc_feature (749)..(749): n is a, c, g, or t
  misc_feature (752)..(752): n is a, c, g, or t
  misc_feature (760)..(760): n is a, c, g, or t
  misc_feature (762)..(762): n is a, c, g, or t
  misc_feature (765)..(765): n is a, c, g, or t
  misc_feature (768)..(768): n is a, c, g, or t
  misc_feature (777)..(777): n is a, c, g, or t
  misc_feature (779)..(779): n is a, c, g, or t
  misc_feature (782)..(782): n is a, c, g, or t
  misc_feature (799)..(799): n is a, c, g, or t
  misc_feature (810)..(810): n is a, c, g, or t
  misc_feature (813)..(814): n is a, c, g, or t
  misc_feature (825)..(825): n is a, c, g, or t
  misc_feature (841)..(841): n is a, c, g, or t
  misc_feature (844)..(844): n is a, c, g, or t
  misc_feature (846)..(846): n is a, c, g, or t
tgagcggactttgcgaggaggagcgcgcgggctgcgggcggctggggcaccgcgggagcggcggcggcggctctagcagaggcggccggggcagcgaaaggttctctctccagggctggacttaataactttgaaactgtccaccggtgtcacgtcctgaacatgagcctcctcctctccttctacctgctggggttgcttgtcagtagcgggcaagctcttcttcaagtgacaatttcacttagcaaagtagagcttagtgttggagaatctaaattcttcacatgtacagcgattggtgaacctgaaagtatagattggtataatcctcaaggagagaagataatttcaacacagagggtagtagtgcaaaaggaaggtgttaggtcacggttaaccatctacaatgcaaatatagaagatgcagggatatatcgttgtcaagcaacagatgccaaaggacaaacacaagaagctacagtagttttggaaatttaccaaaaactcactttcagagaagtggtatctccacaagaattaaaacaaggagaagatgcagaagtggtttgccgagttagcagttcacctgcacctgctgtcagctggttgtatcataatgaggaagtcaccactatttccgacaatcggttcgctatgttagcaaacaataacctgcagattctcaacatcaataaaagtgatgaaggtatatacagatgtgangaacnagtggcggccgggganaaatngantcccggananccntgnatgtcaggnangcngaatacttgccctgttnatgctccttancanngtttttaaggnaccgtgacccaaacanttntntaaccttttccgaaaaaaccccgggccgaagga

SEQ ID NO: 730839 - DNA, 850 bp, Homo sapiens
  misc_feature (835)..(835): n is a, c, g, or t
  misc_feature (837)..(838): n is a, c, g, or t
  misc_feature (841)..(841): n is a, c, g, or t
tgagcggactttgcgaggaggagcgcgcgggctgcgggcggctggggcaccgcgggagcggcggcggcggctctagcagaggcggccggggcagcgaaaggttctctctccagggctggacttaataactttgaaactgtccaccggtgtcacgtcctgaacatgagcctcctcctctccttctacctgctggggttgcttgtcagtagcgggcaagctcttcttcaagtgacaatttcacttagcaaagtagagcttagtgttggagaatctaaattcttcacatgtacagcgattggtgaacctgaaagtatagattggtataatcctcaaggagagaagataatttcaacacagagggtagtagtgcaaaaggaaggtgttaggtcacggttaaccatctacaatgcaaatatagaagatgcagggatatatcgttgtcaagcaacagatgccaaaggacaaacacaagaagctacagtagttttggaaatttaccaaaaactcactttcagagaagtggtatctccacaagaattaaaacaaggagaagatgcagaagtggtttgccgagttagcagttcacctgcacctgctgtcagctggttgtatcataatgaggaagtcaccactatttccgacaatcggttcgctatgttagcaaacaataacctgcagattctcaacatcaataaaagtgatgaaggtatatacagatgtgaaggaagagtggaggccaggggagaaattgacttccgtgatatcattgttattgttaatggtaagcagtaaataatttgtacatgttttatggattcattttagcaatgtaacntnntgnatggcaacc

SEQ ID NO: 730840 - DNA, 713 bp, Homo sapiens
cgctcgtgctgttgctggaaagcgagctcgctgtagaccggccgcgacaccatgtagctgcagctgtactcggggagctgcggcggctccgacctgccgcctggcgctgccatgacctgcgagccagaggacagcgaggagggaggacacgcggtaagcgaggacgatcggaggggaagagcgaggaacagaaagaacgggatcacctgttagctgcagccaggcccccctgcaccgcgagtctggtccgcgtcctgcagccctcggcgctcgcgacaagcgccccacggcgcgcacggccagcctgcaggggggcacctgagaaccttcgggtctcgtggcctgcacccgctgcccggggttccccaaacttgaagcgagtaagcccctgctctgggggcttcccgagttccacccagtcccctatggcccgcagccagggcgctgtccgcgttctgaaatctcccccaaaccgaggggctggggcaggggccaaaggcgcttgcaaggctggaaggggacactgagattccctccctccccgcacctgacccgggacgcagctccaggtgcgcactggaggagaggtgcagacccccgggccaggcgtggaaccgtcagggcgcgctccgcgggtccccaagaggcggacgctgcaggcacattccagcagctgtcgcagccctctcgggggcagaactttcagcttattg

SEQ ID NO: 730841 - DNA, 687 bp, Homo sapiens
cgctcgtgctgttgctggaaagcgagctcgctgtagaccggccgcgacaccatgtagctgcagctgtactcggggagctgcggcggctccgacctgccgcctggcgctgccatgacctgcgagccagaggacagcgaggagggaggacacgcgggaaggaataaactggactacatggaaatcaagactagaagagagggaggaggagctggagctatcctacctcatcagtgttttgtcttctgttgggatgaactttgttaaaactaatgcatggttaagatgaaaggcagaaggaagggtttgataaaccagaacattctcgcctgattgttagtgttctgaagtaaatacagaagaggctccaaaatacagacctctgtacatcaaccttccgtaatccacctgccttgcatatgcagaccatgacaattctacgagctcctggaaacagaactcagaacgcctccccagagaaccctgatgcaaattctctgaaatggtagtcagcatgtgcgttttcctgagaagtgaatgagtcaacagctttcaacagatcttcaaaggcttacttcacccaatgaagttaagaaccactaaagaagaaacctaaaaggaaaatccaggtcatgaactttgcaatttttattcacatacagagaagaggggaggaatctcttgtgtatg

SEQ ID NO: 730842 - DNA, 720 bp, Homo sapiens
agccatgtttccaaggaggtctgtacaaaaagccagacttctgctggcagttactgagagagataggctttccatccatggcagccatttactttgctctgggagacgttgtaatagaaaaggcacaactggggtatttattcattccccccgttcctctagtgtttggtggcgttgccgttgcaagtgcgcagggctaaaatgaactggttatcttaggatcatggaaaacctggaatcaaggctcaagaatgccccctattttcgttgtgagaagggaaccgattccatccctctatgccggaagtgtgagacgtgtgtcttagcctggaagatcttctctaccaaagagtggttctgcaggatcaatgacatatcacagaggaggtttctagttggcattctgaagcagttaaatagcttatatttgttacactatttccaaaatatccttcagaccacacagggaaaggatttcatctataacaggtcccggatcaacctcagcaagaaacgaggggaacagttgtgaagtcctccttgaaccaaatgttggataaaacagtagaacagaagatgaaagagatcttgtactggtttgcgaacagcacccagtggaccaaggcgaattatactctcttactgctgcagatgtgcaaccccaaattactgctcactgctgccaatgtgatcagagtcctgtttctgagagaggagaac

SEQ ID NO: 730843 - DNA, 863 bp, Homo sapiens
agggagaagtcctgtagggagatgggcagttaccttctctccgtctctctctcggggactctatttgtggctggtggagctgtcttaaacgaagagaaccatgagcaatgaatcttgtttaccttattacacagcccacagctactcttcaatgagtgcgttcaaaacctccatgggggacctgcaacgacaattgtacaacagaggagagtacaacattttcaagtatgcaccaatgttcgagagtaattttattcagataaacaaaaagggagaggtgattgatgtacacaaccgtgtccgaatggtgacagtgggcatcgtctgcaccagccccatcctcccactgcctgacgtcatggttctggcccaaccaactaaaatctgtgaacagcatgtcagatggggccggtttgccaaggggagaggtcgcaggcccgtcaagactctagagctcacgagactgcttcccttgaaatttgtgaagatctccatccacgatcatgagaaacagcagctgcgcctgaaactcgccactggccgtactttttatctgcagttgtgtccctcttctgacacacgggaagatctcttttgctattgggaaaaacttgtctatctcctgaggccaccagtagagagttactgcagtaccccaacacttctatctggggacgcaccacccgaagacaacaaaagcctagtggctgcagagctccacagagaagggcgatcacgagtggaggaccgggctcaacaaggcttgctgatgtatctggcggcaccgtcttctgcatatgcgggggaaagggaacccaatgccccccggaacagggaagggggtctccacccgaacctcaggg

SEQ ID NO: 730844 - DNA, 810 bp, Homo sapiens
agcggagtagcgggccgtcggttgggcgcagacaggccgcagaagatggagagatggagccaccccaagagacaaataggcctttcagcacacttgataaccgcagcgggcaggtccaagtcctgtccgccaccccgctattgcagaggaatccctacagcagcccggatatcatgcacattaaagggtcggaggcttcttcggtcccttacgccctgaaccagggcacgacggccctgcctaagaacaagaaccaggagggcaccgggcaccggctgctgaacatgctgagaaaaactcttaaagagtctgatagtgaagaactggaaataacacaggagacaccaaatttggtgccatttggggatgtggttggctgcctgggcattcatataaagaactgcagacattttatgcctaagatcagtttacaacattatgctaatttattcattcgcatctctataaacaaagctgtgaaatgtacaaaaatgtgtagcttgctatccaaaaacgatgagaagaacactgtaattaagttcgatgaagtgaagtatttttctgtacaggttcccagacgttatgatgataagcggaataatattttattggaactcatacaatatgacaatagagaaaaacgtgctttcttgttagggagtgttcagatacatctttatgaggtaattcagaaagggtgcttcattgaagaggtccaagtgttgcatggaaacatatttgtctgcaggctggaggtggaatttatgttctcctatggaaactttggttatggattttcacatcaggtta

SEQ ID NO: 730845 - DNA, 509 bp, Homo sapiens
  misc_feature (29)..(29): n is a, c, g, or t
  misc_feature (31)..(31): n is a, c, g, or t
  misc_feature (410)..(410): n is a, c, g, or t
  misc_feature (416)..(416): n is a, c, g, or t
  misc_feature (445)..(445): n is a, c, g, or t
  misc_feature (463)..(463): n is a, c, g, or t
tggtgatctagaggtctcggctcccactngntgcatatggaaccaaactgactacagaatatttgagcttaacaaacggttcagaactggacagaggagtgtgacaatctctggtgggatgcattcacgactgagttctttgaggatgatgccatgttgaccatcactttctgcctggaggatggaccaaagagatataccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtcagcaacccagctggatgtggaacaccatggcaccngggttngattcccatcctctctcccagtgtatacncacagctgttccccaggnaggcataatgtgaactgtcaaaataagaagggcgggtaggcatgtt

SEQ ID NO: 730846 - DNA, 1206 bp, Homo sapiens
  misc_feature (440)..(440): n is a, c, g, or t
  misc_feature (468)..(469): n is a, c, g, or t
  misc_feature (505)..(506): n is a, c, g, or t
  misc_feature (514)..(514): n is a, c, g, or t
  misc_feature (527)..(527): n is a, c, g, or t
  misc_feature (815)..(815): n is a, c, g, or t
aggatccttgctccacttggttgcatatgatgtgggccaactcccaatgtatccgctacatacctggagccagggattgggaggcacacaccatatggaaccaaactgactacagaatatttgagcttaacaaacggttcagaactggacagaggagtgtgacaatctctggtgggatgcattcacgactgagttctttgaggatgatgccatgttgaccatcactttctgcctggaggatggaccaaagagatataccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtgtgtgtgnagggccggttgtacctggagttcatgtnngacgacatgatgcggataaagacgtggcacttcagnntccggcancaccgagagctcntccctcgcgtagcatccttgccatgcgtgcccaagatccccagatgttggatcgagctctccagataaacatcgactcggatgtgggctgtccgaattccactctcaactacctccgactctgtgtgatactcgagcccatgcaagagctcatgtcacgccatcaagagcctacagcctcagcccccgcgactggctcgagacctggcttttcccgaagtggcagcgcatggtagcaccctgcggagccaacgtcagcagccagcaaaggcggaaacggacgattccnggggcagaccatgagctctggtggggcaactcaacaaaggaccagtcagaaaagagcccgtaaacatttggcccttcagcccgattttgatgtggggaaacccctgtatggcggggagaccgtgagcaacgacaaagggcgttcacccggtgggagaacacccaagttggttgacaacagcgctgtgaaagagaggagcattaaaaacccctcatgtggggcaaccctgagaagaaagcggctacgaatagaacagggcgacctaggtcccaagcgggggggaaagcgatagccaaacatcacgaggagaggaacatagatctcaccgcaggacgaacagatccgggacacctcgacgagagaacgcactgggtcacacggtaagatgagc

SEQ ID NO: 730847 - DNA, 736 bp, Homo sapiens; identical to SEQ ID NO: 728702

SEQ ID NO: 730848 - DNA, 378 bp, Homo sapiens
  misc_feature (13)..(13): n is a, c, g, or t
  misc_feature (15)..(15): n is a, c, g, or t
acatacctacttnantattatataacttttaatatacagatggtcccgacctatgatggttcaacttatgatttttcaagtttactatgagtttagtgggatatgaaatgcattttctttctttttttttttggagacagagtctcgctccgttgcccaggctggagtgcagtggcaccatcttggctcactgcaacctctgcctaccgggttcaagtgattctcctgcctcagcctcccgagggcagctggattacagccatgagcccttgtgtcccgcctaaaaagttgtttaaaagaagtttggactctgaagcctaacagaccagggtttgaactctggttcctgtcattcactacctgtgtgactccagacaa

SEQ ID NO: 730849 - DNA, 480 bp, Homo sapiens; identical to SEQ ID NO: 393738

SEQ ID NO: 730850 - DNA, 1017 bp, Homo sapiens; identical to SEQ ID NO: 338967

SEQ ID NO: 730851 - DNA, 524 bp, Homo sapiens
agcctggaatgtcacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacccttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttggttcaggatccttccctgga

SEQ ID NO: 730852 - DNA, 604 bp, Homo sapiens
gtgaaaggaggcgcttcggctgctggatgtgtggaccctggagtgaaaggaggcgcttcggctgctggatgtgtggaccctggagagaaaggaggcgcttcggctgctggatgtgtggaccctggagtgaaaggaggcgcttcggctgctggatgtgtggaccctggattgaaaggaggcgcttcggctgctggatgtgtggaccctggagtgaaaagaggcgcttcggctgctggatgtgtggaccctggagtgaaaggaggcgcttcggctgctggatgtgtggaccctggagtgaaaggaggcgcttcggctgctggatgcctggaccctggagtgaaaggaggcactttggctgtgcagacctgctccattctcctccgcgtccacagcgcagaagaacaccagcttccatttctaaaaccattatttaaaagtcaagttcttttggtataatgtgcctaatgtgtttggctttctctaggtcaccatttaacatcttactctgcaacactacggtcctagttaagaccaaattcacagccaccaggtatctttacaaattaaccaagattggccaggcgcagtggctcatgcctgtaat

SEQ ID NO: 730853 - DNA, 343 bp, Homo sapiens; identical to SEQ ID NO: 118740

SEQ ID NO: 730854 - DNA, 168 bp, Homo sapiens; identical to SEQ ID NO: 518077
  misc_feature (145)..(145): n is a, c, g, or t

SEQ ID NO: 730855 - DNA, 608 bp, Homo sapiens
  misc_feature (324)..(329): n is a, c, g, or t
  misc_feature (331)..(331): n is a, c, g, or t
  misc_feature (585)..(585): n is a, c, g, or t
catactgatgatatctttgtaaaagaacactgacatctcacgtaattctcattgtatcacacttccttcaatcccgcccatgtttaattggtcgggaccaaatattcctcgagccttccattagggcatatatacttattcatgatgctgttaccactcccagcctgctgttaccactcccagttacattattttaccgtacggtgattccttctgaaccccactcttatttgttggcctactacatgccactcaagagggattcaaagatgagtgcgtggtcccggaagatgcagatgtggggtaccacagagaaagtgattnnnnnncnctagcggggaacaatcacttagttcaagtgattgttcaagtgattgttcaagtgattgttcaagtgattgttcaagtgattgttcaagtgattgttcaagtgattgttcaagtgattgttcaagtgatggttcaagtgattgttcaagtgattgttcaagtgattgttcaagtgattgttcaagtgattgttcaagtgattgttcaagtgattgttcaagtgattgttcaagtgattgttcaagtgattgttcnggatcctcagagtcaccgcagca

SEQ ID NO: 730856 - DNA, 524 bp, Homo sapiens
  misc_feature (324)..(329): n is a, c, g, or t
  misc_feature (331)..(331): n is a, c, g, or t
  misc_feature (492)..(492): n is a, c, g, or t
  misc_feature (512)..(512): n is a, c, g, or t
catactgatgatatctttgtaaaagaacactgacatctcacgtaattctcattgtatcacacttccttcaatcccgcccatgtttaattggtcgggaccaaatattcctcgagccttccattagggcatatatacttattcatgatgctgttaccactcccagcctgctgttaccactcccagttacattattttaccgtacggtgattccttctgaaccccactcttatttgttggcctactacatgccactcaagagggattcaaagatgagtgcgtggtcccggaagatgcagatgtggggtaccacagagaaagtgattnnnnnncnctagcggggaacaatcacttagttcaagtgattgttcaagtgattgttcaagtgattgttcaagtgattgttcaagtgattgttcaagtgattgttcaagtgattgttcaagtgattgttcaagtgatggttcaagtgattgttcaagtgattgttccccnctgggatccttagatcaccncagcacagcatg

SEQ ID NO: 730857 - DNA, 929 bp, Homo sapiens
  misc_feature (324)..(329): n is a, c, g, or t
  misc_feature (331)..(331): n is a, c, g, or t
catactgatgatatctttgtaaaagaacactgacatctcacgtaattctcattgtatcacacttccttcaatcccgcccatgtttaattggtcgggaccaaatattcctcgagccttccattagggcatatatacttattcatgatgctgttaccactcccagcctgctgttaccactcccagttacattattttaccgtacggtgattccttctgaaccccactcttatttgttggcctactacatgccactcaagagggattcaaagatgagtgcgtggtcccggaagatgcagatgtggggtaccacagagaaagtgattnnnnnncnctagcggggaacaatcacttagttcaagtgattgttcaagtgattgttcaagtgattgttcaagtgattgttcaagtgattgttcaagtgattgttcaagtgattgttcaagtgattgtttccccgctagcggggaacaatcacttatccaaatgtcactatgcatcaatgagatgcctaagtgtgtaacagaacaattaaactcagccgtgtctggtgtatcaccagctttcaatctcatgaaatagtcaattcccacatgatttacattttgccatcatgaagggatgtctgtgaaagcagaagaaactatgatctaatgtgctagcggggtgtgtacctaactttcaaatagggaacacgtcatgtgggcttccgctggttgctccttgcccagaccccaaatagtagggaccggctgacaaagaggtgggcactgagggatgtgtggcctgtacccgacctccaaggtcacggcagagcccacgctcaaaggggtctccaaagaggcaatgagctgggacgctcccatggtgccaggaggaagcagctatttctcccaggacagggcagacttcatgctatcactcacgagagt

SEQ ID NO: 730858 - DNA, 861 bp, Homo sapiens
tagctcccttcttgacagatttctgctcccctgaggcaactacttgttggaggccaaaagaatgagggtcatgatcaactcagtataccactggaggttatatgagtaagcagcaaactgtttttcataaatgcagaatgttggcaaactgacagactgcgtatgccacccagaaggaatgctgaaggcagtcatgcccaaagcacagtgtttcttgtgattaggtacatctgaagcctgttagtaacaatatgaacctgtgatcaattaagcagctgaccaatccttacctccttctccctgctcttgttacccaataaatatgaagggctgtggaagctcaggggctgcctttgctcactagaagcagggagctcttttcttcttcccctggcccttcctttaaaacagttccttttgtttttttgttatttccatgtttgtcccttccttcagtctcgtaatgacggtctcaagtagtaacagtagtaactgttgtagtgaaggtctcaagtagtaactgtggcaatgtgccacaagtggcgcccgaacagggactatcagtgacaaacagagacctgaagagacctgaagggacctgaggaggcctacagggacacatagagataagtagggataaatagagatagagacagatagggaaagatagggacttgcaccaacttggaggaactaacagggaccgtagagacagacagggacagacagggatagataaagactagcaaatactagcagagactagcaaagactagcagagaccagcagaagctagcagaaacttgcagggacagacagggacagatagagacagggtcctataggaactcgtcagaggtg

SEQ ID NO: 730859 - DNA, 230 bp, Homo sapiens
gactcgtattatctgtttaaaccacacagctaccctgtgaggcaatatctatcttaagtccttttttcacagatgaggaaattgaggctcagagagatgacatctcttgtccaaagtcgtagctaataaatagtaaactggaaaatggaggcgcagccccagggctgcctcccactaaagcccattctcgcaactctttcactgtcgactctgttgctttctctttccca

SEQ ID NO: 730860 - DNA, 486 bp, Homo sapiens
aatcaggaagagagtaaacggtctgcaggagaaatggggagaaagattcagagagggaaaacaattaatatagcgtaacaagagagcaaaagagcaaagggggaggagaaactaggaaaatcatatatgggctctcacctatttccaaagctgggctaatgtcctttggcttgtgtctgaataaggcaccaattttaagctgctaatgaaaaaaaaagaaaaagagaaagaagcaggcccaggctgggcgcagtggctcatgcctgtaatcccagcacttggggaggccaaggtgggcagatcacctgaggtcaggagttcgagaccagcctgctcgacatggcgaaaccctgtctctactaaaaatgcaaaaaaagtagctgggcgtggtggcggacacctgtaatcccagctacttgggaggctgagggaggagaatcagttgaacccaggaggtggaggttgcaatgagccaagatcgcgcca

SEQ ID NO: 730861 - DNA, 610 bp, Homo sapiens
gttcttatctccccaccatcccatcctggggccctttcagtgactcctgatggcaagtggctgttctcattgtcctggcttccccttgagactggggatgaggaaaatcaaacagcaaagaccatatcctgggtgtcctgagtgtttacagcaggccatgtactagggattaacataaaaacaacaataacaaatctcatgaaaatttcacaaatggaagtgaaacaatatcacctctattatacagatgtgaaaagagaggcccgatgaggtctagcaacttgccctaaatcatatccctagcagagcagatggagaggcaggattcaaacccagaattcctttttttttctttgagacagagtcttgctctgtcaccaggctggagtgcggtggcataatctgggctactgcaagctccacctcccaggttcacaccattctcttgcctcagccttctgagtagctgggactacaggcacacgccaccacgctgggctaatgttttggtatttttagtagagacagggtttcaccgtgttaaccaggatggtctctatctcctgacgtcatgatccgcctgagtacaacctgccggtggggggatcct

SEQ ID NO: 730862 - DNA, 924 bp, Homo sapiens
cagcacagctgagagccatgctcaggaagtttctggatcctaggctcagctccacagaggagaacacgcaggcagcagagaccatggggcccctctcagcccctccctgcacacagcgcatcacctggaaggggctcctgctcacagcattacttttaaacttctggaacttgcctaccactgcccaagtcacgattgaagccgagccaaccaaagtttccaaggggaaggacgttcttctacttgtccacaatttgccccagaatcttgctggctacatctggtacaaagggcaaatgaaggacctctaccattacattacatcatacgtagtagatggtcaaataattatatatgggcctgcatacagtggacgagaaacagtatattccaatgcatccctgctgatccagaatgtcacccgggaggacgcaggatcctacaccttacacatcgtaaagcgaggtgatgggactagaggagaaactggacatttcaccttcaccttatacctggagactcccaagccctccatctccagcagcaacttataccccagggaggacatggaggctgtgagcttaacctgtgatcctgagactccggacgcaagctacctgtggtggatgaatggtcagagcctccctatttttcattttttgcagttgtccaaaaacaaaaggaccctctttctatttggtgtcacaaagtacactgcaggaccctatgaatgtgaatacggaaccagtgagtgccagccgcagtgaccagtcacctgaatctcctcccgaagctgccaagccctacatcacatcaacacttaaacccagggagataaggatgtcttagcttcactgtgaactaagagtgagactacactacatttggtggctaatggtcagagctcccggtttttccagggta

SEQ ID NO: 730863 - DNA, 1751 bp, Homo sapiens
ggatagatgggtaagctgaggcccaaaagggggctgagaccacctcccagtttccccagtgaggtggcgcctgagccacggccaggcccggcctccttccacccggccctgctgtgcgcgcggcgggtgctgacctggcgaggccggacaggggaccaggtcggggtgaccgtcactgacacctggacagtcctcgttgtgttcggggtgggaagcccacggtgagtctggggacccaagatcttattttcctttctgtcacccccgcttggttttggattccatgacagctggacccggcttctgcgtgatcttcagagggaaggcaccaggagtggactgcgggacacccagagtggactgcaggaggacacagaagctaggctgaagcgggaggaagctgggaaccctgcacggggccactgcgcactgggactcgttactggtccccaagactcagggagaatgggtgagttgaactggcaaggaggagcccactgtcattacgggcctctggaatcccggcaggaggagattaaccacatggacattcgaggtggcagagagagctgcctagagaaggtgcgggggcagcagccagctgaggcagagcccggagggtttggtgcaggagcgtctgtagtggagggccatcccccaggctcaaattcctcccataggagattttagccctagtggagctgttgtatgtgatctttgtggggtggtcttgcccatcagatggggccagtctgacccgagcatgccttggtctgctggcctctcccagggccccggcctggccacgcctgcttgcagggcagctctgggtgccctgggggcctgcagcatagcttctgcactggcagaccatgcctgattggtggagagctccagcagggcagcccccacatccctgtgccagcctgcccactgcctcccacactgtagcttctccagggcccactgtcaccccccatcttgcttttgccagtgcatgtctgtgcaggtgggttttgctttccttgcccgccagtgtacctgtgtgtttgcaccctgccctgccattgctgtggcaggagtaccgtttgcccaacgccccctgctgactgccattgcagttggagccttggcagacacagagccagccagccccacctcccttgcaccccactcttgcaccaacactgttgcgggagtgaaactaggcacggaatagggaccaccctgcctgtggggcacaaagaatgccacaggcctgggcctgccggtgctccacctccatcccaacaccaccgccagcatggctgttgccagcagggggccctgccccccaggtgctttcgtctgccactgtggtgaacacctgcacagaggcaggcaccccagcacttgctagcaccctgccacagccgatgaacgtgcaccctgtgctgctgccaccacggctgctggcatgtgcaagcaagaatggatcccgctgccactgcactgcaaaatgcactggctggcaccacctatcagagtgtagtgaccggtagtgaggagcaccttgatccctcagtgcagttgattcctaacctccgggagccagagaacaaagttggtgcctgatacaagtaccccagttagagcacacagtctgggagttgggaactgagccttggccccctaaaatcatccagaaacaaagccagtcagctgaatccaacttatactacaatcaaatcctcaaggtcatcaaataggat

SEQ ID NO: 730864 - DNA, 840 bp, Homo sapiens
ggatagatgggtaagctgaggcccaaaagggggctgagaccacctcccagtttccccagtgaggtggcgcctgagccacggccaggcccggcctccttccacccggccctgctgtgcgcgcggcgggtgctgacctggcgaggccggacaggggaccaggtcggggtgaccgtcactgacacctggacagtcctcgttgtgttcggggtgggaagcccacggtgagatcttcagagggaaggcaccaggagtggactgcgggacacccagagtggactgcaggaggacacagaagctaggctgaagcgggaggaagctgggaaccctgcacggggccactgcgcactgggactcgttactggtccccaagactcagggagaatggggaagagtgtatcacagccattgggaactttcttcacccatcaaagcctcagggctgaagcatcctgaacaagaactcaggagagtgaaagaaacagttacctgtcggctgcagctggtacagctccccaccccgtacagagaccgaagcgtctctctctccccatcacccagcaccagactctgccccgcgactcagcctgcacctgcttcctggctccatccagccttccagcctcactagatcatcatgggccactggccaacacacaggggcagtgccgagccaggccgtggtcacacatggctgggttagtacttgaaaacattgtttttcactggcctcaccgtaatggacctgccccattttctgtggttgattttggatctgcaccagtgtgtaaattatggggtgtcccccgatattggataaagggtaaacagttttagccaaaa

SEQ ID NO: 730865 - DNA, 955 bp, Homo sapiens
  misc_feature (7)..(7): n is a, c, g, or t
  misc_feature (91)..(92): n is a, c, g, or t
  misc_feature (278)..(278): n is a, c, g, or t
agcgggntgttcgcctgcgtcgctccgggagctgccgacggacggagcgcccccggccccgccgggccggacgaccgccagcgccatgccnntctccaaagccaaagcatgaagtggctccggcgaggagagtcccgactgagcgccacaagaaccacatggccacaggtgcgtgagacccgagactgtaccgcagagctgagcgccaagagcacagccgagcgggtttcacgactggacgaagtacatccagacaggcgatggacaacccgggacancccgtaaatcacagagcgagcggacatgcgtggagggcagacacgcaggagttacctagaaaaggcttcgcaggactctactaacgaaacccccatcaatcagaaaggaacccgcgcagcggcagcgcacaacaaaagccccacagaacgactgagccacccaggacccagacacctcacaacccaccgacacaacccaagcacaggggacggcgcaactaagcactgggcacccccgaactacgctgaccgcacaacctcacacgggatggcaaacacgcgggccagagacgagataccaggtgcgccctaatggagctccccacaccgaagcatgtcacacgagccgaagcacaaacgaccagccagaccaaacagacgaaaacacaccgcacacgcggagagagcaccaaggaacaagaccggcgcacggagacgacctgcggcaggggcgcgaacgtacacgcacgaccgacgccgacacagcaactggaacgagaagagcggagcaagcaagagcagcacaatcagaagcgtacacagctggcctcaccacgacgccaacccagctgtaagaccaccacaagacgagcacatcggcacatagaccagagaaactgatgccaaaggccccgcgacgagcggccccaacggtgccgcagcaacgcccggacgcg

SEQ ID NO: 730866 - DNA, 780 bp, Homo sapiens
  misc_feature (7)..(7): n is a, c, g, or t
agcgggntgttcgcctgcgtcgctccgggagctgccgacggacggagcgcccccggccccgccgaggcgctacgacgcgcaggaacgcactgtcctagagggtacctgcaagttggtattgatcttggaaccacctactctggtgtgggtgtatttccacgccaaggtagaaacgtcgcagcataattgccaattgatcagggtaaatgcagaaccacatcctagatgctatgtcgctcgtttacggacactgaacggttgatcggtgatcgccgcaaaggaatcatagttgcaagtggatgcgcccaacaagcgagagtttcgtgatgtcaagaagtgctgagttgtgacgtgcgaggatgttgatgagtgcatgtctgatccaggtcgtgactatgaatactattggcacctttatggttgggtgaactgatgactggcaggtcccaaggtccaaggtaggaactacaaggggagagaccaaacagcttctatccagaggacggtgtctactattggttctgacaaagatgaaggacatcttgcaggaagcctaccttgggaagactgtgaccaatgctgtggtcacagtggcagcttacttgaatgactctcagcgtcaggctaccaaagatgctggaatgtacttgcttggtctcgaagtagtacgtgtagagattgattaactgagcgcaacatgcatgcatgcatagttgcgttacggcttagacaaatcaggttggagcagaaagaaatgtgctcatcttgtgatctgggagg

SEQ ID NO: 730867 - DNA, 1053 bp, Homo sapiens
  misc_feature (7)..(7): n is a, c, g, or t
  misc_feature (1053)..(1053): n is a, c, g, or t
agcgggntgttcgcctgcgtcgctccgggagctgccgacggacggagcgcccccggccccgccgaggccagcacgcccggcggaggcgatagaccctcggtctacgagcactccaccaaggcccctggacggttggcgctatgctccagggcgagggtagataggtgttcgcgagagacatcggactcgccctactagactagtcagaattggcccaatggctgggtagatgtcacgtacgcctagtcagcgccgcgacgctgttgactctgccaaaggaaacgacaggccgcacgacgaggctgtgaagcgtctcgcgaaccgtaccgattcattacccaaggaccaatgtggccgctagggtaccaagcaccggccgagctggctagttacccatgctaatagtaacacagctggggcgttggtgttgggccgaggtcgaactgaagtcagatctctggcatagggctagatgcttcgagacactcattgctgagtctccagttggctccaaggtgatgccgagactgcaaggcgtactgaccaaagtcacaagaagcactcgcacccaaccaagggacacaggacacattcatgtccacggaatgacacccttgtaagagtgtcgtgctgtacttcaatctttgggtacaaccgggacactaatccgtcggcgcggaacttacggagtggctcgcagacgaagcgcaaacgtagtacgatccggattgacttacacgctttgcgccctcaccgtaacttgcatttacttgctcgtggagaggaaagccaagccaccgatcagagggaattgcatcttgggcgaagtcacagaccaagaaaccggtacccaaaggaggttccggtagtcggtaggggcagcgtcgtggtgacacataacgctgtctctagtgaggccttgggaaccgtgagacgggtttcagccaacattcttagcggcatcaaattttgacccgaaccaagttgtcccaatctaacagtctccctccaccgggggtgttacgttgcattggtttccattgggaccctacn

SEQ ID NO: 730868 - DNA, 473 bp, Homo sapiens
gtttggagctgttcgggatgtttctgtatatttcacatgccctgtatccagaagtgggctaaagacagccagtttcttgtatcttctgtgactgatgatgattttggaaagaaagattgtccctggccttgtccaaaatgtaggtttgaatacaaacgatctgaaacacctagtaggtactattgctattgtggaaaagtagaagatccacctttagatccgtggcttgtgcctcattcatgtggccaagtatgtgagcgtgaatttaaacctccttgtggccataaatgtttactcctctgtcatccaggtccctgccctccttgtccaaagatggtcacaactacttgttactgtaagaaagcaaaacctatccctcgtaggtgcagtgccaaggaatggtcttgtcagctgccatgtggacagaagttgctttgtgggcaacataagtgtgaaaatccttgtcatgcagg

SEQ ID NO: 730869 - DNA, 890 bp, Homo sapiens
agtcgccggaacgcgggcgggggcttctgggagttgtagtctgttgggggcgtgcgcagtcgggatggaagcttcctggcgccaggtggccggtggccgaggccgatcccggggacgggccactgccgccccctcaggaaatggagtccatctccgcggcgccggaggagggcgagagaaggggtcggtgggcgcagttccttctggcaccagtcccggaggagtcgcgaccacggcggctgcagggagcaggcacagccccgcaggatcccaagccctgcagactaccgcagccagcgagctaatgtctcagaaaaaatttgaagaaatcaagaaagctaaccaagctgcagccagaaaacttgttgaagaacagtttagctcttcatctgaagaaggagatgaagattttgaaggaaaacagggaaaaatacttgcaaatacgtttataacatacactactcagacagatggagatacacgtgaattagagcgaacaaaacaatatgtaaatgaagcttttcaagcaggggctatgacatgcctaatttgtattgcttcggtgaagagaaaccaagcagtttggagctgttcgggatgtttctgtatatttcacatgccctgtatccagaagtgggctaaagacagccagtttcttgtatcttctgtgactgatgatgattttggaaagaaagattgtccctggccttgtccaaaatgtaggtttgaatacaaacgatctgaaacacctagtaggtactattgctattgtggaaaagtagaagatccacctttagatccgtggcttgtgcctcattcatgtggccaagtatgtgagcgtgaatttaaacctccttgtggccataaatgtttactcctctgtcatccag

SEQ ID NO: 730870 - DNA, 886 bp, Homo sapiens
tgtccaccatgggtgaattatgaatcagtagctatgccaggcctcagctgggccacatctggagaactggggtgagggcacaacatcacaaaatatctggccccagtctggtcactcatcccttttagggcaacaaggaaactatcctgtggcctgagagcacaatacctgagacaaaggccagcagaaacatttgtctgccctcaccctttctgccccagcttccacctgctccccatctgcccacccactaaagcccatgtggcatgccatctctcgaacatccaggatgtcccagagtggatgtccatcaggtctgctggcagacaaaaatatctcttcaagtgccactcgagtgatagtgaagactgcaggcaaccagaaagactttatggtagctgatgacatctcggtaaggcagttcaaggagatgctattggctcacttccaatgccagatggaccaactagtgctggtcttcatgggttgccttctcaaagaccatgacacactgagccagaggggcatcatggatggccacaccatctacttggtcatcaagtccaagcagggctccagatctctagcccattccttccgggacctgccaacgaatgatccctgccaccgggacagaaacaccaaaggaaacagcagcagagtgcaccaaccaactggtatgaatcaagctccagtggaactggcccactttgtggggtctgatgcacccaaagtgcatacccaaaacttggaagtgagccacccagagtgcaaagcacagatgctggagaatcctagcatccagcggcttctgtccaacatggagttcatgtggcagttcatttcagaacatctagacacgcaacaattgatgcagcagaaccca

SEQ ID NO: 730871 - DNA, 598 bp, Homo sapiens
gtgccctgcgtgcaggtttatagataacccctgccagacctgctacaaccaagaccttatggtccaggtctcagtttggagaagatttagctgtctaccacttcttgtgtagtgttcctgtgaagttttatttttggttgcaagtatctggaaaacagatgcagatgtttttgtggatgttgttgagacttttgagacttctgtttctaaggtacacatgatgggacccaaactctcctggagagttccattcacttcctgaaacgtgcacctgtttcaggtgcatgtttattcagtgtgcatggatatttaagatttgctggagcaggctgggcggggtggctcacccctgtggtcccgacactttgggaggccaaggcgggtggatcacctgaggtcagggagtttgagaccagcccggccaacagagtgaaaccccgtctctactaaaaatacaaaaattggacgacgcccaccatcatgccccggctggtgcgtcggtataacacagtagagacggggtctcaccgtgttggccgggatggtctcgatctcctgagctcgtgagtccgcacgcgtcgggctccaaggtgtctgg

SEQ ID NO: 730872 - DNA, 966 bp, Homo sapiens
ccgtattattctgaggacactgtggtaatcaagaactatccataactaatgtataaataactgcttgcttatttctacaataatccaactcaaattatatatacacagcaaaaagcttatgatagaaggcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtccaagagaagacaagtctcccaagggaaggcaagaggggcaagcagaagaaaaaggagaggtgcttgcgaagatgatgaccatgataacttattcttattaagcagagaaaaaaaagtcttaagccgtcaggcagcctctgaatgtggtttcattgtccttggcctgtgtctatacctctggcctggttatatccatgataactacaggagtttggctgttttacttcaaaaaaaaaggggggctaaatccccgaggcattcgtcccttttttaaggca

SEQ ID NO: 730873 - DNA, 905 bp, Homo sapiens
  misc_feature (618)..(618): n is a, c, g, or t
  misc_feature (625)..(626): n is a, c, g, or t
  misc_feature (637)..(637): n is a, c, g, or t
  misc_feature (702)..(702): n is a, c, g, or t
  misc_feature (763)..(763): n is a, c, g, or t
  misc_feature (789)..(789): n is a, c, g, or t
  misc_feature (799)..(799): n is a, c, g, or t
  misc_feature (810)..(810): n is a, c, g, or t
cacacatgtgggtttcaagtgcggctggtgccatccctctgagcagacgctgaaagagaaaacttctgagatagcacttgtgagcgaaaagcacaccaactggctcaaagagctgtggttgggcagatctggtgtaaatacaaagttccttcccgacatttcccagagtttcttgaagatcacctggcctctagaagatgacaaggagacagcaagtcctacaagcaaaaaggagcattcagcaaacattccaagcacagcttatgccctggaagagtatgttccacgggagagaagtgaagccagtgggtccagacctggaactctacctctctctgaatgtctaaagtgaagcggtttcctttcttcttcagctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaantatgcanntttcacaagtngtttcttagtgtcccaacggaggaaccatgaagcaaagctttacctgtgctctacagcaagacantactataccaaggaaagctcttgtatcagaacactggattggtttcattccaaaagtcttnggacaagacccaagatctctatccantttctcggtnacccttataangaaaccaaaacggctcctctagtgcccaaagcctgatctagcacagtcaagacagtacctataggtccctactctcacgaatcacttcaaaacta

SEQ ID NO: 730874 - DNA, 856 bp, Homo sapiens
  misc_feature (569)..(569): n is a, c, g, or t
  misc_feature (576)..(577): n is a, c, g, or t
  misc_feature (588)..(588): n is a, c, g, or t
  misc_feature (653)..(653): n is a, c, g, or t
  misc_feature (714)..(714): n is a, c, g, or t
  misc_feature (740)..(740): n is a, c, g, or t
  misc_feature (750)..(750): n is a, c, g, or t
  misc_feature (761)..(761): n is a, c, g, or t
cacacatgtgggtttcaagtgcggctggtgccatccctctgagcagacgctgaaagagaaaacttctgagatagcacttgtgagcgaaaagcacaccaactggctcaaagagctgtggttgggcagatctggtgtaaatacaaagttccttcccgacatttcccagagtttcttgaagatcacctggcctctagaagatgacaaggagacagcaagtcctacaagcaaaaaggagcattcagcaaacattccaagcacagcttatgccctggaagagtatgttccacgggagagaagtgaagccagtgggtccagacctggaactctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaantatgcanntttcacaagtngtttcttagtgtcccaacggaggaaccatgaagcaaagctttacctgtgctctacagcaagacantactataccaaggaaagctcttgtatcagaacactggattggtttcattccaaaagtcttnggacaagacccaagatctctatccantttctcggtnacccttataangaaaccaaaacggctcctctagtgcccaaagcctgatctagcacagtcaagacagtacctataggtccctactctcacgaatcacttcaaaacta

SEQ ID NO: 730875 - DNA, 822 bp, Homo sapiens; identical to SEQ ID NO: 310553

SEQ ID NO: 730876 - DNA, 550 bp, Homo sapiens; identical to SEQ ID NO: 310544

SEQ ID NO: 730877 - DNA, 777 bp, Homo sapiens; identical to SEQ ID NO: 401877

SEQ ID NO: 730878 - DNA, 1020 bp, Homo sapiens; identical to SEQ ID NO: 401879

SEQ ID NO: 730879 - DNA, 1025 bp, Homo sapiens
  misc_feature (611)..(611): n is a, c, g, or t
  misc_feature (767)..(767): n is a, c, g, or t
  misc_feature (796)..(796): n is a, c, g, or t
  misc_feature (798)..(798): n is a, c, g, or t
  misc_feature (804)..(804): n is a, c, g, or t
  misc_feature (808)..(808): n is a, c, g, or t
  misc_feature (812)..(812): n is a, c, g, or t
  misc_feature (815)..(815): n is a, c, g, or t
  misc_feature (818)..(820): n is a, c, g, or t
  misc_feature (824)..(824): n is a, c, g, or t
cctcttcctgtgtggaagctgggattccaatggcaggcaggaaatcttgtagtaggtgatcgtggccttccttgggatccctgtttcccccttttattcccttttcacccagtaaaaccctgctttgctcactctttaaagcatctgtgagcgtaaatttttgtggccatgggatggacaagaaccacatgtttacctgaagtcctgtgacattttggtgtgcagcatgggagctccaaaagtgagtcaagtgaacttattttgaatggtttatggcctttaataattacataagttatatactcctgtgatcaaaatttggagcatgtttgtttctctctgcctggttcctccagaatttagaacctatctacattctttcagatgccagaggatgctatagaaaaatgcgtgccctcttgtaatactttgttcaagttctgatcagaaggatgaatgatggagcccaagaagccagagtctcattgtgttgctcaggctggaatccagtggcatgatctcggctcagtgcaacctccgcctcctgggttcaagcagttctcctagatcagcatcagcgtcccgagtagctgggattacaggcacccgcnacatgcctggctaatgttggtcaggctggctcgaactcctgacctcaagagatccactgctttggcctcccaaagtgctcggattacaggcatgagctgcaaacccagctccaaatactttttttttaaatcaaataatgatttcaatgactgagnattggcaatgtatttcaacataattctgntntcactnacgnattnagnctnnntganaacagagacacgagacaacgaaaaagaaagaacaattgtggcgcgcacgggccgcaaaaaagcgtacaaaaacacacggatgaagcacccggaccaacaaagatgagaaggtggcagacagtgcccacagagaaccggcgaccaaaaaagagcgggatacaccaaaaaaaaaagccgaggaaacaagaagcgctgaaaaac

SEQ ID NO: 730880 - DNA, 807 bp, Homo sapiens
  misc_feature (393)..(393): n is a, c, g, or t
  misc_feature (549)..(549): n is a, c, g, or t
  misc_feature (578)..(578): n is a, c, g, or t
  misc_feature (580)..(580): n is a, c, g, or t
  misc_feature (586)..(586): n is a, c, g, or t
  misc_feature (590)..(590): n is a, c, g, or t
  misc_feature (594)..(594): n is a, c, g, or t
  misc_feature (597)..(597): n is a, c, g, or t
  misc_feature (600)..(602): n is a, c, g, or t
  misc_feature (606)..(606): n is a, c, g, or t
cctcttcctgtgtggaagctgggattccaatggcaggcaggaaatcttgtacatctgtgagcgtaaatttttgtggccatgggatggacaagaaccacatgtttacctgaagtcctgtgacattttggtgtgcagcatgggagctccaaaagtgacattctttcagatgccagaggatgctatagaaaaatgcgtgccctcttgtaatactttgttcaagttctgatcagaaggatgaatgatggagcccaagaagccagagtctcattgtgttgctcaggctggaatccagtggcatgatctcggctcagtgcaacctccgcctcctgggttcaagcagttctcctagatcagcatcagcgtcccgagtagctgggattacaggcacccgcnacatgcctggctaatgttggtcaggctggctcgaactcctgacctcaagagatccactgctttggcctcccaaagtgctcggattacaggcatgagctgcaaacccagctccaaatactttttttttaaatcaaataatgatttcaatgactgagnattggcaatgtatttcaacataattctgntntcactnacgnattnagnctnnntganaacagagacacgagacaacgaaaaagaaagaacaattgtggcgcgcacgggccgcaaaaaagcgtacaaaaacacacggatgaagcacccggaccaacaaagatgagaaggtggcagacagtgcccacagagaaccggcgaccaaaaaagagcgggatacaccaaaaaaaaaagccgaggaaacaagaagcgctgaaaaac

SEQ ID NO: 730881 - DNA, 1028 bp, Homo sapiens
cagaaaaaagcctaattgcaacttgatggctttgttggctttctgagcaatgtgtccagttgccacagtgaagggaatggaataatctaactcaccattcccaagtcctatgccatcctgagagtggggggtggagtcaattcaccttggtgcttggactaagcatgaggtggtgagtgacaacgttcctaattgaagggtagggtaaatggttgttgggtggacaccaacacttattctactacagaagctaaattgaaccctcaggcagggtacgtgaaagtggcaagagatgtcaagaccactgggcaagttggccagttgttccttaggaatgaaaattcttttgaaaggaatggccagggtcctctgctggccccacttggtcttctggaggctctgatcttggttggttagtggtctttacaggccaaggtcaaggccattgcacaaaaaaccctgtgcatgcccttaacttgctttcagttgaatatttgggctgaactatgaggcagagaggaatcccactgggtggctccttgctgcattcgcagttgaccagcatggggtttgttggagaaataggaaccatcccctgaaaacacacactatggtagccactcaactgttgaaaggcactggagtccaatgggtgaggccgcctctgagacaagcctctgagttgaggctgggagaggctccctccttggagtgttgctttttttgtttcacccctgcctctggagatgggtagaggaacatgagctgaccttctgggaagttaggttggtgaggagttgctgaggcactgcagggccatgcccagtagagaggaatgtataacattttaagaggctgagagcaccccttgttggacgcatgcccatggcagcttccttctgccgatcatgggagaaatcaagcacttttcactaatggctaatgatcgattttgggatgaaattctccactcctctcctttaccacatcaccactatccttcctgcaatacatccacgagactcact

SEQ ID NO: 730882 - DNA, 1943 bp, Homo sapiens
gcttcctctcagcccgctctgagctggaagcagcatgtgggacctggccctgatcttcctcgcagcagcctgagtgttctcactaggggtcactctgtgggtcatttgcagccattttttcactgtgcacatccctgcagcggttggccaccctgtgaaactgagagtcctccattgcatcttccagctgctgttgacatgggggatgatatttgagaagctcagaatctgttctatgccccaatttttctgtttcatgcaagatctgcctccgctaaagtatgatcccgatgttgtggtcacggatttccgctttgggacaatccctgtgaagctgtaccaatccaaggcatccacctgcaccctgaagcctggcatcgtgtactaccacggtggcgggggcgtcatggggagtttgaaaacccaccatggcatatgctctcgtttgtgcaaggagagtgactccgtggttctggcagttggttaccgcaagttacctaagcataagtttccagtgccagtaagagactgcttggtggccaccatccacttcctgaagtccctggatgcatatggagtggatccagcccgggttgtggtctgcggtgacagtttcggaggggcaatagccgcagtggtttgtcaacaacttgtggacaggccagatctgccccggatccgggctcagatcctgatctatgccattctccaagccctggatttacaaaccccttcgtttcaacagaggaaaaacatccattgttcacacggagttcatctattactttttttttcaaaacctggatttcagattctcctggccaaaacctggatttcagctcctcctggcaagaggtcatcatgaaaggtgcccatttgcctgctgaagtctgggaaaagtacagaaagtggttgggcccagaaaacatccctgagaggtttaaggagaggggttaccaactgaagccccatgagcccatgaatgaagctgcttacttggaagtaagtgttgtcctggatgtgatgtgctcgcccctgattgcagaagatgacatagtgtctcagctcccggaaacctgcatcgtgagctgtgagtatgatgctctccgggacaattcactgttgtaccccgtgactggcacatatggaggatggttcctatggagtgctcaggaccatgacgtgagcttcttgcactttccctgctccatgataattctgagtgccttagttcactccatgagaattctgagtgcattagttcaatttgtaaagggactgtgaccatctttcttctctgctggtactgcggtgtggattccactggcatccagcctcccacagggctctctgttgctgatttaggtggtgcatagtggggctagggaggaggtagaggttgctgtcacctttctggtccaggttctagaaccacacaatgcatgctcctgatgtccagaggacgtggtagaaaagacaggtttggaggtgggagtgtggctgtctctattctctgttgggaaaacctgggctgacaatattcagtggccatttgtgggagtgaatcagccggtaagagctgttctcagcctctctaaggggcagttcaggctcccagattgatccagactgtgtgtgactttcgtccatttgacttgactttggaatagcacaagggcatcacgtacttcacgaggctttcccaatgtggctcagaggcaggagctctgatgctctaggctgctgtgaggtggtggtggtggtggagaaactggcttcacccacctactcttctgtgaacagtagtgacttttcccgctgtttctcagcctctgggatcagagtcttcactgtctgggctggaaactttaagatagaatggatagagcttccacagtggttggcatctagtggtggatgaagacagcctgcagctgcccgac

SEQ ID NO: 730883 - DNA, 693 bp, Homo sapiens
ggcgcgcgcggaatcagttgagtctcttcggttcccggctctttctcctgcgactggggaaatggacgcctggagaacggaaatccagttatcaaaattgactccagaagagagaacctaacagaacaataacaatggaagaaattgggaatattatcaaaaagctatcattctgttaaactccaggcttggatggtgttacaggtttaaaaaaaaaaaaaggaaaaagtccttcatgaaaaaagaagaacttaagcaacattgatggattcagaagctcatggaaagagaccaccaatactaacatcttcgaaacaagatatgtcacctcatattacagatttagtgaaactgaagcattacttgtgtggctgctgtgcagccttcaacaacgtcgcaatcacatttcccattcagaaggtcctctttccacaacagctgtatggcatcaaaacgggggatgcaatacttcagttgagaacggatggatttcgaaacttgtatcggggaatctttccccgattgatgcagaagacaactacacttgcacttacgttgggtctgtatgaggatttatcctaccttctccacaagcatgtcagtgctccagagtttgcaacctgtggcgtggcagcagtgcttgcagggacaacggaagcaattttcacttcagacattgcttcaagaccacaa

SEQ ID NO: 730884 - DNA, 985 bp, Homo sapiens
ggcgcgcgcggaatcagttgagtctcttcggttcccggctctttctcctgcggtgggtatttgtccggctgctgggcgacctttcccgcgaaggaggttgtgccttcattcggtcgcgccccgggctggggaggcacctccctggtgcgcaggaaccgcaggggcgggtaggagcctggctctgcctgagctccggagggagcagagctggcaccgcgcaagggcccctgcctcccgggagactgggatttctggcctcctcacctcgggaccgctgactgtggagtgtcaaagacggaacagggtttagtgatcttgtccaaccccctccccgcttttcacagactggggaaatggacgcctggagaacggaaatccagttatcaaaattgactccagaagagagaacctaacagaacaataacaatggaagaaattgggaatattatcaaaaagctatcattctgttaaactccaggcttggatggtgttacaggtttaaaaaaaaaaaaaggaaaaagtccttcatgaaaaaagaagaacttaagcaacattgatggattcagaagctcatggaaagagaccaccaatactaacatcttcgaaacaagatatgtcacctcatattacagatttagtgaaactgaagcattacttgtgtggctgctgtgcagccttcaacaacgtcgcaatcacatttcccattcagaaggtcctctttccacaacagctgtatggcatcaaaacgggggatgcaatacttcagttgagaacggatggatttcgaaacttgtatcggggaatctttccccgattgatgcagaagacaactacacttgcacttacgttgggtctgtatgaggatttatcctaccttctccacaagcatgtcagtgctccagagtttgcaacctgtggcgtggcagcagtgcttgcagggacaacggaagcaattttcacttcagacattgcttcaagaccacaa

SEQ ID NO: 730885 - DNA, 622 bp, Homo sapiens
agcggaggttatgcacatatattggtaggagctatatgggaaatctctctactttcagctcaattttgctgtgaacctaaaattgctcttaaaaaataaagtgtgtaatcaaaaaatactccttgttaactaacatgatccatatcttacagatgggaaactgccccttcttttacaggaggatacaatatgttagctgtagagccagtactgtaaccttgaccttcatttcaaggccaggtttctctaagctttactaggctactcaaaactcataacctgtaccatgatggaatttgatattgtttttggactgatctgtaaataaatacatttgtaatttagatttccatttagacagttcgttattcatgatagacttactaaagaatctctctttttaatgctagtgttcctgaataacactatttataacaacagaagaaaaaatactactactaatagatgcatctgtcgattttgtaccatatgtgaggtagtatgctaagcatccattgtttatggttctagtaataaccctcaaaggtgggtattatattatatttttggaaaacaccaaaaatgaagcttagagagattaagatatacatcaaaagaacac

SEQ ID NO: 730886 - DNA, 628 bp, Homo sapiens
cgggggtcggccgagggcgcggggccccggggctccgggctcgcccccgccgctcggggcaggcgcgccgatggcgtttctgaggtgacgccgcccacaccgggcttctccgggggcggaggaaacacctatgaaccctccggcagccttccttgccgggcgccagaacatcgggtcagaagttgagatttccactatcgagaaacaacggaaggagctgcagttgctcattggagaattaaaagatcgagataaagagctcaatgacatggttgcagtgcaccagcaacagcttctttcatgggaagaggatcggcagaaagtgttgacactggaagaacgttgcagcaaattagaaggtgaactacataaaagaactgaaataatcaggtcactcacgaagaaggtaaaagctcttgaatccaatcaaatggaatgccaaacagctctccaaaagacccaactacagcttcaggaaatggctcaaaaggcaacgcattcttctcttctctctgaagaccttgaggctagaaacgaaactctcagcaacacgttagtggaactttctgcccaggtaggacagctacaagctcgagaacaagctcttacgacaatgataaagctaaag

SEQ ID NO: 730887 - DNA, 806 bp, Homo sapiens
agcggggcacaacaagggactgggggttcgtctgctgggtttgcggagcagctagctactcggcgggatctcccggcaggatgggtaaaaagataaagaaggaagtagagcctcctcctaaggatgtgtttgacccattaatgattgaaagcaaaaaagcagcaactgtggtgttaatgcttaattctccagaagaggaaattttggctaaagcatgtgaagccatttataaatttgctttaaaaggtgaggaaaataaaacaaccctccttgaacttggagctgtggaacctttaactaagctactcacccatgaagacaaaattgtaagaagaaatgctactatgatatttggaatcctggcttctaataatgatgttaaaaaattgttaagggagttagatgtcatgaattctgtcattgcccagctcgctccagaagaagaagtagttatccatgagtttgctagtctttgtctagcaaacatgtctgcagagtacaccagtaaagtgcaaatatttgaacatgggggattagagccactcatcagactactgagtagccctgacccggatgtaaagaagaactctatggaatgcatttacaacttggtgcaggattttcagtgtcgagctaaacttcaagaactaaatgcaatacctcctatcttagatctcttgaagtcagaatatccagtgattcagttgttggctctcaaaaccttaggtgttattgcaaatgataaggagtctcgaacaatgctaagagacaatcaaggattggaccatcttattaagatcctagaa

SEQ ID NO: 730888 - DNA, 778 bp, Homo sapiens
  misc_feature (670)..(671): n is a, c, g, or t
agcgggcggttgccatggggacggagcttgggtggcaaccagaactagggagctggtggagaaggtggcggccgctggaaggaggcccgggaggtggctgaggggtccaggcggcgggacgactctggccttttgaagaccggggtgggtgctctctaggaaactctacagagaagaatgtcagatgcagcagaagctccccgagaagcaacaggagaaaatggagaaacagaaatgaaagaagaggaggaacctaatccaaattataaagaagtagaagatccacaacaggaatcaaaagatgacacaatagcatggagagagtctcaggaggaggagaggaaaacgggcgaggaggaaggggaggaggaggagaaagaggaggaggggaaggaggacaaaaagattgtcatggaagaaactgaggaaaaggctggagaagtccaagagaaggaggcttcaggaatacaggaagaaaccacagtagagccccaagaagtcacagcgtccatgatccgtttggagacacagattactgattcccagtcaatcacatcaggaattttcccaaaaacccaaagaggtagcaagtcaaagctttccttacaattggaggatgcagaaacagatgagcttttaagagacctgagcacacaaattgaattcttgnnttggatcaaatcagtcctgaggaacaacagattagttcccctgaaaggcagcctcaggagagcttgaggagaaaacgacggatgcgcgagatgaatgggacaagaaa

SEQ ID NO: 730889 - DNA, 762 bp, Homo sapiens; identical to SEQ ID NO: 102762

SEQ ID NO: 730890 - DNA, 667 bp, Homo sapiens; identical to SEQ ID NO: 97643

SEQ ID NO: 730891 - DNA, 831 bp, Homo sapiens
agcgtgagtgcctggcaacctagaccagtcagggacgcggcaggaaatggaagagcctccgcaagaggctctggctgaacccttgaaacatgaaagcccagccgctccctcaagtgctggccacactaagggccaggaagaagacgaccagaagaaccaggccgaaaggaaggcagataaccacactgctcacagaatagctgaccagactgccctaagagtgcctagccaggctgaatccagcatatttagccaagctaccaacggagtagctgaacaaaatgggcatagtacacctggtcaggctggccgcagagcatccaaccctgctgatgtttctgaccttagagcagatgatcaggttaatcaaacaccgtctgaacagactaaaggcaaggcatctagccaagctaataatgtacagcatgaacagagtgatggtcaggtgtctggcctgacggaggaaagaactgctgaacagactgaacgaagattacctacccaggctgagagaagaacttctgggcagattgatggtagactggctatgccatctgaccagagaggttccagacagaccgaccacagaatggcaggccagtctgagagaagagcttccgagcagatggaccgcagaatgtctggcgaggctgagcgaagaacttctgagcagattacacacagattatccaaactatctgagagaagaccttctgtgcagattgacagtgggtcatccgtccatctgaccaagtccttctgtaacagatcgacacgtggatcgtccgtaccatctgacaaggacctaccgtacacattgcaccggcagca

SEQ ID NO: 730892 - DNA, 798 bp, Homo sapiens
aacgcccgcacgcgcccggcccctagtcccagcgcggggagggtactatcgcagcttctccgtcaggccttgggccatggcctcgctacgcaatgccaacccgaggctgaagaactacttcaaggagaactacattcctcaggtctgcgaggcactgttatgtggtatacttgttacatgtcctgaggatccgctgaggtatttagagggaatgatcatggttataatcaaaagtggtcttcagaatcttctttgggatatgtgcattactccatcaatgaaaccaaacattcgaagattgtctgaaacttacctggaacaactttttgaattggatgatcagctgatgactccggaattgatgataaaagcctgtagcttttatactggacatttagtaaagactcatttttgcacttggagagacatagctcgtacaaatgaaaatgtcgtcctggctgaaaaaatgaacagagcagtgacatgctacaatttcagacttcaaaaatctgtatttcatcactggcactcttatatggaagaccagaaagaaaaacttaaaaatatgctattgcggatacaacagatcatctattgtcacaagctaaccattatcctaacaaaatggcggaatacagcaagacataagagtaaaaagaaagaagatgagctgatattaaaacatgaacttcaattgcaaccccttgggaacactaggtgactactcacaacgacgcttgctgcgaaagaatcccattttctggacgaagtcctctgaaggtctcttgtccatgagac

SEQ ID NO: 730893 - DNA, 904 bp, Homo sapiens; identical to SEQ ID NO: 387989

SEQ ID NO: 730894 - DNA, 793 bp, Homo sapiens; identical to SEQ ID NO: 387990

SEQ ID NO: 730895 - DNA, 836 bp, Homo sapiens
agcggacagtcctgccaggacggcgacagtgaagcacctgggttgagagggagcagcaggtaactgcgcaacccctgcctcccccggccccagcccgtgcctcagcagagccgggtgtggtggggacccgggagtgggtctcactgcgtgtcgcctgccaacaccttcctccaccaccatccttacccagccccagtcccacccagcacacctgggcgagacaacccaggtgcgaaggacaagcgattactaccgaagagcgtgcaaaccaggaagagagcagcctcctggagaggaaaacgtgatcccaggggtagacacgtggcgctgcgtggagagacaggttgacgagacgaggctcttctgaccgtcctacctggcaaaacttgacgacagcttcaggtcgctaccatctggacctctcggagctccctgaaccatgactcagaccctcgacacaagggaagaccctctgaacctgggcggcggtggcggcggcggctgtggctgtggctgggcacactcggcctccttgagctcctggtcgtcctgccatcgaaggcgcccgggtgctccagcgtacaatagaccgcaccgatatagccccaagaccgagtatgggcccccaaggaagcagccgaagcaacagcacggccgggcttttggttccaagcacccgtgtgctctaactgggggtgctggggagggccctggcgcccaccccctccaggattctggaaattcccctgcccggtgcaagtgtttcgggtgtatggcctgcaccctctctgcttttgctgctgctcctgctggagcgggtcctggaaccctggctg

SEQ ID NO: 730896 - DNA, 1730 bp, Homo sapiens; identical to SEQ ID NO: 465720

SEQ ID NO: 730897 - DNA, 884 bp, Homo sapiens
  misc_feature (792)..(792): n is a, c, g, or t
  misc_feature (796)..(796): n is a, c, g, or t
  misc_feature (802)..(802): n is a, c, g, or t
  misc_feature (804)..(805): n is a, c, g, or t
  misc_feature (817)..(817): n is a, c, g, or t
  misc_feature (819)..(819): n is a, c, g, or t
  misc_feature (824)..(824): n is a, c, g, or t
  misc_feature (828)..(829): n is a, c, g, or t
agcgggtccctggcaattcccgacttcccaacggcttcccgctggcagccccgaagccgcaccatgttccgcctctggttgctgctggccgggctctgcggcctcctggcgtcaagacccggttttcaaaattcacttctacagatcgtaattccagagaaaatccaaacaaatacaaatgacagttcagaaatagaatatgaacaaatatcctatattattccaatagatgagaaactgtacactgtgcaccttaaacaaagatattttttagcagataattttatgatctatttgtacaatcaaggatctatgaatacttattcttcagatattcagactcaatgctactatcaaggaaatattgaaggatatccagattccatggtcacactcagcacgtgctctggactaagaggaatactgcaatttgaaaatgtttcttatggaattgagcctctggaatctgcagttgaatttcagcatgttctttacaaattaaagaatgaagacaatgatattgcaatttttattgacagaagcctgaaagaacaaccaatggatgacaacatttttataagtgaaaaatcagaaccagctgttccagatttatttcctctttatctagaaatgcatattgtggtggacaaaactttgtatgattactggggctctgatagcatgatagtaacaaataaagtcatcgaaattgttggcttgcaaattcaatgttcacccaatttaaagttactattgtgctgtcatcattggagttatggtcagatgaaaatnaganttctananntggtgaagcaantnaattnttgnncaaattttagaatcgggaaaatcttattttaactaaagggctgagattgggatat

SEQ ID NO: 730898 - DNA, 909 bp, Homo sapiens
  misc_feature (707)..(707): n is a, c, g, or t
  misc_feature (791)..(793): n is a, c, g, or t
  misc_feature (800)..(800): n is a, c, g, or t
agcgggcctgcctcttccaggctgcgtggccggggcgtcatctcgcgcttccaactgccctgtaaccaccaactgccattattccggctgggacccaggacttcaagccatgtggcgcgtcttgtttctgctcagcgggctcggcgggctgcggatggacagtaattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagccacagcaagattttgcaaagtatatagaaatgcatgttatagttgaaaaacaattgtataatcatatggggtctgatacaatgntgtcgctcaaaaagttttccagttgatttggattgacgaatgctatttcgtttcatttaactattacaattattctgtcttcannnggagctntggattagattgacgcttaaattggcaacactggagaaagtaatgaggttttccccacattttaaagaaggcaaaaattcttatcctggtgaaggtcctcatgaagtgg

SEQ ID NO: 730899 - DNA, 158 bp, Homo sapiens
agcggaagggaggggcgagtatcgcaaaataggccaagtcgctgccctctactcaactcgcagggcgggaggatggagacagagggatgcggcgggagggcgggacagcccagtcgccgccaaggaggcgaagcggggtcggggtagctcacccgccc

SEQ ID NO: 730900 - DNA, 841 bp, Homo sapiens
agctgaagggcgcgcggtgccgacagggagcttccttggctggcatggcggcgagcgcgctgcgaggcctgccagtggctggcggaggcgagagtagcgagagcgaggatgatggctgggagattgggtatctcgaccggacgtctcagaaattgaaaaggctattacccattgaagaaaagaaagaaaaatttaagaaagcaatgaccatcggagatgtttcattggtccaggagctcctagattctggcattagtgtagattccaactttcagtatggatggactccccttatgtatgctgctagtgttgccaatgcagagctggttcgggtccttttggacagaggtgctaatgcaagctttgagaaggataagcaaagtattttgataactgcatgttctgctcatggctcagaggaacagatcttgaagtgtgtagaactactactttcaagaaatgctgatccaaatgttgcttgtaggagacttatgaccccaatcatgtatgctgctcgagatggtcacacccaggttgttgctctccttgttgctcatggagcagaagttaatacccaggatgagaatggttacactgctttaacgtgggcagcacgtcagggtcataaaaatatagttttgaagttgcttgaacttggagctaataaaatgctacaaaccaaagatggaaagatgccaagtgagattgcaaaaagaaacaaacatcatgagatcttcaacttactttcttttactttaaatccattggaaggaaaacttcaacaggtaactaaagaagacactatttgtaaaatattgacaacagattctgatagagaaaa

SEQ ID NO: 730901 - DNA, 729 bp, Homo sapiens
agctgaagggcgcgcggtgccgacagggagcttccttggctggcatggcggcgagcgcgctgcgaggcctgccagtggctggcggaggcgagagtagcgagagcgaggatgatggctgggagattgggtatctcgaccggacgtctcagaaattgaaaaggctattacccattgaagaaaagaaagaaaaatttaagaaagcaatgaccatcggagatgtttcattggtccaggagctcctagattctggcattagtgtagattccaactttcagtatggatggactccccttatgtatgctgctagtgttgccaatgcagagctggttcgggtccttttggacagaggtgctaatgcaagctttgagaaggataagcaaagtattttgataactgcatgttctgctcatggctcagaggaacagatcttgaagtgtgtagaactactactttcaagaaatgctgatccaaatgttgcttgtaggctttaacgtgggcagcacgtcagggtcataaaaatatagttttgaagttgcttgaacttggagctaataaaatgctacaaaccaaagatggaaagatgccaagtgagattgcaaaaagaaacaaacatcatgagatcttcaacttactttcttttactttaaatccattggaaggaaaacttcaacaggtaactaaagaagacactatttgtaaaatattgacaacagattctgatagagaaaa

SEQ ID NO: 730902 - DNA, 171 bp, Homo sapiens; identical to SEQ ID NO: 109142

SEQ ID NO: 730903 - DNA, 689 bp, Homo sapiens
agggcaggcagggacagcccctctgatgaggaggccactgggctgagaccaatgaatgagatggagccagccacgtggtgagccagaagagggcatcacagggcttgagtctgggggagcctggctgcccagaggtggcagatgacatgaagaaataaccatgtaagggctggctgtgtatgagagcaagcattgggaaggatgaatgccaactatgttccaggaacttccactgttctcacacacccaggtgagtggtgttcaggtgggtggcacccaggtgagtgacatcccagttgagtggcacccaggtgagtagcatccaggtgagtgacacctaggtgagtgacattcaggttagtggcgtctgtgtgagtggcatcatccaggtgagtagcttccaggtgagtggcacccaggtgagtggcattcgggtgagtggcatccaggtgagtgatatcatccaggtaagtggcacctaggtgacatccaggtgagtgacgacatccaggtgagtgacatcatccaggtaaatggcacccaggtgagtagcattcaggtgagtgacacccaggcgagtggcatccacgtgactagcgttgtccaggtgcataacacccaggtgagtggcacccagttgagtggtgcccaagtgagtcacatccaggtaagtggggtccaggtggtgg

SEQ ID NO: 730904 - DNA, 850 bp, Homo sapiens
agggcaggcagggacagcccctctgatgaggaggccactgggctgagaccaatgaatgagatggagccagccacgtggtgagccagaagagggcatcacaggtccatgaaatgggctcccgaagtccaacctcacagaccccataggaaagcagatggaatctccaagggcaccagctatacatggtggtggaaggaccaacgcatgctctgaatgccactgcggaccacagggcttgagtctgggggagcctggctgcccagaggtggcagatgacatgaagaaataaccatgtaagggctggctgtgtatgagagcaagcattgggaaggatgaatgccaactatgttccaggaacttccactgttctcacacacccaggtgagtggtgttcaggtgggtggcacccaggtgagtgacatcccagttgagtggcacccaggtgagtagcatccaggtgagtgacacctaggtgagtgacattcaggttagtggcgtctgtgtgagtggcatcatccaggtgagtagcttccaggtgagtggcacccaggtgagtggcattcgggtgagtggcattatccaggtgacacctgggtgaggtggcatccaggtgagtgatatcatccaggtaagtggcacctaggtgacatccaggtgagtgacgacatccaggtgagtgacatcatccaggtaaatggcacccaggtgagtagcattcaggtgagtgacacccaggcgagtggcatccacgtgactagcgttgtccaggtgcataacacccaggtgagtggcacccagttgagtggtgcccaagtgagtcacatccaggtaagtggggtccaggtggtgg

SEQ ID NO: 730905 - DNA, 678 bp, Homo sapiens
ggtccctggtacgcggcggatgggcgccggcaggagcgggcagggcgaggcgaaggccggggagggatcgagaacggtgtgggagagctaggctcggggggcgaggccccggcccggcggggcgatggaggcgctgctctccacccccatcaaccccaacaacttccccgccaagctgtggcgcctggtgaacagcccgcgctaccgctccatccgctgggacggccgcggcgaggggctgcttatcgatcagccgctcttcgaggccgagctgctcagcccgcccgggccggggggcggtggcgggactgcgggggccggggccgagcccgagctcttcaaaaccaccagcttcaccagcttcatccgccagctcaacctctacggcttccgcaaggtggtgctgggcgggccggggggcggcaaaccggcaggcaatgggccgctccatcacttccacaacccgcacttccgccgcgaccagccacagctgctcgtgcacctcaagcgcctcaccagcgccaacaaggccaagctggcggccggcctggaggtgccctgccgcccgaccaacacgcttccagcggctgctcatcacctcggcctccgccgccaccgcgccactgcagcaccagcagccgccgccgcccgcggggccccggcccgagccgcacggtg

SEQ ID NO: 730906 - DNA, 708 bp, Homo sapiens
aatgttaacttccattatgtgagagcagatgaaaccaaagccttgggcccacacagcaaacctttgggtagcaacgagttctagaaaaatggagcctaaggagtccagattgtttttccttgaaataccaagcaagtctaaaatgattactacccatgagatatatttttaatgatgttaggtttgggggtgtgttagattgttttgcattgctataaatgaatacctgaggctgagtaatttgtaaagaaaagaggtttatttggctcacatttctgcctggcagtggctatagttggcttctagtgaggcttcaggaagcttttactcatggtagaaggcaaggggggggcaggcatgtcacatagcaagaggaggagtgagagagagaaggaggtgccaggctcctttaaattgtaaactaacagcaagaactcactcattcccatgaggaagggaccaggccattcatgagggatcctccctcatgacccaaacaccccgactaggccctacctccaattctgaggatcacattccaacataagattcagagagtgaaaacattcaaagtctaccaggaggtgattaaagtgatatgacaatgtgaggtatatgttacctggaaggtagtaggagcagatggtgggaagaagaaaagtgtagcaactacccagtcctctgcatgaaagagccctcctcaaagag

SEQ ID NO: 730907 - DNA, 1025 bp, Homo sapiens
aagtagttgcgggagggcgcggagcacgccgggaagctcgcgggtcggcaccgggacagctcccgggcgccgtggaatgcacacgtcccgcacccggaccttccggtcagcttcccggctcgctgtctgatgcccgcggtagccaatgagctagtggtgtttgtcctgctccgtccccgccctccaggggaaccaatcccattgcaggagaggcaggacgcgcaaaggcccgaaagaggagctgggcggggtggggggaaggcggaggcagtctagtaatgtaaagctccgctgagagggagagtgctgaagaaggggacagcctctgtacctgcggcgcggcccgaggggcggacgcgagcggactgacgcgctggaggctgtttatagcgctgtcaggacagcgcggggagtggaggcagaggcctgagagctccccggattatggtgcactgagaaggcatctggaagcctgggccctcatggcatccaacgataaaggcatggcaccctcgctgggctctccctgggcctcccagatggggccctgggatgccatcctcaaggctgtcaaagaccagctcccgtctctggactcagactcccctttgtcggactatggggaagaggagctgttcatcttccagcgaaaccaaacctccctgattccagacctgtcggaggagctggctgaagatcctgccgatggcgacaagtccagggcctgggtcgctgcagctgaagagtcccttcccgagccagttctggtgcctgcagaattggccacagaacctgggtgcagacagaacacaaggacaaaggatgcatcctctcaggaaggaagagaccctggcaggccttttgaaagctctggtgaggtcagcgctcttcttgggatggccgaggagccccccaggtggctggaaggcgaccttggaagcctgtctttcaacaccaaaggatcccagggtcctccctgggacccacaggccgaagccactctctcctgccatgaaggagaccca

SEQ ID NO: 730908 - DNA, 809 bp, Homo sapiens
  misc_feature (50)..(50): n is a, c, g, or t
  misc_feature (498)..(498): n is a, c, g, or t
  misc_feature (670)..(670): n is a, c, g, or t
  misc_feature (680)..(680): n is a, c, g, or t
  misc_feature (692)..(693): n is a, c, g, or t
ggtctggggatgcgaccaggaccctggggaaaggaagccagcccccaggnccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaaggtcccacatttgaccaaggagtgcctggtagcgttgagatgtgggagagaatgcactaatctgaaggcagccctgcgtcaggaattcagcaacctggaagagattcttgagtatcagaacaccaccttctttnggtggaacctgtatatccatgattgattacctcctctggccctggtttgagcggctggatgtgtatgggatactggactgtgtgagccacacgccagccctgacggctctggatatcagacatgaagtgggaccacacagtctgtgctcttctcatggataagagcatatcnagggctactngcatctctattnncagaacaacccgtaatgcctttgactatgggatgtgctgagtctcagttgtacaacccttcgactgtcaaaaatccccagttgatgagagtctacgtcacggcacggctgggaaac

SEQ ID NO: 730909 - DNA, 840 bp, Homo sapiens
  misc_feature (81)..(81): n is a, c, g, or t
  misc_feature (529)..(529): n is a, c, g, or t
  misc_feature (701)..(701): n is a, c, g, or t
  misc_feature (711)..(711): n is a, c, g, or t
  misc_feature (723)..(724): n is a, c, g, or t
gctccttcctcaccgggctgactagcctctcctttccctgtccccctccatcgctgctctgcaggaagccagcccccaggnccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaaggtcccacatttgaccaaggagtgcctggtagcgttgagatgtgggagagaatgcactaatctgaaggcagccctgcgtcaggaattcagcaacctggaagagattcttgagtatcagaacaccaccttctttnggtggaacctgtatatccatgattgattacctcctctggccctggtttgagcggctggatgtgtatgggatactggactgtgtgagccacacgccagccctgacggctctggatatcagacatgaagtgggaccacacagtctgtgctcttctcatggataagagcatatcnagggctactngcatctctattnncagaacaacccgtaatgcctttgactatgggatgtgctgagtctcagttgtacaacccttcgactgtcaaaaatccccagttgatgagagtctacgtcacggcacggctgggaaac

SEQ ID NO: 730910 - DNA, 934 bp, Homo sapiens
  misc_feature (663)..(664): n is a, c, g, or t
  misc_feature (688)..(689): n is a, c, g, or t
  misc_feature (740)..(740): n is a, c, g, or t
gcaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggnngatgggccatgctttcctaaggtnnggtcgaaccaggaagaggcctgagtgctacctcgtcctgatctacctggcntggtgggcgcgtgaccatggtccagctgcagcatccggcgcctgaccaactccttttcgagttaaaggtctgatgagggcccagtcacagtggagcagctgctggagcaacgtgtgcctgatctggcctacggaccgtgagagaccaagactgacagcggctccacacggggcaggctcggccgggactggcac

SEQ ID NO: 730911 - DNA, 1057 bp, Homo sapiens
  misc_feature (465)..(465): n is a, c, g, or t
gcaatgaaaagggagagagagaactagaaccaatcacaacctctcaagccctgcagattgctggcagagctggcagattcagctcacggtttaaagaaggagaggttacaacaatgaatcatgaagatctcagtttattaaaggaaattttgaagaggcctgtggatcctataagggcagctggctcttcatccaactgctgagcagattgaaatgtttgcctaccatctccctgatgcaacactgtccaatctcattgatatttttgtagacttttcacaagttgatgggcagtattttgtctgcaatatggatgattttaaattttctgcagagttgatccagcatattccactaagtctgcgagtgaggtatgttttctgcacagctcctatcaacaagaagcagccttttgtgtgttcttcactgttacagtttgccaggcagtagcaggaatgagccccngacctttgcatggttacgccgatacatcaaatggcctttacttccacctaagaatattaaagacctcatggatcttgaagctgtccacgatgtcttggatctttacttgtggctaagctaccgatttatggatatgtttccagatgccagccttattcgagatctccagaaagaactagatggtattatccaagatggtgtgcacaatatcactaaattgattaaaatgtctgagacgcataagctgttgaatttggagggctttctatcagggagccagtcacgattgtcaggaaccttaaagagccaagctagaaggacacgcggcaccaaagctctagggagtaaagctactgagccacccagccccgatgcaggagagctgtcccttgcttccagattggtgcagcaaggactcctcactccagacatgctgaaacagctagaaaaagagtggatgacacaacaaactgaacacaacaaagaaaaaacagagtctgggactcatccaaaagggacgagaagaaagaagaaggaacctgattcggactagttttctgttcctgtttttttttttttatttaattttgta

SEQ ID NO: 730912 - DNA, 841 bp, Homo sapiens
  misc_feature (8)..(9): n is a, c, g, or t
  misc_feature (698)..(698): n is a, c, g, or t
agcggagnngggagagatgtgagcctcgtaccaggaagatcatactgaggccaccaggttgagagccgcctggctggggggcttgtccggggacagcaggggcagaggcatggaggttcacagccaggaaatcgtgcagtgaacctgtcccctccggtcacaacatcaagagctgaactgggactagaagtcatcgccccagagctttttgctaccagaactgccgggtgaaaatctttggaagagaagtttgagaacctgttaaacaagctctctaggtaattctgtgcacgttcagtctgagaactgctgcatctgaagaggccctccagaaaaaggaagaaaagtgggaaggtgaccccagtggctgaaagcaggagaaagtgtttcatcacgggccctctccttctgaatactatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatattttngatgaaaatcttcaccctctttcgaaatccgaagtgccaccagattatgacaacaaaaccagagcagaagcagattaccggttcggtcggaccctgtcagtgctgctcagtgacggtgaatgtgccatcgtcacctggtgtac

SEQ ID NO: 730913 - DNA, 1063 bp, Homo sapiens
  misc_feature (8)..(9): n is a, c, g, or t
  misc_feature (920)..(920): n is a, c, g, or t
agcggagnngggagagatgtgagcctcgtaccaggaagatcatactgaggccaccaggttgagagccgcctggctggggggcttgtccggggacagcaggggcagaggcatggaggttcacagccaggaaatcgtgcagtgaacctgtcccctccggtcacaacatcaagagctgaactgggactagaagtcatcgccccagagctttttgctaccagaactgccgggtgaaaatctttggaagagaagtttgagaacctgttaaacaagctctctaggtaattctgtgcacgttcagtctgagaactgctgcatctgaagaggccctccagaaaaaggaagaaaagtgggaagcactgtatacacagaagcttcccaaggaaaagctatgaactctacactttggaggaggttgaggcagtgggggtgagagaaggtgactcagggagttgtgcaaatgactgactcatatttcatggatacgagtatggctgatgtaagactgcagttatctcctcctgattcaattaagcacagggaatctactagagggccctgcctccacttccatcaaacaagggaagaaaatgctcttcatgaggtcactgttaactgagccagcatagggaggctcagcagatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatattttngatgaaaatcttcaccctctttcgaaatccgaagtgccaccagattatgacaacaaaaccagagcagaagcagattaccggttcggtcggaccctgtcagtgctgctcagtgacggtgaatgtgccatcgtcacctggtgtac

SEQ ID NO: 730914 - DNA, 465 bp, Homo sapiens
tgggtgtgttcatgcacctacgagtcgcagaagtcccgggcagagctggtggggcagcttcagaggctgggatttgacatctctgagcaggaggtgaccgccccggcaccagctgcctgccagatcctgaaggagcgaggcctgcgaccatacctgctcatccatgacggagtccgctcagaatttgatcagatcgacacatccaacccaaactgtgtggtaattgcagacgcaggagaaagcttttcttatcaaaacatgaataacgccttccaggtgctcatggagctggaaaaacctgtgctcatatcactgggaaaagggcgttactacaaggagacctctggcctgatgctggacgttggtccctacatgaaggcgcttgagtatgcctgtggcatcaaagccgagtggtggggaagccttctcctgagtttttcaagtctgcctgcaagcgatagagtg

SEQ ID NO: 730915 - DNA, 668 bp, Homo sapiens
  misc_feature (234)..(234): n is a, c, g, or t
  misc_feature (374)..(374): n is a, c, g, or t
  misc_feature (544)..(544): n is a, c, g, or t
gaagtcagaccaaaatagcaggaaggtattgcagcaagatggatttgggaaaggaccaatctcatttgaagcaccatcagacacctgaccctcatcaagaagagaaccattctccagaagtcattggaacctggagtttgagaaacagagaactacttagaaaaagaaaagctgaagtgcatgaaaaggaaacatcacaatggctatttggagaacagaaaaaacgcaagcagnagagaacaggaaaaggaaatcgaagaggcagaaagagacaacaaaacacagaattgaaggtggagcctcagccacagatagaaaaggaaatagtggagaaagcactggcacctatagagaaaaaaactgagccacctggngagcataaccaaagtatttccttcagtagcctccccgcaaaaagttgtgcctgaggaacacttttctgaaatatgtcaagaaagtaacatatatcaggagaatttttctgagtaccaagaaatagcagtacaaaaccattcttctgaaacatgccaacatgtgtctgaanctgaagacctctctcctaaaatgtactaagaaatatctgtacttcaagacaattcttccaaaatatgccaagacatgaaggaacctgaagacgactctcctaacaatgccaagtaaccatctgt

SEQ ID NO: 730916 - DNA, 723 bp, Homo sapiens
cactttttcacattcacagtgcttcctctgatatctttccttacatcattatacactgttgatatcattttactcttctttctcttctacatttcttaaattttggttcttttcctgtacatgtgttttagcggggcccttttctttgaactttgtctaattagcctgtacatttttgtttcttttaaggtagaacagatctttttttgtttctccttttaagtctactggttttaaaagaggtaaatgtatccatagaccacagtgccttgctttttcctctgccagcacatggagcacgggattagatgcacaaacctatttagggaactattttggtagatgtttgagtttatacagaaattgcagctggtattttattttgctgtacatttactcaacttgtccattagtatttaactatttccagagtttgtttaggagtaagaattgacccattcgttagtttaccatattttttcctggtataaaaaggagccagaaataagccttattgctaaataattaattatgtaagcccacctaggtcctgcataagatccccctcacatacttcacaatatatatgtgtgtgtgtgtgtgtgtgtgtgtgtgtgtgtgtgtgtgtgtgtgtagtgggataaaaaattatacgtgacgaaaatgacgtgattatatatacttgactacactgattgatgggacaaagtgatctaaagtatt

SEQ ID NO: 730917 - DNA, 796 bp, Homo sapiens
  misc_feature (655)..(655): n is a, c, g, or t
  misc_feature (660)..(660): n is a, c, g, or t
gcagtgagggagagtgaggatggcagagaccagtgccttgcccaccggcttcggggagctcgaggtgctggctgtggggatggtgctactggtggaagctctctccggtctcagcctcaataccctgaccatcttctctttctgcaagaccccggagctgcggactccctgccacctactggtgctgagcttggctcttgcggacagtgggatcagcctgaatgccctcgttgcagccacatccagccttctccggcgctggccctacggctcggacggctgccaggctcacggcttccagggctttgtgacagcgttggccagcatctgcagcagtgcagccatcgcatgggggcgttatcaccactactgcacccgtagccagctggcctggaactcagccgtctctctggtgctcttcgtgtggctgtcttctgccttctgggcagctctgccccttctgggttggggtcactatgactatgagccactggggacatgctgcaccctggactactccaagggggacagaaacttcaccagcttcctcttcaccatgtccttcttcaacttcgccatgcccctcttcatcacgatcacttcctacagtctcatggagcagaaactggggaagagtggccatctccaggtaaanaccantctgccagcaaggacgctgctgctcggctggggcccctatgccatcctgtatctatacgcagtcatcgcagacgtgacttacaattcccccagattggagatggtgcccgccctcattgcgcaaatgggtgcccag

SEQ ID NO: 730918 - DNA, 697 bp, Homo sapiens
gcagtgagggagagtgaggatggcagagaccagtgccttgcccaccggcttcggggagctcgaggtgctggctgtggggatggtgctactggtggaagaccccggagctgcggactccctgccacctactggtgctgagcttggctcttgcggacagtgggatcagcctgaatgccctcgttgcagccacatccagccttctccggtaccagccccctccccagtccacaggctctggggtcctgcctggggcctgacccctgggccctgggcagccaggccaagggcatttttactacttacagaaaattggccaagggcagagggtgggcaggctaaaatgggctgaattccagattgattctgaagaacgacagctgatttctggaagacaggggttgctgaaacctgatgaccgagatggtaggctgtacagatcaatggtgtgggttctgtaaccaagcaacctaggtttgcattctggcttcagcatttctagttctgggcttcttccataaatcggatatcatttcctaactcatataggtggtcggaagtatttacttctattatgtgtacctaacttacacataatgctggatacctaggactctacgtaagtgtaggtgaacacaacatgggggcgtgatcaccactactggacccgtatgtatctgggctcctggagtggagggac

SEQ ID NO: 730919 - DNA, 758 bp, Homo sapiens
gcagtgagggagagtgaggatggcagagaccagtgccttgcccaccggcttcggggagctcgaggtgctggctgtggggatggtgctactggtggaaggtgagccaggcagaactggggtgcagcgggggcccagtgggttctgaggacccaggccaccagtgtggagctggcaaggagaggagaggtccccaaacccagctgggtgtccggtcccattggctgcttcccctctgtgcccggactcggggggtgtctgacaattgaacctgtgaggtgcagcacactgcccgctgggagcagagaggaagccaggcaagggtcagggagggagggactttgaaaggggacatctgcccaggagatgatcaagagccaggctttaggacttttcatgtccctccagccaggagaaaatttaatccactccttggaaaatcctgctgagaatcccacataagatcagtcccccaaaaaggctctggggacagacagctctgcctcctgctcttgtgtggctggaaccaaagtccccttcagctctctgccctcaatgccttgacattccgaatgggtggttgtaaagattaaatgggataatgggtataaagtgctagcctaaatagactctagggtataaaaaggttcattcactcccatcctctccagcccaccatattttcactgtgtctactcctatgagcccaaggcaacttcacctctggaggcaactgggtctgcgaggtactacctcactaa

SEQ ID NO: 730920 - DNA, 3538 bp, Homo sapiens
cccgtggggggctcatcctacccacagtaagagcatcctggcgtgaccccactgaggacttcacctcctctcccttggtggacacctatccaggtgggcatcgtgctgcactattctacactgtccaccatgctgtggataggagtgaccgccaggaacatctacaagcaggtgaccaagaaggcccctctgtgcctggacacagaccagccaccgtaccccaggcagcccctgctcaggttttacctcgtcagcggaggggtcccctttatcatctgtggggtcacggctgccacgaacatcaggaattacgggacagaggacgaggacacggcgtactgctggatggcctgggagcccagcctgggcgccttctacggcccagccgccatcatcaccctggtcacctgtgtgtacttcctgggcacctacgtgcagctgcggcgccacccagggcgcaggtacgagctgcgcacacagcccgaggagcagcggcggctggcgacacccgagggcggccgtgggatccggccaggcaccccacccgcacacgatgcccccggcgcctccgtgctgcagaacgagcactcattccaggcacagctgcgcgccgccgccttcacgctgttcctgttcacggccacgtgggccttcggggcgctggcggtgtcacagggccacttcctggacatggtcttcagctgcctgtacggcgccttctgcgtgaccctgggactcttcgtgctcatccaccactgcgccaagcgtgaggacgtgtggcagtgctggtgggcatgctgcccgccccgcaaggacgcccaccccgcacttgacgccaacggggccgcgctgggccgcgccgcctgcctgcactcgccgggactgggccagccacggggcttcgcgcacccaccgggcccctgcaagatgaccaacctgcaggccgcgcagggccacgccagttgcctgtcaccggccaccccgtgctgcgccaagatgcactgcgagccactgacggcggacgaggcgcacgtgcacctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaagggtaaattgctagaaggcctgccgtttggcaccgacgggaccggcaacatccgaacgggaccctggaaaaacgaaactactgtgtagatgggggcagaggacacggtgttcctggaggagcttcagagcagagtggggggcccatctgccacatgaggtcactgggggtaccgaagtgaccccgcctttcagaagccgttcacacccctgccccttccttgtgatcacacccctgccccttccttgtgatcacacccctgccccttccttgtgttcacacccctgccccttccttgtgatcacacccctgccccttccttgtgatcacacccctgccccttccttgtgttcacacccctgccccttccttgtgatcacacccctgccccttccttgtgaaagacctcagcggggaaacgctccgggccacgcccactccccttatcccaattccgcgtgctggtcccgcacacggtcatccggtttctgtcctgtgatctccagtcctggggcaccctagaggcagagcaggggattccatcaaaggacccactgagaccccagcatggccctgcccgagatgccctgctgcccacggagtcctggcttcccctggtgtggccgggcagggccgagatcgcaggagggggctgccctgacctttcccagtgttcaatgtgtgtgtcttgcgttctactccgggggtggcggcggcaggtctgtccccagcattctcgctctgggcagaaccctcgggaccctccgctgtcgtgtgtctgagccacccctgcagcttcacagggcccctgcacacctctgcccactcagtgtgccctgtcagccctgtccttgtcgtagccccagccctgcagggctgagagcaccacagatgctgggggctgctctggactttggggatggctgtcagcctcagagggccaatggggggctttcacgggcccaaggcttgggaaaatgcccagacatcctttagtgaagactcgacttccaaaaccagccaccgctgggactggattccactccagtataggcacttagcaacacgaaggtttattccaaaaagaaaaggggctgacagacgggagattctcatggacaaaatccctttccctttttctcgtctccatgaacatctgggtaccaagccctgactcaaaggacagatgtggatgacagcaagacttctgtgaaagcaagtggcccgtccctaggtgggagggagtccagagggtcatgggtgtgaaactgtgcacagctttccctccctccctcttcctccttgtctgtgacacatgtgcacccacacacacacacacaaacacatgtgcatatcacacacatgcacacacacaaacacatgtgcatatcacacacgcgcacacacccaaacacgtgcatatcacacacatgcacacacacaaacacgtgcatatcacacacatgcacacaaacgtgcatatcacacacacgcacacacacccaaacacgtgcatatcacacacacgcacacacacaaacacgtgcatatcacacacaaacacacgtgcacacatacttaacacacacttgcacctgctgtgcacatgtgcacacacacgtagtagtgtgttttccagccacccacacactgggtttgcattggagattgtttcaccctgcaaacgtcaacgtcagcagactcgtcggtgcgctgtgctatccggttgggaggtctcaccaggagcagagcctccctaacgtgcacctccgagaagaggggtgtcggggagtgttcccagcacctgctcggtggaagggctctccggagactggcactcagtatctgagtatgaggagcctcacttcccggggtgtcggtaaacttgaccgtgactcagtaacccacagcgtgctcctcccagcaaaccccgtgtgtccttacaggtcgaccagacgggccgtcggaggaccaccaggtggctctgcctctgcctcaccttctcacctgcttccatagctgatgtgaacccgaatccccacgctgtgctgtgtacgcactgtaggtgcagaaccgtccacacaaaaatacagtcttggcattgtt

SEQ ID NO: 730921 - DNA, 1057 bp, Homo sapiens
  misc_feature (197)..(198): n is a, c, g, or t
  misc_feature (200)..(200): n is a, c, g, or t
  misc_feature (202)..(202): n is a, c, g, or t
  misc_feature (204)..(204): n is a, c, g, or t
  misc_feature (283)..(283): n is a, c, g, or t
  misc_feature (382)..(382): n is a, c, g, or t
  misc_feature (893)..(893): n is a, c, g, or t
  misc_feature (916)..(916): n is a, c, g, or t
  misc_feature (934)..(934): n is a, c, g, or t
  misc_feature (936)..(936): n is a, c, g, or t
cgctcactgctgctagtgttcctctcctgctccaggacctccgggtagactcagaccccgggcccattcccagactcagcctcagcccggacttccccagccccgacagcacagtaggccgccaggggcgccgtgtgagcgccctatcccggccacccggcgccccctcccacggcccgggcgggagcggggcgccnngngncngcggggccaggccgaaggagagtttgtccgattcccgagacctggacggtcctacgacagctcacgggcaccctccagngcccactaaaaaagcgctgaagcagcgattcctcaagctgctgccgtgctgcgggcccaagccctgccctcagtcagtgaaaacagcgtggacgatgantttgaattgtccaccgtgtgtcaccggcctgagggtctggagcagctgcaggagcaaaccaaattcacgcgcaaggagttgcaggtcctgtaccggggcttcaagaacaagtcttccctcccatcacatgagccacgtggaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaangatggtgtggtgaccattgaggnattcattgagtcttgtcnanaaggatgagaaccatcatgaggtcccatgcactctttgaccatgtcatcttagcccccaggagaacggggtcaaagtttcctgggggacccagctcaaccctaataccgcgggctcaacct

SEQ ID NO: 730922 - DNA, 909 bp, Homo sapiens
  misc_feature (197)..(198): n is a, c, g, or t
  misc_feature (200)..(200): n is a, c, g, or t
  misc_feature (202)..(202): n is a, c, g, or t
  misc_feature (204)..(204): n is a, c, g, or t
  misc_feature (283)..(283): n is a, c, g, or t
  misc_feature (382)..(382): n is a, c, g, or t
  misc_feature (862)..(862): n is a, c, g, or t
  misc_feature (885)..(885): n is a, c, g, or t
  misc_feature (903)..(903): n is a, c, g, or t
  misc_feature (905)..(905): n is a, c, g, or t
cgctcactgctgctagtgttcctctcctgctccaggacctccgggtagactcagaccccgggcccattcccagactcagcctcagcccggacttccccagccccgacagcacagtaggccgccaggggcgccgtgtgagcgccctatcccggccacccggcgccccctcccacggcccgggcgggagcggggcgccnngngncngcggggccaggccgaaggagagtttgtccgattcccgagacctggacggtcctacgacagctcacgggcaccctccagngcccactaaaaaagcgctgaagcagcgattcctcaagctgctgccgtgctgcgggcccaagccctgccctcagtcagtgaaaacagcgtggacgatgantttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaangatggtgtggtgaccattgaggnattcattgagtcttgtcnanaagg

SEQ ID NO: 730923 - DNA, 634 bp, Homo sapiens
  misc_feature (525)..(525): n is a, c, g, or t
  misc_feature (548)..(548): n is a, c, g, or t
  misc_feature (566)..(566): n is a, c, g, or t
  misc_feature (568)..(568): n is a, c, g, or t
aagtcttccctcccatcacatgagccacgtggtgagtcctctggaggcttgaagattatccccctccctgggagtcttgggccatggagggtgggggcggtgaacggaaggggattttgtctctgccctcagcctggtgccctctccttccaggaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaangatggtgtggtgaccattgaggnattcattgagtcttgtcnanaaggtacagtccctgcctctacattaccctgacctggactcaggcctgatttagtaatgcagggaa

SEQ ID NO: 730924 - DNA, 450 bp, Homo sapiens
ctttatcttttaaattgcccactaataccatgaggtttaaggtgtggggtggatgctgcggcatcggaggaccctgctggtggaggaaatggttcacgcccgtccccgttccctttgcaggcttgctattgtgcgtctgtgattgacaagaccacgaggctgagcgcgccctggagatttttctataaatggcttaacaccccagtctagactatttgctcggatataagggagacaattgtttttttgttctttgccggcgaaccctggctctgtagggctgacctggaatttaaccagtcttccctgagccggcggaggaggacaaaaaccgccgcgaccccggcagggtgggaagtgcagggcagcgctcccaagacacgcttgttggaggttcgggcctgggtgcttggttgtctgagcctccttttttgtgtttgcctgggtcct

SEQ ID NO: 730925 - DNA, 447 bp, Homo sapiens
cgcctgctttcgcttccagccgcgcgctccgtgccactgccgctctctgcagccccgcgtccccgcagcctccccatggccagcccgcttcgctccgctgcggcccttgcccgccaggcttgctattgtgcgtctgtgattgacaagaccacgaggctgagcgcgccctggagatttttctataaatggcttaacaccccagtctagactatttgctcggatataagggagacaattgtttttttgttctttgccggcgaaccctggctctgtagggctgacctggaatttaaccagtcttccctgagccggcggaggaggacaaaaaccgccgcgaccccggcagggtgggaagtgcagggcagcgctcccaagacacgcttgttggaggttcgggcctgggtgcttggttgtctgagcctccttttttgtgtttgcctgggtcct

SEQ ID NO: 730926 - DNA, 669 bp, Homo sapiens
cgcctgctttcgcttccagccgcgcgctccgtgccactgccgctctctgcagccccgcgtccccgcagcctccccatggccagcccgcttcgctccgctgcggcccttgcccgccaggtacctcgaacccgggcgtttgcggaaggggggaggattggaacccgggtctcggtagctcgcgggcctggccgggcgccttgtcgccgtttcctgcaccatcctccttcgccttgccctccattccgcctccagcgaggcgtcttcccttccccgcatccctgcccgaaatctggagtcccagcctgcaatctccacctcttcgaggttcccgctgcccaggcttgctattgtgcgtctgtgattgacaagaccacgaggctgagcgcgccctggagatttttctataaatggcttaacaccccagtctagactatttgctcggatataagggagacaattgtttttttgttctttgccggcgaaccctggctctgtagggctgacctggaatttaaccagtcttccctgagccggcggaggaggacaaaaaccgccgcgaccccggcagggtgggaagtgcagggcagcgctcccaagacacgcttgttggaggttcgggcctgggtgcttggttgtctgagcctccttttttgtgtttgcctgggtcct

SEQ ID NO: 730927 - DNA, 572 bp, Homo sapiens
tgcccctggagtagaggacatcagcgggcttccttctggagaagttctagagactactgcccctggagtagaggacatcagcgggcttccttctggagaagttctagagaccactgcccctggagtagaggacatcagcgggcttccttctggagaagttctagagaccgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctgggagagttctagagactgctg

SEQ ID NO: 730928 - DNA, 647 bp, Homo sapiens
gccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatatt

SEQ ID NO: 730929 - DNA, 391 bp, Homo sapiens
tggagaaagttggaggtggtggtgatttcagtcgccttggccgccttgagccggagctgagcggaggcactgggccgagcctgcttcccgggccttcctaccatgccagggctgctccctgcctccgccaccctggcacaccttcacccgcgtaccgcctcctccccgtcgctctgccttttccaaaactcacttgggccctccgtgcgcagggttcttttttggtttttctgtaaaaatcaaaacaaaaaacagagacttttgagaggagcagatgccacctaaagtcccactgcattccctgcaaagcgctcaaatgtggaagccagtcattggcatttttattttttattgattgattgattttttcaccagtggctttttgtaacct

SEQ ID NO: 730930 - DNA, 532 bp, Homo sapiens
ttaaaactacatggaattgttctttatggattatcatggttaatttcaatttttaaaaatatgcaggaagttaaaagactataattccagtattggaagccagtttaagagaatatgactatgtagttacttttaatggaaaggggaagaagaggaagaaaaaggaaagacattgtgttcgtatcttctctgcaacaattataaaatgaatgaggaagtattttggtgtttctaaggtctttccatgatcttgaaatctatatattatagtcatttagtctgtgaaccattttaacaattgggtttcatgttacatatctttaaatttttatgttgaaaatttatagctgtgacacaagatgatagaaattgctcatgctcacatatattccaactggcttttcagcttgctcccttctcttttaatttcagctatcatttttagagccttacagtcacaattgttcttaactatcccaaatttttatttcctatttggactgacttctccataattttagtaactaaatga

SEQ ID NO: 730931 - DNA, 565 bp, Homo sapiens
tgtttacaaggtattggctgaggaactttgtgttggaagttaataaacatcagtgtcaaattggaaagattttgcatatttatattgcaaggaaaaagtcactaggctttcttacttgattaggaagggcacttccatatgtcatctctatgatttgaagtggactatacttctcccttctattggtttaagaattacacacactgtatattcttctaccacgtaataacttagaaggatttattgaaaagttcaaaatatgctgtttttgtttttattccattgatgaaataaatgcatgaatgggagtaacagaatatattaacacatctagagaaaaatattgttgcttatccctgcatagctgctggtacatcacagatagcaacaacaaaaatccataaccagtactatgatttggatgtcttctccataactcatgttgaaatttaactgccattgtgatgatcttggcaagtggaacctctaagtggtgattaagtggcagagtcttcataaatcctgttatttcatgagtggtttagactcctgggaatgagttccc

SEQ ID NO: 730932 - DNA, 516 bp, Homo sapiens
atcaagataactggctgatattttcaaaaagacagatttctttctaataattatagctttcttaaaaaaaaaagagagggggttgcattgcaacatcctcattccccatggctgacagtcagcacagcaactagaaaggatctcactaaatacactgtcaaaaatgtttatgcttaaaatggctggcagatatagcattcccagttccaggtttcatttttgtaccttctctattcaaaaaagcctctatccagcaggaaaacgtgcagaatactcacagacaacagagctgctctacaggctgtaaaggatccacagatacctcatgagaggagcaaacaacaccgagtacagccaactacacatcctagaaaacatggctttacggaatcccctcttgctaagtggatgaatttctacttcttccttttgccttaatgagatcacatggacacaggaaggggaatatcacactctggggactgttgtggggtggggggagaggggagggatagc

SEQ ID NO: 730933 - DNA, 388 bp, Homo sapiens
caaacttgtaatcatgcctacggctaacctctgggttgagagatgaggtttcttttatgctagtttccacctcttgaggcacgaccgtcactcaaatttgttgcattactggattcatctcttttggcacaatacaatataaaagtttggtgtcacttgggttgtgtcatgtttgaagtcatagcattagtgctcagcttacctattcagaaaagtaggtcatgaggctcaagtatcttcatctcattaggaaaaaacagaaatactttaaaaattctattaaactaatagtaatcatgatggccttacatcttatttatccttgtatatatatctgagtttagaattttcataaatgatgagaatattagtatttttgatgagcaag

SEQ ID NO: 730934 - DNA, 583 bp, Homo sapiens
ctaacctcatgatccacccgcctcggcctcccagagtgttgagattacaagcgtaagccactgtgcctggccgatttttcgcctttaaagctggaacaccaaagtgtccccttataagagaaaaccagaaataaacctattccctgcaaatcctaagaaccacccagcacactaagtctactaggagactttcctcctttactgtaggaaagtccccaaagagtccccttgtaaaagaaaagcagaaataaacctattctctgcaaaaattttcaaaaagaagaaacttattttaaaccatgtgctaagcagagcttagggaagtggggtctagcccccaaaggtagccgttaggagagtttacaaatgaaattcacatgagtttagattccaaaacatctcaaggaaaaatgtaatttaaagtgatcctggacagtaagtgtccccagatgcccagaaaaatcaaatgcaaatgctctctagctgaatttaccttcattgcagcaaatgctgttgcttatccagaacacaccagtacattcacatgagctttttacatctggtgttgattctgattgagcca

SEQ ID NO: 730935 - DNA, 580 bp, Homo sapiens
gtgaaattcaaggatgaattagacatagccattatttattagacgctcacattctgcctctggtagaagatgggactacatcttacaaagccattcttcctcaagaaattttttgctagtttgctttaggaataattcaaatagttgggcagacattgactttcttaacactattagacaaaacacatgtaccaagaaaactagagcattttgatttcccaatttgttcaatcctgttttattgaaacaaagatgggaagaaaagcagatggaaataggaatcacaaaattagacaatgtttattatacgcctatttcagacaaatctcaaaaagtgcctttagtagaaaataaagccataaagaaaatggagaaggaatgggaaatgtattggaaacgataacaggggcttcgagattaaaaattgtagagaaaatttctcatctgaggccaatggaattaaaaacagaatacatttgctggactagatattattaggtaagaggatgagaaaataaatattccaactcggcgaaagctaaatggacagaatgcaatttaagagctatttgggttgaga

SEQ ID NO: 730936 - DNA, 680 bp, Homo sapiens
aagctgcctagaagcaataattgaagggtcagacaaaaataactgtccaaatggtgttcttataaaatgttccagagtaacttgtagttagaaaaagttagacttgaaggcaaaaaaaaaggtgtaatcttgaattttgtctattgatcacatgcagaagagctggttgtatatattttcataatactttggtagccaatacaatttatggcaaaatatttttctgagccaaaagataaacttataagacaaagaattgtagccatgtatttaaaaagataatgctttgttttagaaatgaagtactttgcatcatgcattggaatgaaaatagaatgaacaaacaactaaggaaatatagtttgaagttattcagcaaacacatgatagttattttcattgtttctgaaattatgttatatattttaggaaggtgcacactataagcttctgttgtgatagatataaaacaacaaagacaataacaacacacatacaaaaacaaacccaaccaaaactataaaatgtgtcacattcctggagggaagaataaaagcccaccaacttcacaaaaataaataaagtttttgtgtagattaatatctacctattaatggctcatatttcctcagaaaaaaactctaattagaaatattctgtagatgaaggatgggaagaga

SEQ ID NO: 730937 - DNA, 519 bp, Homo sapiens
gcaggtggtgtcatcatgcttggctacttttttgtatttttggtagagacggggtttcgccttgctggccgggatgatctcgatctcctgaccctgtgatatgcccaccttggcctccccaggtgctgggattgcaggcatgagccaccgcacccggcttgcctgtctctattttaaaaaagccaactcagatcaagaattttgattatccagacttgctttattttcttctgtggtatttttttcctttacttacattataaaattcctcagatgcatgtgaagtagagagaatagtataatgaacctccatatacttaccacctagcttttttttttttgagacaggatttcactctttcgcccaggcaggagtgcgatggtgcgatctcagcttactgcaacctctgctccccgggttcaaccgattctcctgcctcagcctccaagtatttgggaggcccaggcagtggatcacaagatcaagagatcgagaccattctggccaacatggtgaaa

SEQ ID NO: 730938 - DNA, 358 bp, Homo sapiens
  misc_feature (144)..(144): n is a, c, g, or t
tttttcttatgatatttctctcccagtttcttggttataattttcacaataatttcaggctgtagccagtagtctgttcgggcagttcttttcttttcctcttcaatctccatgatttcatccagtgcagatttctttttcttnttttctttagactgagttgagctctgggaagattcttttcgtttcactgatgctgaacttcctatcgtcttcagtgcactcggtcccagagtacttgacttggaagatgttgctccggatgagctacatgctcctttactcaaattaaacgtgactttctcttcatcattttctctgcttaattccgtaaaagtagggacctcctgttccttct

SEQ ID NO: 730939 - DNA, 445 bp, Homo sapiens
  misc_feature (134)..(134): n is a, c, g, or t
  misc_feature (357)..(357): n is a, c, g, or t
ggaccatcatcctaaattattatgtctgttacatccatcacagcactccaaaaggtcgccgcaaccccgaggtcagtttcctggtgtagttgtccctcagctccatgcgacccacgcgaacaatctgacagacnaaactgattttctcccttttcaggtctttgcttccgaggtcagtaaacacggctcgcaaattatgtaatctgtctatgtctttaggtaatcctgaactggaccagcgaaccaggtagttctcactgatgaatttggactccacagggtcatatagagacatgaggacttcagcatcttctcctattttacaaaccacatttttgaggttcacaaacaaggccngagaaggggttgcagcaaacttggcttgtctgttaatatctatgttctgcttttgagatttttcctcttgtaacctttcctccacttg

SEQ ID NO: 730940 - DNA, 558 bp, Homo sapiens
  misc_feature (24)..(24): n is a, c, g, or t
gctatcatccgaaattattatgtngcttcagatgcgtgtcacagtttgcctagacgcatccaccaacttttaatggtgtattctcttagtaagaggaacccagcttatattcagctagccagtaacccaaataaatgtccttattcatattcacttatgtcttatgagaattatttgcaatatatataccaagagtaaaataactgggttgtcaggtatatagatatttaagcaaagtagatattaacaaattgtcttctggaattgtttcattagttaaggctcccaatggcgatatataagcattctttttctcagtatctttaccaatacgtgttactattcatcattctaattttgccaacaatatggacataaaatgatatacggatgttttaactgtttatttttcttattataatgcattcttgttaactattcagatttcctctctgatttatgctgattcatatgttttcagaagcattttcttctcctaaaatttccatattttcttattaattgttaggagttccataataatttaggatgatggtc

SEQ ID NO: 730941 - DNA, 525 bp, Homo sapiens
  misc_feature (33)..(33): n is a, c, g, or t
  misc_feature (40)..(42): n is a, c, g, or t
  misc_feature (44)..(44): n is a, c, g, or t
  misc_feature (442)..(442): n is a, c, g, or t
ctctagagaatccggtgtcgacttctgctctgncagagannngnggtcttacagaggctctttactgaccaactgaagtatagacttactgctggacaatctgcatgggaatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagaaggtcncaggtgctggtgcttggatttagccaggctcctccgagcacctcatgcatgtcccagcccctgggccctagccctttcctgcc

SEQ ID NO: 730942 - DNA, 379 bp, Homo sapiens
  misc_feature (49)..(49): n is a, c, g, or t
  misc_feature (55)..(55): n is a, c, g, or t
  misc_feature (59)..(59): n is a, c, g, or t
  misc_feature (61)..(61): n is a, c, g, or t
  misc_feature (66)..(66): n is a, c, g, or t
  misc_feature (83)..(83): n is a, c, g, or t
  misc_feature (94)..(94): n is a, c, g, or t
  misc_feature (159)..(159): n is a, c, g, or t
  misc_feature (171)..(171): n is a, c, g, or t
  misc_feature (201)..(201): n is a, c, g, or t
  misc_feature (235)..(235): n is a, c, g, or t
  misc_feature (313)..(313): n is a, c, g, or t
  misc_feature (319)..(319): n is a, c, g, or t
  misc_feature (336)..(336): n is a, c, g, or t
tgcagggaggcgtcaaggactgggcaggaggtgataataaggtgaggtncaactntttncngcttntagcttttccgtatgtngaattatttcnttaggaaaaactctcagaagtagaattaacagggtaaaaagaggtagaagcatttttatggtttngacacacaggcngttttagaaaggaccattctggttttcacnaccatcactaactagagtccaaaaatggcacctngttcaatttgcatttctctgatactagtgaggctagaaatttttccacatttgttatccagttctacttccttgtttncaggtngtcagtttattttcttngatcatctatcttccttttttttttttttttttcgaggggggg

SEQ ID NO: 730943 - DNA, 538 bp, Homo sapiens
gtctagaggatccggctcgcgagcagataccaccccaaagtcgagggatgtacagcaacagaatgagaagctacaaacaagaaatgggaaaactcgaaacagattttaaaaggtcacggatcgcctacagtgacgaagtacggaatgagctcctgggggatgatgggaattcctcagagaaccagagggcacatctgctcgataacacagagaggctggaaaggtcatctcggagactagaggctggataccaaatagcagtggaaaccgagcaaattggtcaggagatgttggaaaaccttagtcatgacagagaaaagatacagcgagcacgtgaaagacttcgggaaacagatgctaatttgggaaaaagctccaggattctgacagggatgttgcgaagaatcatccagaaccgcatcctgctcgtcatcctagggatcatcgtggtcatcaccatcctgatggcgatcactttttctgtcagaagacctgatgtatctgctcgcgagccgggatcctctagatcaacgcgcat

SEQ ID NO: 730944 - DNA, 336 bp, Homo sapiens
gtgctgaggaggaaccctggacgccactatttcacatggaagaggcaggcgacatgcgagtgctgaggaggaaccctggacgccaccatttcacatggaagaggcaggcgacatgcgagtgctggagaggaaccccggacgccaccatttcacatggaagaggcaggcgacatgcgagtgctggagaggaaccccggacgccaccatttcacatggaagaggcaggcgacatgcgagtgctggagaggaaccccagacgccaccatttcacatgaagaggcaggcgacatgcgagtgctgaggaggaaccccggacgccaccatttcacatggaag

SEQ ID NO: 730945 - DNA, 558 bp, Homo sapiens
  misc_feature (9)..(9): n is a, c, g, or t
gtgatctanaggagctgtcacactgggttcgagtctaaatggaataatagatatgaaataactcaacaagtaaatagctcagctgttggaaatcaaacaaggagaagaaaagaaaaaggacatagtgctataaaagaaaatctttataaaattcaaaaccatttaaaatatgttgccattgatttccttattaacaggttttaatacctccatctttctctaatagttttcagtttattagaaacagtatgtgaactttttagattaaaaatttccagcataggtttatcacttattatatccttttattccttgaaatggatgattgtcaggcagaaatttaggacaaaggagctggaaaatattcatgagactcaggaacaaagctattactccaactgtaaggtttcattataagcacgtaaatatagttcaaagttaccacatctgtaaactcaaaaatgctgctcacttggctggatccaatcaatatttgctaaccattattttagttattcttcatatagacaggcgctttgtttcttagaagaaatcact

SEQ ID NO: 730946 - DNA, 187 bp, Homo sapiens
caaaaagcaggaaccgttcgtgggctttgggtttgacaagccagactccctattcttagatctcctggcttgacaggacccaagctctgcccctatgctgggtaccaagggagttctcctagctgtggcttctctaggttctaggggtgcaagcctctgtgtgtttgtttgttgtgttggctgtgtg

SEQ ID NO: 730947 - DNA, 571 bp, Homo sapiens
  misc_feature (556)..(556): n is a, c, g, or t
aggtgactctacaggatcttagagcttctgctctgagggagcctgaccttgtagtgggtggaggaggtaaggggcctccctccctaaatctgcctcttctgcaagctacttggagacttgcctagttgtacccacccctccaggtccctggtgctagagcttctgagaagggcctttccctttcctctttgcctgctatataaggcaggctcctgtggctctgctggctcagtgtgggctgcaggaggactgcagactcagctgcaattctgaggggggtttgggaggcttgtgcgaggtctcaggcctgtgtggggagctggtgcctcttcctgcccgtatctttctcttccaagggcagtgctccaaggcagggactggagaagccaaggggagagtctaaaagggctagagcatttttaaaaatagacacagggtcttgggactggggtttcggattgagttgcaagcagggagaaaacctgaaggtcggtgcccctatggggctgaccagtagagaatttcctttactgtatttttgtgtctggggcatctntcctgggggccgagc

SEQ ID NO: 730948 - DNA, 459 bp, Homo sapiens
  misc_feature (15)..(15): n is a, c, g, or t
ttatacggattcgancccagcgccactagcctcatggccacctgtttatttgattatttttaacagagaagatccttttaaaaatatctgttaccctggctggagtgcagtgacgtgatcacggctcactgcagccacaaccttccagcttaggtgatcctcccacctcagtgctccccaccctgagtagctgggactataggcatgtgccaccacaccaccatgctaggctaatggtttgtatttgtttgagagatgcagtttccctaagttgcttaggcttcttttttagactcaaataatctgcatgcattggcctcccttagtgctggaattacaggccatctaaatcttttatctcaggtttgccttgtgacaaaaggaggggtactttttctgacatgatgaggcagagaaaggtgaggtgggtgcatcctgtgcatatgattttctcaggtg

SEQ ID NO: 730949 - DNA, 645 bp, Homo sapiens
gcggtaccggcgcatttaggtgagaaggcactagtctacatgcccatctatctggacaccccacagccactccagcccagcatggccatgctgaatgcagacccctcccctagaccacaaatttctgtttggttttccttcctgatgaacagtttctatcctatgtatggagatgggagtgtggtctggagtggggtcaatgtccccgccatgtggctgcctcactttttaatgggctccaaatgacacagagctgggtcacctgggtctcactgcagtttcctggatcagggatactggaaagatgtcatgttccacatggacaccagcctaagctttaggctgacacaaaaagactccctccagcatgcaagtggcatggctcttttttgttaccacgctgttcccttccacttattggtgccagtgcccctcagtcctcctctggtcctgttggtgtccctctccaaatctgaggcctcccttccttagggagagcatcagtcctggagccctccatcgggagctctccattaagaagggcatcttcagaacccagggtggggcccactcgggcagcaggacacacggtgcagcaggagctcaggctgcaatgcagccactgggtgtgacctaaatcgcaca

SEQ ID NO: 730950 - DNA, 440 bp, Homo sapiens
tcgtaacagccttgtcccagcaattctggaatgacccaggacattgccttccttgtccatgaccgcaatccccttaatggattcaagacttcgggacatgtagacattcattccactggcttgcaccgaggaagatcacaggtaagagtcttttaatccaagggccagtcaggccatacttcatctggacaaactgagggattactcctaagaaagttgaagaagcaacggctcccgccattagtaatgatctttctagtggcttacaagtgtaacttctgtttccattgatgctgttgaacgctgccatgtaggcacagaggaaaacctgaggtaaaatcacggacttgatccctttcagtggcgtcattgacaaaaataccgtgggcgccatgaaaggcaggaacgctgcaggtcgaaaaagcttggggatcaggttg

SEQ ID NO: 730951 - DNA, 581 bp, Homo sapiens
  misc_feature (509)..(510): n is a, c, g, or t
  misc_feature (558)..(558): n is a, c, g, or t
agggcacatcagttcagaatactgccaaaaataagttttacaaagcttctgcaagttagaaagaaagagagagggagaagaagccacgtggaaagcagcaggattcagaatggctttgtacttctcaacactagccctggaatccagaagaccatggagcaatgccttccaaattgtgaagaaaaattacttccaaccttgagttcaatactcagccataaattggaggggaggtagaactaaaacacttttagaaatgtaaggtctcaaaagatgtgcttttcgtgcacactttctcaggaagctattgaagatgccctgtattagtctgttttcatgctgctgataaaagacatacctgagactgagaagaaaaagagatttaattggacttctagttccacatggctggggaggcctctgaatcatggcaggaggtgaaaggcacttcttacatggcagccacaagagaaaaatgaggaagaacaaaaagcggaaaccctgataannccatcagatctcatgagatttattcactatcacaggaatagaacaggnccctttgattcattacttccccc

SEQ ID NO: 730952 - DNA, 230 bp, Homo sapiens
acactagcctcatggggatagtcagtagccacttgggggaaactgaggaccatgaaggagcagaaacaggagggcctcctcctgtaatatgacaacatgctccagagacctttttctgagggtccccagcccaccccaactatgggactaaccatacttgaatctaccccaaaccaagggttaagttcacgcctaagcataaggactaaagtgatgaggctagtgtgtac

SEQ ID NO: 730953 - DNA, 415 bp, Homo sapiens
  misc_feature (31)..(31): n is a, c, g, or t
cgccactagtctcatcagcgccactaccctnatcccatcccagtggcatgaatctgaccctttccaagcacatctcttcctcggcactcttctcaatttgctctggccacagggaccaccaacctgttcctcaaatgtgcaagcccctcctactgcagtgcccttgcactgactgttttctgtaccccaaacactcttctctgcgttatttggctctctcctcatcctttgcggcattaaagaccccttctctgatcatcctatctaaacagctctcccccatgaatctcaattacactacccccattgctttcctacaaagcacatattacactttctaagaatgtatttattgggtgcctccttgtttattggttctgcatcagactataaacttcatgaggctagggcgctg

SEQ ID NO: 730954 - DNA, 393 bp, Homo sapiens
ctacggtggaagcgacgtggccgagggggccttgacggcgttggcggggctgggcacaggggcagccgcagggaggcaggtatggcaaggcgtgaagccaccctggaaggaactggaccaaggtcttcagaggtgcgacagggtctggaatctgaccttactctagcaggagtttttgtagactctccctgatagtttagtttttgataaagcatgctggtaaaaccactaccctcagagagagccaaaaatacagaagaggcggagagcgcccctccaaccaggctgttattcccctggactccgtgacatctgtggaattttttagctctttaaaatctgtaatttgttgtctattttttcattctaaataaaacttcagtttgcacctag

SEQ ID NO: 730955 - DNA, 479 bp, Homo sapiens
  misc_feature (28)..(28): n is a, c, g, or t
cacagactgcgccgggcggttacatctnaatgagcccacagctgcctgttgacctggtgtcatcacgagggtgatcactatttccagcaagctctttgtccctcaaagcccagggatcaggggcagcccgtggaagacgagccactggttccagcgaggcacaaggagagaggttaagctgcttctaccctgttcaactgtgatgagattccagcgaaaatcagcattgagggcctcaggtgtttgcagggggctctggtatgttagaaaaactagagggaggggtctgcctttgtgtctgtttgtgagcgtgtctactcaagtaggaaaggggagcacagatttttacaaaatagatgtgggcggtttcttgtagtcttgcctaactgaaaccatgtttgccagagattacttggaattaccctaataggtgctttgtcaaaatacttggtgcgggcccagacagtgagggggtccga

SEQ ID NO: 730956 - DNA, 546 bp, Homo sapiens
caggatctgatcgaatcgacggttctcccttttatgtttcaccaaaccatttgtagagctacaaaaggtatcctttcttattttcagtagtcagaattttatctagaaatcttttaacacctttttagtggttatttctaaaatcactgtcaacaataaatctaaccctagttgtatccctcctttcagtatttttcacttgttgccccaaatgtgaaagcatttcattcctttaagaggcctaactcattcaccctgacagagttcacaaaaagcccacttaagagtatacattgctattatgggagaccacccagacatctgactaatggctctgtgcccacactccaagacctgtgccttttagagaagctcacaatgatttaaggactgtttgaaacttccaattatgtctataatttatattcttttgtttacatgatgaaactttttgttgttgcttgtttgtatataatacaatgtgtacatgtatctttttctcgattcaaatctcaacccttaggactctggtatttttgatctggc

SEQ ID NO: 730957 - DNA, 283 bp, Homo sapiens
  misc_feature (34)..(34): n is a, c, g, or t
  misc_feature (70)..(70): n is a, c, g, or t
gcttgtgcgaaatcctcctcctcctgctcatctnctcttgctgaatggactctgggagggctactctgcntttctctgagctctcaggtgcagctcacagccttctttgtctccagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcag

SEQ ID NO: 730958 - DNA, 311 bp, Homo sapiens
gtctagagatccctgtggagacgggtctcaggaacacataatggatacaatccagcatgtcacaaagcattatcattctttcttctagattatggcaaagttcctgacttttgttcttccccttgccataagccagtgttggatctggtcttgccttagctgctacagctaacttttaaaaccatcatcatggtcaggcatggtggctcacgcctgcaatcccggcacttcgggaggccgaggcaggtggattacctgaggtcaggaattcaagaccagcctggccaacgtggtgaaaccccgtctccaca

SEQ ID NO: 730959 - DNA, 480 bp, Homo sapiens; identical to SEQ ID NO: 105232

SEQ ID NO: 730960 - DNA, 579 bp, Homo sapiens
gcgactctgagaggatcccctcgcgaacgtgttatcccacatatttcagaatgaaaaaaattaaaatatagactataacaatgaaaggccatatttctttaataagcacgaatcatctttcaaacattattctgctgataagacttagtttttacttccctgaatttcactgcaaccaataatagcacagtcttttcattttttacttaattttagttctgaataggtcatatattcatatggcttaatattttaaaggtaacaaagggtacacatttatcacattttaaactgtggtgaaataattagtagttgagaatgttaatttcaatatgcttctaactagatcaaatctgaaaatatccttaaatatgaccattctaaatacattgctatatactagtatattatattcatttatgataccagtggctttgaaatcaaagtgctacaaattaccaaaacactacagagtcctattagatggctaaatttcagagatttttaaatgccatgcaaactatagtaatgtacagtttatccaatgcatatgcatgcatgggataacacgttcgcgag

SEQ ID NO: 730961 - DNA, 282 bp, Homo sapiens
tgatgactctagaggatcctaagacatggcgaaacacatcaatgccagtcataggagatcactctattttgaaaaatataaaactgtttcattgcaaatctatggaaacaatgtcacaggggccaagagctgtcacttcgagtcaaagaaggcccacttcactgtggcgctgatggccagtgatgtcaaggcgaattacaccccgactcaccaagagagaaatcaaagtcaggagaggaacattcagctagtgacgttcctcatcccagtgacgttcctcat

SEQ ID NO: 730962 - DNA, 310 bp, Homo sapiens
  misc_feature (297)..(297): n is a, c, g, or t
atcagctcggtccagcggaacagcaaggaagtggatgagctgggatgcaaccccaggttgtctggctggagagaaaaacacagagaaagatgccagaaatgaaaggtgggggctattttctcacagaacttaaaatgaattgaggagaggaggccaggggttcccaggtggccgcctgcccacagtgccacgggctggtaggcggttttcttcactagtccacaaataaacgagaaggaagactaggaaatatttaccaagtgaactgtgctggtagaggaaggacagtcttgggtngcttgttccgctg

SEQ ID NO: 730963 - DNA, 479 bp, Homo sapiens
ctcagtgcccaggctgctgccaggcacggtcacgtcaccttgctccagacataagttgttctgcttttttgcaaatcgaggaggaatacgggaggaaaggcctcgacctttgacaggcacctgcacggcctgctccttctttcttctctcttcctccagcaggcggcgctgcttcttggtcaggacttcgatgaagccttcgcccaccatagaacccacctcactctcctccccggggctggacccgcaattttcaatgatggcacttccatagttcaggtcaaactgtttcatggcctctccctgttcacctgccctcggagcagccaacttggcctccttctctgcctttttactggaggcttcgggaaggtcagcactggcatgggctgcccgctccagggcatagggggagtggccactcccactgctgcagccactaagacctccaggcaaggcctcgtctggggcatctgtcc

SEQ ID NO: 730964 - DNA, 618 bp, Homo sapiens; identical to SEQ ID NO: 728728

SEQ ID NO: 730965 - DNA, 401 bp, Homo sapiens
  misc_feature (15)..(17): n is a, c, g, or t
  misc_feature (21)..(22): n is a, c, g, or t
gtagttcagcccagnnntggnngacagcgctggttcccggctccccgcaccatcatggctttgcctctgaggcccctgacccggggcttggccagcgctgccaaaggaggccacggaggagcaggagctcgtacctggcgtctgctgaccttcgtgctggcgctgcccagcgtggccctctgcaccttcaactcctatctccactcgggccaccgcccgcgccccgagttccgtccctaccaacacctccgcatccgcaccaagccctacccctggggggacggcaaccacactctgttccacaatagccacgtgaaccctctgcccacgggctacgaacacccctgaggccccggacgcccccggacacaataaaggtgtgaagcttcaaaaaaaaaaaa

SEQ ID NO: 730966 - DNA, 422 bp, Homo sapiens
  misc_feature (4)..(4): n is a, c, g, or t
  misc_feature (11)..(11): n is a, c, g, or t
  misc_feature (25)..(25): n is a, c, g, or t
  misc_feature (320)..(320): n is a, c, g, or t
  misc_feature (322)..(322): n is a, c, g, or t
  misc_feature (373)..(373): n is a, c, g, or t
  misc_feature (390)..(390): n is a, c, g, or t
  misc_feature (400)..(400): n is a, c, g, or t
cccngagttancctgagcaaaaacngaatgcagccaaccttgagtgacgcaagatacaaagagtcctggcgtaatcttcgtgctcaaggctacaagctgacaatagaagcgctccccttccaggctgcccgggcctctggagatatagccagtgatttgcgctacaagtcagacctgatcggcatgaagggcataggatggctggcgctgagatccccacagatggagagtgcaaagaaggctggagaactcatcagcgagaccaagtaccgtaaaaaaccagacagtatcaagttcaccacagtggttgactccccagnanctggttcatgccaagaacagctattattgcactgcaatggagcggcatgtntagatcttggagatgcnagaattcccntgcacaagatacaaccctgatt

SEQ ID NO: 730967 - DNA, 399 bp, Homo sapiens
  misc_feature (5)..(5): n is a, c, g, or t
  misc_feature (297)..(297): n is a, c, g, or t
  misc_feature (299)..(299): n is a, c, g, or t
  misc_feature (350)..(350): n is a, c, g, or t
  misc_feature (367)..(367): n is a, c, g, or t
  misc_feature (377)..(377): n is a, c, g, or t
tggtnacctggtcatgcaagaatgccaggtctggcagtgccacgactacaggacacagtatcacaagttcacagcactgcccgaggacctgaagatggcctgggccaagaaagcccatgccctgcagagtgatttgcgctacaagtcagacctgatcggcatgaagggcataggatggctggcgctgagatccccacagatggagagtgcaaagaaggctggagaactcatcagcgagaccaagtaccgtaaaaaaccagacagtatcaagttcaccacagtggttgactccccagnanctggttcatgccaagaacagctattattgcactgcaatggagcggcatgtntagatcttggagatgcnagaattcccntgcacaagatacaaccctgatt

SEQ ID NO: 730968 - DNA, 361 bp, Homo sapiens
  misc_feature (6)..(6): n is a, c, g, or t
  misc_feature (10)..(10): n is a, c, g, or t
  misc_feature (76)..(76): n is a, c, g, or t
aatganttgntgaccatttaggaagcagcaccaagtctattacaggcatggtgtgaacttgatgtttgacctgtgnatcaaaattgaaccattgtacagtttggcttctgtttgcttcaaaatatgtagaattgtggttgatgattaatttgcgagactaactttgagagtgtaacagttttgaagaaaacattgaatgttttgcaaatgaaggggcttcacggaatgttacaatgttactaatataatttggcttttgttatgcaaattgttaacaccagctattaaaatatattttagtggaaatgcctttaattcatatttttttcctctacactgtggaatctttaaagcctggtgg

SEQ ID NO: 730969 - DNA, 384 bp, Homo sapiens
  misc_feature (20)..(20): n is a, c, g, or t
  misc_feature (319)..(319): n is a, c, g, or t
  misc_feature (339)..(339): n is a, c, g, or t
agaaatcttgggcctgagtnaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccaaaccctcctcggtatccatggagagcctggggccagatatctggctcatctctggcattgcttcctctccttccttcctgcatgtgttggtggtggttgtggtgggggatgtggntgggggatgtcctggctgangctgccaaatttcatcccaccctccttgcttatcgtccctgtttt

SEQ ID NO: 730970 - DNA, 415 bp, Homo sapiens
aaaatagaagacccaaataaaatcagaaatgacaaaggagacattacaatgaacacacagaaatacaaaggatcattagagactgttatgaacaactatacactaataaattggaaaacctagaggaaataaagtcctgaatatatatatcctactaagattgaaccaggaagaaacagaaaacctgaacagacaaataatgagtaatgagattgaatcagtaatgaaacatcttccaacaaagaaaagccgaggaccaaatggttttactgctgaattttactaaaattataaagaacaggtaacgtcaattcttctcaaactattccaaaaagtggaagaggaaggaattcttcctaactcattctatgaagccagaattaccctgatatcaaaaataagacaaggacatgac

SEQ ID NO: 730971 - DNA, 613 bp, Homo sapiens
  misc_feature (304)..(304): n is a, c, g, or t
  misc_feature (307)..(307): n is a, c, g, or t
  misc_feature (374)..(374): n is a, c, g, or t
gctgatgaggggctgcagcatgcaattcacttcaccagcagtcactaaggtctgatctcttttctaaccatacctggaagatggaatgctggacccagggtatgcatagaaaatgggagttattagaaaagcagctttgcttgctttaacccaggaattgtatttctgacttttagacttggactgggactacaccatcaactttccttggtctccagcttgcagacaacagattatgggacttgccagcctccataatcagaaggctttgacatatcaatgcaccagggatcttaccaaactnaantttaagcacttatagctcaagattctccctctgagatgaaacatacttccaccctgtcatgtgtcancttcagaagatatcaattgctcaagaaagtgttggacaagcagaaaagcacactgaacatttctggacttgtgaaaagctctgaatatggatctctcagggatattccatccccaccaatgctttaccaatgcgagagctggccaggctgagacatttaatgataacatggaacaatttattcaggaagatagtcaactactcatgtggctttatgattataaaacccactgaaaattg

SEQ ID NO: 730972 - DNA, 435 bp, Homo sapiens
ttaatctcaacttaatttcagtaatgaaaaatttgctctatatgccttcattctgcccatgctgttattgtcacaaactacatctttataataattatatgtccatcaacatagttttataattacgcagttttaaaaatcaggagggaagaacaagagttacgaacagatatacattgtcttgctgctccaaaatctgcaatgtaaaaggccccatgcacaagggcaatgtgctaattctgttggagtcatgagtgagaggcccagaggttgcacctcacttggctgctcactgggtcttggatgcagggttcaaccacttggccagtgggaatggtgtgctacgatctgctcctttattttattttttgctcaccacacgggaattgtgatgcacccttaaataaagcatttgtgttccaaattaaaaaaaaa

SEQ ID NO: 730973 - DNA, 530 bp, Homo sapiens; identical to SEQ ID NO: 728729

SEQ ID NO: 730974 - DNA, 774 bp, Homo sapiens
  misc_feature (35)..(35): n is a, c, g, or t
  misc_feature (89)..(90): n is a, c, g, or t
  misc_feature (99)..(99): n is a, c, g, or t
  misc_feature (122)..(122): n is a, c, g, or t
  misc_feature (131)..(131): n is a, c, g, or t
  misc_feature (139)..(139): n is a, c, g, or t
  misc_feature (142)..(142): n is a, c, g, or t
  misc_feature (170)..(170): n is a, c, g, or t
  misc_feature (172)..(172): n is a, c, g, or t
  misc_feature (188)..(188): n is a, c, g, or t
  misc_feature (225)..(225): n is a, c, g, or t
  misc_feature (261)..(262): n is a, c, g, or t
  misc_feature (286)..(286): n is a, c, g, or t
  misc_feature (309)..(309): n is a, c, g, or t
  misc_feature (314)..(314): n is a, c, g, or t
  misc_feature (317)..(317): n is a, c, g, or t
  misc_feature (347)..(347): n is a, c, g, or t
  misc_feature (368)..(368): n is a, c, g, or t
  misc_feature (370)..(370): n is a, c, g, or t
  misc_feature (373)..(373): n is a, c, g, or t
  misc_feature (393)..(393): n is a, c, g, or t
  misc_feature (396)..(396): n is a, c, g, or t
  misc_feature (401)..(401): n is a, c, g, or t
  misc_feature (406)..(406): n is a, c, g, or t
  misc_feature (409)..(409): n is a, c, g, or t
  misc_feature (725)..(725): n is a, c, g, or t
  misc_feature (727)..(727): n is a, c, g, or t
  misc_feature (731)..(731): n is a, c, g, or t
  misc_feature (738)..(738): n is a, c, g, or t
ttatttgtataagaaatgtaagaaaaaaaatatanaaagaagaggataggattttgtttatttgtatggatggacccttggtataaaannacttttggngctttccattcatttggtttagnacagccagngagcttcncgnactttctttctttttttttttttttttnanacagagccttgcttgntctgtcacccaggctagagtgcagtagcacgatcttngcttactgcaaccacggctgccggggggcaaggganncccaggcgcccagccccctgagtngctgggattatggacaaatgccnccacnccnggcgaatttttttttttttttttgtatttntagtagagacagagttttgcngngtnggtcaggctggtcttgaacnccnggccncatangantcacctgcctctgcctcccaaagttctgggaggacagacatgagctaccatgctgcccttgtattttcttatctgtacccagtgtaactacacgtttactggaactgtgtttttaagactgacagttgtttataatggattagtcgtaagtgccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataangnaggngcagaangtagtattttggaggttgatttaaattcagcaacgc

SEQ ID NO: 730975 - DNA, 1870 bp, Homo sapiens
cttgcgttgcacccgggctgagtgcggccgcgacggggcgggcggactctcgggcgctcagagctggcctcgggtcctcggagcctggcgctcgaacctcccttccgacctccacccggaccccgaccccgacccggcctggcccggcccccgcccccgccccccgggccgatggactactcctacctcaattcgtacgactcgtgcgtggcggccatggaggcgtccgcctacggcgactttggcgcctgcagccagcccggcggcttccaatacagccccctgcggcccgctttccccgcggcagggccgccctgccccgcgctcggctcctccaactgcgcacttggcgccctacgcgaccaccagcccgcgccctactcggcagtgccctacaagttcttcccagagccatccggcctgcacgagaagcgcaagcagcggcgcatccgcaccacgttcaccagcgcgcagctcaaggagctggagcgcgttttcgctgagacccactaccccgacatttacacgcgtgaggagctggcgctcaagatcgacctcactgaggctcgcgtgcaggtctggttccagaaccgccgggccaagttccgcaaacaggagcgcgcggccagcgccaagggcgcggcgggcgcggcgggcgccaaaaagggcgaggcgcgctgctcctccgaggacgacgattccaaggagtccacgtgcagccccacgcccgatagcaccgcctcgctgccgccgccgcctgcgcccggcctggccagcccgcgcctgagccccagcccgctgcccgtcgcactgggctccgggccgggacctgggccggggccacagccgctcaagggcgcactgtgggccggtgtggcgggcggtgggggcggcgggcctggcgcgggagcggccgaactacttaaggcttggcagccggcggagtccggccccgggcccttctccggggttctgtcctcctttcaccggaagcccggccccgccctgaagaccaatctcttctagctgccggcctctggaggctccgagcctgcccccagagacgtccctgcccctccaggacctgacagcccctcccatcctggccacccgcctggaagtccccatccgtctccactccctactgtctcacccctcggtgtgtcctccccaactttggagaccaagtcagggccactctcgtcctcacccaccctctaccagcagagcggagttctttataccgggacctcctccaggagaaccccggagctccttctagcttggccttctttggatgcggtatcacatgaggcctgtccctaacagtgccctcaaagtgaaggtcctcaaggaggatcggcacagcccccttccctggctctgcagcggctgggtcaccccttacgctggtgatcaggaaagcccgctgccccacccctcgggcccacccgtacagaggctggtggtcgccgggataattaatgaccaccgccaattcatccctcacgtgtctcctctcttccctagcccgtctggcacagagggtggacctgttagaggagtggaggggctgcctggggaatgggacagagggattctctttccctaatttttttggttgtcctttttctttgaaaaacttgtaatttattgaagttttactcaatccaaataaaacttaatttattgaagacatcacgccgcaacccttacgactgcccaggaggctgcttgcaagaccctgtcccgggctgagacctgcgaggaacctccctcccccaccctgccgccgtgcatccccagagcagggcagcacagaccaggagacagtgagaactaagcaaactggcactttatggctgagatc

SEQ ID NO: 730976 - DNA, 958 bp, Homo sapiens
tttgagctggtcttcatagtcctggctgagcactacaaggtggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctggtcccggacattgccatcaacagctgaacagcctgcccaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagggacaaaccatgaagtgacgaattaaaccctctatattattaattggataaaatgctgtaaaaccggttattagcatgactcaaactaagtttaaatgtttgcatgtctaaagcaactttctggagtgatggatatgttccataccctaggtcacacagctctgtgcatttgttagaactcattggctgtatattttattttatt

SEQ ID NO: 730977 - DNA, 966 bp, Homo sapiens
gacatctttcagtcgcaaatctggggaccctctcataaccgctttctctttctgtgcccacagggacccccgatgatgccaccttaccctggtcccggacattgccatcaacagctgaacagcctgcccaggggttgcagcccaaggtgtactaacccagcacctagagaaacgccggagtctaatgggtgtgtcatagatatctgtcgactcttggagaataatatcgcttcttcctcacttcacagaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagggacaaaccatgaagtgacgaattaaaccctctatattattaattggataaaatgctgtaaaaccggttattagcatgactcaaactaagtttaaatgtttgcatgtctaaagcaactttctggagtgatggatatgttccataccctaggtcacacagctctgtgcatttgttagaactcattggctgtatattttattttatt

SEQ ID NO: 730978 - DNA, 1033 bp, Homo sapiens
atacaccgggcacccagtctcctttcttcctgctgctgctcctcacagtgcttacagctaccacagcccctaaacccgcaacagttgttacgggttctggtcatgcaagctctaccccaggtggagaaaaggagacttcggctacccagagaagttcagtgcccagctctactgagaagaatgctgtgagtatgaccagcagcgtactctccagcctgggtgacagagtaagaccccatctcttataagaaaaaaagacaggaaagaaaagaaaaagaaaatttcttcccacatctggctctgctaagctgagagagaatgggaccccccgttctcttcccacagcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagggacaaaccatgaagtgacgaattaaaccctctatattattaattggataaaatgctgtaaaaccggttattagcatgactcaaactaagtttaaatgtttgcatgtctaaagcaactttctggagtgatggatatgttccataccctaggtcacacagctctgtgcatttgttagaactcattggctgtatattttattttatt

SEQ ID NO: 730979 - DNA, 829 bp, Homo sapiens
atacaccgggcacccagtctcctttcttcctgctgctgctcctcacagtgcttacagctaccacagcccctaaacccgcaacagttgttacgggttctggtcatgcaagctctaccccaggtggagaaaaggagacttcggctacccagagaagttcagtgcccagctctactgagaagaatgctgtgagtatgaccagcagcgtactctccagcctgggtgacagagtaagaccccatctcttataagaaaaaaagacaggaaagaaaagaaaaagaaaatttcttcccacatctggctctgctaagctgagagagaatgggaccccccgttctcttcccacagcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagg

SEQ ID NO: 730980 - DNA, 449 bp, Homo sapiens
aggggttgcagcccaaggtgtactaacccagcacctagagaaacgccggagtctaatgggtgtgtcatagatatctgtcgactcttggagaataatatcgcttcttcctcacttcacagaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtcccattcgctgtggtggcagaattgggatcctctagatcac

SEQ ID NO: 730981 - DNA, 645 bp, Homo sapiens
atacaccgggcacccagtctcctttcttcctgctgctgctcctcacagtgcttacagctaccacagcccctaaacccgcaacagttgttacgggttctggtcatgcaagctctaccccaggtggagaaaaggagacttcggctacccagagaagttcagtgcccagctctactgagaagaatgctgtgagtatgaccagcagcgtactctccagcctgggtgacagagtaagaccccatctcttataagaaaaaaagacaggaaagaaaagaaaaagaaaatttcttcccacatctggctctgctaagctgagagagaatgggaccccccgttctcttcccacagcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtcccattcgctgtggtggcagaattgggatcctctagatcac

SEQ ID NO: 730982 - DNA, 754 bp, Homo sapiens
tttgagctggtcttcatagtcctggctgagcactacaaggtggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctggtcccggacattgccatcaacagctgaacagcctgcccaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagg

SEQ ID NO: 730983 - DNA, 570 bp, Homo sapiens
tttgagctggtcttcatagtcctggctgagcactacaaggtggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctggtcccggacattgccatcaacagctgaacagcctgcccaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtcccattcgctgtggtggcagaattgggatcctctagatcac

SEQ ID NO: 730984 - DNA, 539 bp, Homo sapiens
  misc_feature (5)..(5): n is a, c, g, or t
cagcnactaggctgagtaggggattccccacgcacctgtcaactgtctaatgaccttcattcctgcgcgtgtcttcagcacccccggggcacttggtgtttgttctctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagggacaaaccatgaagtgacgaattaaaccctctatattattaattggataaaatgctgtaaaaccggttattagcatgactcaaactaagtttaaatgtttgcatgtctaaagcaactttctggagtgatggatatgttccataccctaggtcacacagctctgtgcatttgttagaactcattggctgtatattttattttatt

SEQ ID NO: 730985 - DNA, 335 bp, Homo sapiens
  misc_feature (5)..(5): n is a, c, g, or t
cagcnactaggctgagtaggggattccccacgcacctgtcaactgtctaatgaccttcattcctgcgcgtgtcttcagcacccccggggcacttggtgtttgttctctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagg

SEQ ID NO: 730986 - DNA, 702 bp, Homo sapiens
ccccgattatgaatggcggaggcgtgaatggcgtacgcgttgaaggccggaggcgtagaatggccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagggacaaaccatgaagtgacgaattaaaccctctatattattaattggataaaatgctgtaaaaccggttattagcatgactcaaactaagtttaaatgtttgcatgtctaaagcaactttctggagtgatggatatgttccataccctaggtcacacagctctgtgcatttgttagaactcattggctgtatattttattttatt

SEQ ID NO: 730987 - DNA, 498 bp, Homo sapiens
ccccgattatgaatggcggaggcgtgaatggcgtacgcgttgaaggccggaggcgtagaatggccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagg

SEQ ID NO: 730988 - DNA, 314 bp, Homo sapiens
ccccgattatgaatggcggaggcgtgaatggcgtacgcgttgaaggccggaggcgtagaatggccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtcccattcgctgtggtggcagaattgggatcctctagatcac

SEQ ID NO: 730989 - DNA, 946 bp, Homo sapiens
gaggagaggaagaggagcatgcccttcatggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctggtcccggacattgccatcaacagctgaacagcctgcccaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagggacaaaccatgaagtgacgaattaaaccctctatattattaattggataaaatgctgtaaaaccggttattagcatgactcaaactaagtttaaatgtttgcatgtctaaagcaactttctggagtgatggatatgttccataccctaggtcacacagctctgtgcatttgttagaactcattggctgtatattttattttatt

SEQ ID NO: 730990 - DNA, 742 bp, Homo sapiens
gaggagaggaagaggagcatgcccttcatggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctggtcccggacattgccatcaacagctgaacagcctgcccaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagg

SEQ ID NO: 730991 - DNA, 558 bp, Homo sapiens
gaggagaggaagaggagcatgcccttcatggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctggtcccggacattgccatcaacagctgaacagcctgcccaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtcccattcgctgtggtggcagaattgggatcctctagatcac

SEQ ID NO: 730992 - DNA, 969 bp, Homo sapiens
tggtggtaaatggaaatcccttctatgagtacgggcaccggcttcccctacagatggtcacccacctgcaagtggatggggatctgcaacttcaatcaatcaacttcatcggaggccagcccctccggccccaggggttgcagcccaaggtgtactaacccagcacctagagaaacgccggagtctaatgggtgtgtcatagatatctgtcgactcttggagaataatatcgcttcttcctcacttcacagaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagggacaaaccatgaagtgacgaattaaaccctctatattattaattggataaaatgctgtaaaaccggttattagcatgactcaaactaagtttaaatgtttgcatgtctaaagcaactttctggagtgatggatatgttccataccctaggtcacacagctctgtgcatttgttagaactcattggctgtatattttattttatt

SEQ ID NO: 730993 - DNA, 765 bp, Homo sapiens
tggtggtaaatggaaatcccttctatgagtacgggcaccggcttcccctacagatggtcacccacctgcaagtggatggggatctgcaacttcaatcaatcaacttcatcggaggccagcccctccggccccaggggttgcagcccaaggtgtactaacccagcacctagagaaacgccggagtctaatgggtgtgtcatagatatctgtcgactcttggagaataatatcgcttcttcctcacttcacagaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagg

SEQ ID NO: 730994 - DNA, 3310 bp, Homo sapiens
  misc_feature (806)..(806): n is a, c, g, or t
tgctaatgcttttggtacaaatggatgtggaatataattgaatattttcttgtttaaggggagcatgaagaggtgttgaggttatgtcaagcatctggcacagctgaaggcagatggaaatatttacaagtacgcaatttgagactaagatattgttatcattctcctattgaagacaagagcaatagtaaaacacatcaggtcagggggttaaagacctgtgataaaccacttccgataagttggaaacgtgtgtctatattttcatatctgtatatatataatggtaaagaaagacaccttcgtaacccgcattttccaaagagaggaatcacagggagatgtacagcaatggggccatttaagagttctgtgttcatcttgattcttcaccttctagaaggggccctgagtaattcactcattcagctgaacaacaatggctatgaaggcattgtcgttgcaatcgaccccaatgtgccagaagatgaaacactcattcaacaaataaaggacatggtgacccaggcatctctgtatctgtttgaagctacaggaaagcgattttatttcaaaaatgttgccattttgattcctgaaacatggaagacaaaggctgactatgtgagaccaaaacttgagacctacaaaaatgctgatgttctggttgctgagtctactcctccaggtaatgatgaaccctacactgagcagatgggcaactgtggagagaagggtgaaaggatccacctcactcctgatttcattgcaggaaaaaagttagctgaatatggaccacaaggtanggcatttgtccatgagtgggctcatctacgatggggagtatttgacgagtacaataatgatgagaaattctacttatccaatggaagaatacaagcagtaagatgttcagcaggtattactggtacaaatgtagtaaagaagtgtcagggaggcagctgttacaccaaaagatgcacattcaataaagttacaggactctatgaaaaaggatgtgagtttgttctccaatcccgccagacggagaaggcttctataatgtttgcacaacatgttgattctatagttgaattctgtacagaacaaaaccacaacaaagaagctccaaacaagcaaaatcaaaaatgcaatctccgaagcacatgggaagtgatccgtgattctgaggactttaagaaaaccactcctatgacaacacagccaccaaatcccaccttctcattgctgcagattggacaaagaattgtgtgtttagtccttgacaaatctggaagcatggcgactggtaaccgcctcaatcgactgaatcaagcaggccagcttttcctgctgcagacagttgagctggggtcctgggttgggatggtgacatttgacagtgctgcccatgtacaaagtgaactcatacagataaacagtggcagtgacagggacacactcgccaaaagattacctgcagcagcttcaggagggacgtccatctgcagcgggcttcgatcggcatttactgtgattaggaagaaatatccaactgatggatctgaaattgtgctgctgacggatggggaagacaacactataagtgggtgctttaacgaggtcaaacaaagtggtgccatcatccacacagtcgctttggggccctctgcagctcaagaactagaggagctgtccaaaatgacaggaggtttacagacatatgcttcagatcaagttcagaacaatggcctcattgatgcttttggggccctttcatcaggaaatggagctgtctctcagcgctccatccagcttgagagtaagggattaaccctccagaacagccagtggatgaatggcacagtgatcgtggacagcaccgtgggaaaggacactttgtttcttatcacctggacaacgcagcctccccaaatccttctctgggatcccagtggacagaagcaaggtggctttgtagtggacaaaaacaccaaaatggcctacctccaaatcccaggcattgctaaggttggcacttggaaatacagtctgcaagcaagctcacaaaccttgaccctgactgtcacgtcccgtgcgtccaatgctaccctgcctccaattacagtgacttccaaaacgaacaaggacaccagcaaattccccagccctctggtagtttatgcaaatattcgccaaggagcctccccaattctcagggccagtgtcacagccctgattgaatcagtgaatggaaaaacagttaccttggaactactggataatggagcaggtgctgatgctactaaggatgacggtgtctactcaaggtatttcacaacttatgacacgaatggtagatacagtgtaaaagtgcgggctctgggaggagttaacgcagccagacggagagtgataccccagcagagtggagcactgtacatacctggctggattgagaatgatgaaatacaatggaatccaccaagacctgaaattaataaggatgatgttcaacacaagcaagtgtgtttcagcagaacatcctcgggaggctcatttgtggcttctgatgtcccaaatgctcccatacctgatctcttcccacctggccaaatcaccgacctgaaggcggaaattcacgggggcagtctcattaatctgacttggacagctcctggggatgattatgaccatggaacagctcacaagtatatcattcgaataagtacaagtattcttgatctcagagacaagttcaatgaatctcttcaagtgaatactactgctctcatcccaaaggaagccaactctgaggaagtctttttgtttaaaccagaaaacattacttttgaaaatggcacagatcttttcattgctattcaggctgttgataaggtcgatctgaaatcagaaatatccaacattgcacgagtatctttgtttattcctccacagactccgccagagacacctagtcctgatgaaacgtctgctccttgtcctaatattcatatcaacagcaccattcctggcattcacattttaaaaattatgtggaagtggataggagaactgcagctgtcaatagcctagggctgaatttttgtcagataaataaaataaatcattcatccttttttttgattataaaattttctaaaatgtattttagacttcctgtagggggcgatatactaaatgtatatagtacatttatactaaatgtattcctgtagggggcgatatactaaatgtattttagacttcctgtagggggcgataaaataaaatgctaaacaactgggta

SEQ ID NO: 730995 - DNA, 3060 bp, Homo sapiens
  misc_feature (715)..(715): n is a, c, g, or t
catctggcacagctgaaggcagatggaaatatttacaagtacgcaatttgagactaagatattgttatcattctcctattgaagacaagagcaatagtaaaacacatcaggtcagggggttaaagacctgtgataaaccacttccgataagttggaaacgtgtgtctatattttcatatctgtatatatataatggtaaagaaagacaccttcgtaacccgcattttccaaagagaggaatcacagggagatgtacagcaatggggccatttaagagttctgtgttcatcttgattcttcaccttctagaaggggccctgagtaattcactcattcagctgaacaacaatggctatgaaggcattgtcgttgcaatcgaccccaatgtgccagaagatgaaacactcattcaacaaataaaggacatggtgacccaggcatctctgtatctgtttgaagctacaggaaagcgattttatttcaaaaatgttgccattttgattcctgaaacatggaagacaaaggctgactatgtgagaccaaaacttgagacctacaaaaatgctgatgttctggttgctgagtctactcctccaggtaatgatgaaccctacactgagcagatgggcaactgtggagagaagggtgaaaggatccacctcactcctgatttcattgcaggaaaaaagttagctgaatatggaccacaaggtanggcatttgtccatgagtgggctcatctacgatggggagtatttgacgagtacaataatgatgagaaattctacttatccaatggaagaatacaagcagtaagatgttcagcaggtattactggtacaaatgtagtaaagaagtgtcagggaggcagctgttacaccaaaagatgcacattcaataaagttacaggactctatgaaaaaggatgtgagtttgttctccaatcccgccagacggagaaggcttctataatgtttgcacaacatgttgattctatagttgaattctgtacagaacaaaaccacaacaaagaagctccaaacaagcaaaatcaaaaatgcaatctccgaagcacatgggaagtgatccgtgattctgaggactttaagaaaaccactcctatgacaacacagccaccaaatcccaccttctcattgctgcagattggacaaagaattgtgtgtttagtccttgacaaatctggaagcatggcgactggtaaccgcctcaatcgactgaatcaagcaggccagcttttcctgctgcagacagttgagctggggtcctgggttgggatggtgacatttgacagtgctgcccatgtacaaagtgaactcatacagataaacagtggcagtgacagggacacactcgccaaaagattacctgcagcagcttcaggagggacgtccatctgcagcgggcttcgatcggcatttactgtgattaggaagaaatatccaactgatggatctgaaattgtgctgctgacggatggggaagacaacactataagtgggtgctttaacgaggtcaaacaaagtggtgccatcatccacacagtcgctttggggccctctgcagctcaagaactagaggagctgtccaaaatgacaggaggtttacagacatatgcttcagatcaagttcagaacaatggcctcattgatgcttttggggccctttcatcaggaaatggagctgtctctcagcgctccatccagcttgagagtaagggattaaccctccagaacagccagtggatgaatggcacagtgatcgtggacagcaccgtgggaaaggacactttgtttcttatcacctggacaacgcagcctccccaaatccttctctgggatcccagtggacagaagcaaggtggctttgtagtggacaaaaacaccaaaatggcctacctccaaatcccaggcattgctaaggttggcacttggaaatacagtctgcaagcaagctcacaaaccttgaccctgactgtcacgtcccgtgcgtccaatgctaccctgcctccaattacagtgacttccaaaacgaacaaggacaccagcaaattccccagccctctggtagtttatgcaaatattcgccaaggagcctccccaattctcagggccagtgtcacagccctgattgaatcagtgaatggaaaaacagttaccttggaactactggataatggagcaggtgctgatgctactaaggatgacggtgtctactcaaggtatttcacaacttatgacacgaatggtagatacagtgtaaaagtgcgggctctgggaggagttaacgcagccagacggagagtgataccccagcagagtggagcactgtacatacctggctggattgagaatgatgaaatacaatggaatccaccaagacctgaaattaataaggatgatgttcaacacaagcaagtgtgtttcagcagaacatcctcgggaggctcatttgtggcttctgatgtcccaaatgctcccatacctgatctcttcccacctggccaaatcaccgacctgaaggcggaaattcacgggggcagtctcattaatctgacttggacagctcctggggatgattatgaccatggaacagctcacaagtatatcattcgaataagtacaagtattcttgatctcagagacaagttcaatgaatctcttcaagtgaatactactgctctcatcccaaaggaagccaactctgaggaagtctttttgtttaaaccagaaaacattacttttgaaaatggcacagatcttttcattgctattcaggctgttgataaggtcgatctgaaatcagaaatatccaacattgcacgagtatctttgtttattcctccacagactccgccagagacacctagtcctgatgaaacgtctgctccttgtcctaatattcatatcaacagcaccattcctggcattcacattttaaaaattatgtggaagtggataggagaactgcagctgtcaatagcctagggctgaatttttgtcagataaataaaataaatcattcatccttttttttgattat

SEQ ID NO: 730996 - DNA, 1891 bp, Homo sapiens; identical to SEQ ID NO: 329079
  misc_feature (26)..(26): n is a, c, g, or t
  misc_feature (43)..(43): n is a, c, g, or t
  misc_feature (49)..(49): n is a, c, g, or t
  misc_feature (59)..(60): n is a, c, g, or t
  misc_feature (72)..(72): n is a, c, g, or t

SEQ ID NO: 730997 - DNA, 1851 bp, Homo sapiens
  misc_feature (26)..(26): n is a, c, g, or t
  misc_feature (43)..(43): n is a, c, g, or t
  misc_feature (49)..(49): n is a, c, g, or t
  misc_feature (59)..(60): n is a, c, g, or t
  misc_feature (72)..(72): n is a, c, g, or t
acgacggcagtgctcgttatttggtnatagcgtctccagaggntccctngtgagggatnngatcggcattanttgtgattaggaagaaatatccaactgatggatctgaaattgtgctgctgacggatggggaagacaacactataagtgggtgctttaacgaggtcaaacaaagtggtgccatcatccacacagtcgctttggggccctctgcagctcaagaactagaggagctgtccaaaatgacaggaggtttacagacatatgcttcagatcaagttcagaacaatggcctcattgatgcttttggggccctttcatcaggaaatggagctgtctctcagcgctccatccagcttgagagtaagggattaaccctccagaacagccagtggatgaatggcacagtgatcgtggacagcaccgtgggaaaggacactttgtttcttatcacctggacaacgcagcctccccaaatccttctctgggatcccagtggacagaagcaaggtggctttgtagtggacaaaaacaccaaaatggcctacctccaaatcccaggcattgctaaggttggcacttggaaatacagtctgcaagcaagctcacaaaccttgaccctgactgtcacgtcccgtgcgtccaatgctaccctgcctccaattacagtgacttccaaaacgaacaaggacaccagcaaattccccagccctctggtagtttatgcaaatattcgccaaggagcctccccaattctcagggccagtgtcacagccctgattgaatcagtgaatggaaaaacagttaccttggaactactggataatggagcaggtgctgatgctactaaggatgacggtgtctactcaaggtatttcacaacttatgacacgaatggtagatacagtgtaaaagtgcgggctctgggaggagttaacgcagccagacggagagtgataccccagcagagtggagcactgtacatacctggctggattgagaatgatgaaatacaatggaatccaccaagacctgaaattaataaggatgatgttcaacacaagcaagtgtgtttcagcagaacatcctcgggaggctcatttgtggcttctgatgtcccaaatgctcccatacctgatctcttcccacctggccaaatcaccgacctgaaggcggaaattcacgggggcagtctcattaatctgacttggacagctcctggggatgattatgaccatggaacagctcacaagtatatcattcgaataagtacaagtattcttgatctcagagacaagttcaatgaatctcttcaagtgaatactactgctctcatcccaaaggaagccaactctgaggaagtctttttgtttaaaccagaaaacattacttttgaaaatggcacagatcttttcattgctattcaggctgttgataaggtcgatctgaaatcagaaatatccaacattgcacgagtatctttgtttattcctccacagactccgccagagacacctagtcctgatgaaacgtctgctccttgtcctaatattcatatcaacagcaccattcctggcattcacattttaaaaattatgtggaagtggataggagaactgcagctgtcaatagcctagggctgaatttttgtcagataaataaaataaatcattcatccttttttttgattataaaattttctaaaatgtattttagacttcctgtagggggcgatatactaaatgtatatagtacatttatactaaatgtattcctgtagggggcgatatactaaatgtattttagacttcctgtagggggcgataaaataaaatgctaaacaactgggta

SEQ ID NO: 730998 - DNA, 1692 bp, Homo sapiens
  misc_feature (26)..(26): n is a, c, g, or t
  misc_feature (43)..(43): n is a, c, g, or t
  misc_feature (49)..(49): n is a, c, g, or t
  misc_feature (59)..(60): n is a, c, g, or t
  misc_feature (72)..(72): n is a, c, g, or t
acgacggcagtgctcgttatttggtnatagcgtctccagaggntccctngtgagggatnngatcggcattanttgtgattaggaagaaatatccaactgatggatctgaaattgtgctgctgacggatggggaagacaacactataagtgggtgctttaacgaggtcaaacaaagtggtgccatcatccacacagtcgctttggggccctctgcagctcaagaactagaggagctgtccaaaatgacaggaggtttacagacatatgcttcagatcaagttcagaacaatggcctcattgatgcttttggggccctttcatcaggaaatggagctgtctctcagcgctccatccagcttgagagtaagggattaaccctccagaacagccagtggatgaatggcacagtgatcgtggacagcaccgtgggaaaggacactttgtttcttatcacctggacaacgcagcctccccaaatccttctctgggatcccagtggacagaagcaaggtggctttgtagtggacaaaaacaccaaaatggcctacctccaaatcccaggcattgctaaggttggcacttggaaatacagtctgcaagcaagctcacaaaccttgaccctgactgtcacgtcccgtgcgtccaatgctaccctgcctccaattacagtgacttccaaaacgaacaaggacaccagcaaattccccagccctctggtagtttatgcaaatattcgccaaggagcctccccaattctcagggccagtgtcacagccctgattgaatcagtgaatggaaaaacagttaccttggaactactggataatggagcaggtgctgatgctactaaggatgacggtgtctactcaaggtatttcacaacttatgacacgaatggtagatacagtgtaaaagtgcgggctctgggaggagttaacgcagccagacggagagtgataccccagcagagtggagcactgtacatacctggctggattgagaatgatgaaatacaatggaatccaccaagacctgaaattaataaggatgatgttcaacacaagcaagtgtgtttcagcagaacatcctcgggaggctcatttgtggcttctgatgtcccaaatgctcccatacctgatctcttcccacctggccaaatcaccgacctgaaggcggaaattcacgggggcagtctcattaatctgacttggacagctcctggggatgattatgaccatggaacagctcacaagtatatcattcgaataagtacaagtattcttgatctcagagacaagttcaatgaatctcttcaagtgaatactactgctctcatcccaaaggaagccaactctgaggaagtctttttgtttaaaccagaaaacattacttttgaaaatggcacagatcttttcattgctattcaggctgttgataaggtcgatctgaaatcagaaatatccaacattgcacgagtatctttgtttattcctccacagactccgccagagacacctagtcctgatgaaacgtctgctccttgtcctaatattcatatcaacagcaccattcctggcattcacattttaaaaattatgtggaagtggataggagaactgcagctgtcaatagcctagggctgaatttttgtcagataaataaaataaatcattcatccttttttttgattat
